United States Patent 9,328,346 (POLYCOMB-ASSOCIATED NON-CODING RNAS) - sequence listing, part 150

SEQ ID NO: 192483 - RNA, 86529 nt, Homo sapiens
gcgagcggcuguuggaggaaggaggugggggccgggagcgcaaauggcguugagaugguucagggcccuguucaaacuccagcacugaccauucaccggcggaagcggcggcgcaggaggcggcggcggcccagcgggggcacacagcaggcucuguuaccagcuccagcaguggcggccagcgagagcuaggccugggcccggccggcggcgcucgaggcggggagggaaguugcggggccgccgcuccugcccccccaaccgggcuuccuauuuaccgaaagcagagucccucgccucucucggcucucaccugccggcccugcucucccgcgcgaggguuccgcgcccgcccgcgggccguagggagcgggagaggcggaggcggcccguggccaaagcacccgccaggcuccgaggguaagugaggugucgggcggccgccuaggccgggagggagccgggagggugggggaggcagaggcugggagcgggcgguggaagucucacugccucgcccaccgggccgcugaggaaguugggcaggggaaugaccugaggaacucuuuuuuuccccuuuuauuuuccuuuuucggaguucuuuuucgggcgacugcugauugacuuagcuccccaaacccagucaaguguguugauuucagccccgaguccuuucccgugguuucauccgccucuggccgccacuggggccuugcacugccuuaaggauucgguggcagaggcuuccggggcgucgaaagugaccucccuuuccugggcggcgcggguugggaggagaaaaguugcauugagugucuaguccgagggguccaucgcgcccacugcccguggcgccccggcuguccccaggugaggauuucugguuagucagguucgucccguccgcuuuccaucuuuaauggaagcccuuaaagccuuuggggaucgggaagacgcuagauuagggugggagugaaguauaaaggcuuuuugcuuuuuuuuuuuuuuuuuuuuuuuuaaaucacagcgcacuucucucaaaauucgaccugauuuugggcuagggcaaaagccgaacgaccgaaaagacuuagucgucaaucauucuuuccuuuuuaguuaggacagucuuuggaguuuaaagguugagcaagauuguguacuugaaacacuuaaaauuuaacuucaaggacgucugcacacuuauuuuggaaucuguagugcuuuacgcuuagauaaugccauugcaaagacauuuuauugugggaaacgauaaaggcaaucaggaggagauauuauauaaugaacuucucuguacccaucgcuuggauuuagcagugacuauuaaacaaauuuauuucaucuauacacuucucauuccuuaauguuggaaaaucgcugacguuauuucaucaguauuucacuauguauuuguaaaagacguggucuuuuggcacaaaauuauuauuaucauuauuauuauuauuuugagacggaguuucgcccuuguugcccaggcuggagugcaguggcgcgaucucagcucaccgcaaccuccgccucccagguucaauugauucuccugccccagccuccggaguagcugggauuacaggcaugcgccaccacgcccggcuaauuuucuauuuuuaguagaaacgugguuucuccauguuggucaggcuggucucgaacuccuggccucaggugaucugcccgucuuggcuucccagagugcuggaauuacaggcgugaccugccgcccccagccagcacaaaauuauuuuuuaucacauaaaauaauuaaguccuuagugucagguauucaucugaagacuucaaacuuucaacagugaaugcuuugugguuauagaaccauuuuaacaguuuuucugauguuggcauaaaggaacucaagucuagauuuuugguuuggccuuugguuaguauuuuuagaugauuagcacauaagugaauccaaaacauuccaucuuuguugguguguauguguacguacacuuacagaccugcaggaucucagcuuuacauucuugaaggaacagagaaucgauuuuuauuuuguuguccgugguaguugcccaguauccuguuuuguuuaggcuguacuuaacaagaaagacaguaagacuuguuaguguuagagcugcaguggaagaugaaauacaucuccuucaggaacacuguuuucucuuaacgcagauauguaugaugacuaaauuauuaccuugucaaauuaaaauuggguucucaccaaacaugggggggggucuacuacugaauuuauauaaaacucagacagugacucauuauaaaugguaagaauuuaaguuaaucaagggaaaacaaguguagaucaaaacauauucaaaaguauaggucaaauauaauuucaauucuuguagcuuucaaaguaaugauuuuucauuccuuaggcccuuguucacuuuuuaaaguuauauucgauguauucauguuugaacuguagaaaggucaaaguguuagacaaacgguuacugauugaucauguuuaaaaaguacuauaacuuuuuaauaggcacagaacuaaugcaaguaacuuguuuuaaaaaauguuugacucuugauuuacugcccuaaagauuuuuuuuuuuguccugugaaguagauaaaucaggugaaucgauuugccauuuauaaauugaaaaggaaaauaaaaguuguauguuucuaugucuguauuaauccaugaaacaguguaauaugcuggagcucacuagccccagaaaauauaacucagcaaaugagcacagcacuaucgggacaaggcagauaggauaaggauaguuucuuucccuagggagaugaccaucuaaggaacauuuuuaaagucacagcgcaaauuacauuacaccaagaagcagaaucuucaagauuggguuaaaagcugcagguuguaaaacaugagaaaaagcaccauuuuggggaccuuuuuucucaugugaauuagugccaugaaauuucaaagaacuaaauuuaaucaaguauuggauauuucugaggcccugaaaaaaacuaacauucugugcuuaagauuuuauauaaguaauuacccuauacagguuaucauuauaucacugcaaccuccaucuccugaguucaagcgguucuucugcuccagcuucucaaguagcugggauuacaggugcgugccaccacucccagcuaauuuuuguauuuuuaguagagaugggguuucaccguguugggcaggcuggucucaaacuccuggccucaagugagcugccugccucggccucccagccucuauacagauaauuuuuuaagguaaaaaugauguuuauaagaauaguaaauuaauucauuuggaacuuaauaugcuucauuuuaaguuagcuuuauggauaucguauuauaaguugguuaaucauuaaguuuuuuuacuuuguaaguagcguaggaauauguacucauuguggaggaaaauugacauggaagcauguaggguaauaaaucagccuuucuuuauaccccuuccucauauuuguuuauuuaaaagucuguguggugagugucaaaagucaugagggaagaaucccuagguuuuuauuuuuauaugcacuguuuaacacuuguauuugaugauuauauguuuucuuaaauuuuuuuucacagagaauaugaaacuggugucaaaaugacauccagauuugggaaaacauacaguaggaaagguggaaauggcaguucaaaauucgaugaagucuuuuccaacaaacggacuacccuuagcacaaaauggggagagaccacauuuauggcuaaauuagggcagaagaggcccaauuucaaaccagauauccaagaaauuccgaagaaaccuaaaguggaagaagaaaguacuggagauccuuuuggauuugauagugaugaugagucucuaccaguuucuucaaagaauuuagcccagguuaaguguuccucuuauucagaaucuagugaagcugcucaguuggaagaggucacuucaguacuugaagcuaauagcaaaauuagucauguggucguugaagacacugucguuucugauaaaugcuucccuuuggaggacacuuuacuugggaaagaaaagagcacaaaccgaauuguagaagaugaugcaagcauaaguagcuguaauaaauuaauaacuucagguaaguuuugauuuucuuuauucuccgccaagagagcuuugugcaaccaauuuauuuaaaugauuuaaauucuaaaauauauauuguguuuucuuucugcacuuaugauacauggggaccauugauaguuuuguaaaagacauuuaagaacuuuaaagaaaccaguuggagguugaaauaaacaacuuggauguuaacauuuauagacuguugcgcaggguacguuuugggaacagucauaaguuuauaaccccaauuccaauaagaaauaucucuuuuuguuguguuaggaucacaaaguaucucauuucuauuacuguggaggauuuggaugguuauugauaaugaaaaugagaugaguauuuaaaaugaggauuaguuaccaaugguagacucucugccaaaacuaguucagaaagauuaaggggguauugaguggagacauuuaaagaauugaacuugauuccaaauugagauuaguuuggggccaguaucaacuuguauugauagauuuuuuuuuuugagaaggagucucgcugucgcccaugcuggcuccgccucccagguucaugccauuuuccugccucagccucccgaguagcugggacuacaggcgcccgccaccacgccuggcuaauuuuuguauuuuuaguagagacaggguuucacuguguuagccaggauggucuccaucuccugaccucgugaucugcccgccucaccucccaaagugcugggauuacaggcaugagccaccgugcccggcuguguugauagauuuuaaaccacaaaacugguuguauuuuaaaaauguuaauuuguaaauauagcaucuaguauucucuccuaaaacgauauauuuuguucugucuucuguaagggauuugagauuuauaauaagugaaaaaggugcaauuaauuaaaagacugaagagcuaauauugaggguggcagggaagaggugggguggagaagugggagcacucuaucagcauuaggauaaggguggcaguauacuguaauugaaaagaaaccuuaguucuugacgucuuggcaaaguuuagcaauaaugagagguuauaaaaaucuccuauuuugaaaggaaguaaacacagacaaaacuuggcuguacugaauucuuaaggcaaauuuguccuuugaagguuaagguaugugaaacaguacaauguacugggccuugcauaguuuuacuaaaaauguugagcauuuuuucacucuuuuucucacucuuggaugagacgaugagccagcuguuauugucauucccuugauccucaggguuaauucuaauuuggcuguccuuccugcuuugcccacauuucuccucaggcguuguugacaaguuaaguuuagguuaaauuuccauuaaaaaacagcguaaaggaccugugcaguggcucaugccuguaaucccagcacuuugggaggccaaggcaguuggaucaccugaggucaggaguucaagaccagccuggccaacauggugaaaccccaucucuauuaaaaauacaaaaaauuagcugggcaugguggcgggugccucuaaaucccaccuacuacggagguugaggcaggagaaucacuugaacccaggagacagagguugcagugagccgagaucgcaccacugcacuccagccugggcaacaaagcaagaugccaucucaaaaaaaaaaaaaaaaaaaggcauagacagcauaaaaacuguuuccaggucagcuccuaaaaauguauaaauguauauuaaaaucaucaaacuuuuuuuuuugagacacagucucgcuguguugcccaggcuguaguacaguggcgcagucuugccucacugcaaccuccgcuucccggauucaagugauucucccaccucagccuccccaguagcugggauuauaggcaccugccaucaugcccagguaauuuuuguauuuuuguagggacagguuuucaccguguuggccaggcuagucucaaacuccugaccucaagugaucugccuaucuaggccucccaaagugcugggauugcaagcgugagccaucgcuucuggcccaucaaacuuuuuuugaacuaaaaugaauuuuaacucagcucucauuuuauauaagaagcucaaagagguuaaaugacuguccaaggucagcuaguggcagaacuggaaugagauucguuuauuaucaacauauugagcaccuacuguccgucaaaccacuguacaaggcucugcgaaugcuauucugcuuguguuuguuguuccaacugacauuucuuuuuuuucuuuuuuuuuuuugagaugaagucucgcucuuguccccccaggcuggagugcgauggcgcuaucuuggcucacugcaaccuccgccucucggguucaagcaauucuccugccccaguccccccgaguagcugggauuuuaggcaccugccaccaugcccugcuaauuuuuguauuuuuaguagagacggcguuucaccauguuggcccggcuggucuagaacuccugaccucaugugauccacccgccuuggccuccccaagugcugggaauauaggcgugagccacugugcccagccugacauuucuugauguuuucagauaaucuacaguguggggugggugggccggaggaaguaagauuaaacugugcaaguggugaaagugcucagggcugacuccaucuuccuuaaguguauggucuuuugaggaauggggcaucauuggcaggcaggggcccugauggcagaguguauuaauaaaguugaacguuuagguaagggggaaaaggaauguggaaguuauucauaaguaauuguuucuguagcuuugcggacaauauaucuuuauguuaaaucuguuguuggaaguugguuggugagaccaaccagcuaagugggauaauugcuucccagucuauguagcuaaaauguaguucuaaugcugauacuguggacugacucugaguccaaacuccauuuuaauuggucugugaggggaaaauacauacuaaaauacagguaaauagauguucaggaacaucuuguccaucuuccuuccuccuucacaaagggucucuuaguggucagggaaugguguagcacuaugaauauuucuuuuuuucuccucucccuuggucauccagaguugcaacaaccuuggcagcucccuguaggauaagaagugaauuugagggagugcauuuaauuuucaugguagacuuauccugucucuaaugugugcaaguuaguuguucuuauaaaccauuuguaaguuuguauguuuguaaguuuguuauaguuguggggaugcuuuuguacuuugugacuuuuccuuugucucuccccucuaaacuggucauuucucuugugccuagacuguuuucuugcauuaugucugucaauuuucauugccuuuacucucacucagaaaaccuuguaauuuuaauugaaauuuagaaacccaaaccuaaauuuuugauaaaagaggccucucuaaaucucaagugguuccuaaccuuuuuugcuuuagggacccuucugagaaugauaaaguuuugaacucuuuucuccagaugcaaguauucauguaccuacuugggucucagaaaucuuagcagucuuuugcaggucaugguuaggcauuuuauuuaaaaaccuguugcaaauuuuaacaacucauucaaagugcacaggugaaguuccgucauaucuuuccaguggaguguugaguguccuucucguucauacuauuuuuuugcuguagaauuauaucaccucagugaaaagggcuuauccaggcucagaauuauuaugucauuuguccuggcauuacguuuuuaagugcaucucuuucucuauaggggaguaugugguugauuuuuuugacacuguuaaaauucuuuaaguacuuuuauaacggauaguacuuuuaaaaauuuuguugcggguguggcggcucaugccugucaucccagcacuuugggggagguucaggaguucgagaccagccugaccaacauggugaaaccccgucuuuacuaaaaaaaauacaaaaauuaaccaggugugguggcgcaugucuguaaucccagcuacucaggacacugaggcgggaacugcuugaaccccggaggugaagguugcagugagcugagauuaugccaccgcacuccagccugggugacagagcaagacuccaacucaauaaauaaguaaauaaauaaauuguguuucacuugaagaggaaacuuaggaugaggucacuauaaaacauacaguggcuguaauccagcacuuugggaggccgaggcgggugaaucgcuugaggucaggaguucgagaccagccuggccaacauagugaaacccccaucucuacuaaaaauacaaaaaaauuagcggaaauugcuugaaucggggagguagagguugcagugagccgagguggugccacugcacuccaacuugggcaacagagcgagacuccaucucaaaaaacaaaaacaaaaaaaccccgcaaaaccuacaguaguucccauuuuccagacagaugcuugguggguaagggaaccagaaacaagauuacaaacugaauagguacugcagggaaggguuguguugcuaaaauguccuguuccuuaaacaagaagaaaacguuuauuaugaaacuuuucaggcacacaaaaauagaaugguaaaaaaaaaccucauguacuugauuguccaccuccaauaguuguaucuggcagaucuuguugcaucuguuuugcacgcuacucucuccacuucccauccuuuacucccuggauuuuaaagcuaguuuaagauuucuguuucuaucugcaaauacuucuguaucuaaucuuuaauuuugaaaacagaaauuucugauugcaguugcuauuaaagccagucaguucucagccaggugugccaauuaaaaaugacuguuagcaggagcuaaagguccacccuucuaagagaucuccagguauuccuuaaugguuugaaucaaugccgucgguaguagaggcaaaaagaaggcuucucuugccuuuuaugcaaggcuacuuccauuucucaucuuuguucugcuacagguuuuuaaucuggacucuagaauaaagugugcaaagacuuauauuucggcuuggcacacuuuucuugccagccagcugggauucagucuacauauccugccaaauauugagauaacuacagcauaggcucuuaauuugccugacugguuuuguagccaauaaauuuuuuuaauuugcuuaaagcuguaaugaguauuuguguaaguuagagggaugguauugucaggagauuuugaacuuggauuuagaacugaaggugauuuuuuagaaagggaaauguuuuauuacugaaaguuuaaaguaggacaggaacuugugaucugagaugagauugucauuggauaaaguacagaugauaugaggauuauuauuauuuuuuaaguccugaaaggauaguaucagcaagaguuaccugccuuuauuuauugaauguauuuguuguguagaauauauuuaaaucauaccgaaaaucagcuucuuuuuaagagaaguggauaagaccuauuauuucuuuuuuuauuuuuauuuuuauuuuuuggagacagggucuuacucucucauccaggcuggagugcauggcuuaucacagguucuaccuccugggcugaagccaucuucccuccucggccuccccaguaguugggaguacaaugguucaccaccacacugggcuaauuucuauauuuuuuguagagaccgugucucaguaugcccagccugguccugaacuccugggcuugaguaguccuccugccuccaccucccgaaguguugggauuacaggcaugagccacugugcccggcccuguuauuucuuaaauuccuacuuuuacauaucaauugauccuuaaucacaacuguauaagggaggcuuuauuuccauuauauugaggguaaggcacaguucagagguugaauaacuugaacuguuaaguggaagaucugggaaacauccaaaguguucuuuucauacagugcuguuguauucugaugugaaugagauaaauuuugucaucuucaaagcuguauauuuagaagagacugucacuguaagagcaguuuuaucuugauguuggaaauaaaguuauuuugcaaggggcaaauuauggauucccucuugucucuguucaaguaauuuucugcuuuuuuuaauuuuaaagaugugauuuuuguaaagaggugggaucuggcugucuugcccuggcuggccucaaacuccugggcucaugcagugcucccaccucagccuccugccucagccuucugagaggcugggauuacaggcaugccaccuggcuuaaguaauuuucuuuuuaauaagaaugaugggccaggcaugguggcucacaccuguuaauaccagcacuuggguaggccaaagugggaggauggcgugagcccaggaguucaaaaccagccuggucaacauagugacaucccauuucuucaaaaaaaaaaaaaaauuagccugauguguuggggugcacccguaguuccagcuacuugggagacugaguugaggaucacuugagcccagcaguucagggcagcagcgagccaugauugggucacagccugggugacacagcaagauaccaucucaaaaacaaaacaaaacaagaaugaugaccaaacuauuuuuaauacuuaccgaauaaaguuuuugacuugauuuuuauagauauuuucuacuacuuauuuucauauguguauauaaauggaaauucaacauuauguaaauuaugaaagaggcauuauaauuuuaaguaaauucauuuuguucuaaagcagaacuuuuguuucuuacucagauuuucugaggaaaaggaguauuauucucaagguuuguauauuaacaaacgcaugggagaccacuaacaaauuucuucucagauccagauugaauaccagcuaugggguaaaauaugaaauuuauaaacauagccucuguacuuuagaguuacugacuucugcuggucaugauaaagaacuagcuucuaacaugacaacacuuuuauauaauacauuaugcuuuucagagcauuuucccuaaguauuuuaugcuuuuagaacuugaagccagacagccgggugcgguggcucacaccuguaaucccaacacuuugggaggcaaggcggguggaucacgaggucaggaguucgaaaccagccugaccaacauggugagaucccgucucuacuaaaaauacaaaaauuagccaggcgugguggcgugugccuauaaucccagguacucaggaggcugaggcaggagaaucgcuuaaacccgguaggcagagguugcagugagucaagaucaugccacugcacuccagccugggcaacagaacgagacucugucucaaaaaaaaaaaaaaaaaaaaaaaaggccggguggaguggcugaugccuguaaucccagcacuucgguuuggaaggccgaggcgggcggaucacgaggucagcaguucgagaccagccuggccaacaugguaaaacccggucuuuacuaaaaauaacaaaaauuagccaggcacgguggcgggugccuguagucccagcuaguccggagccugaggcaggagaauugcuugaacccgggagguggagguugcagugagcugagaccaugccauugcacuccagccugggugacugagcgagacucugucucaaaaaaaaaaaaaaaaaccaaagagcuucgagccagaugauaccucaugaauuuuucuuuuccagcacuugugccuuuaggaaguaguacucaacuuuccuagaccccugaugguagaggaggaugaguuuguucauaggaaggucuacggggaugccuccuuccagcuauuauuuuaguguccaugaacaagauggacucacuugcauuucucgcauuguacuggggaagauagaauaaacaaucacaagugugcugaaaaggaaaaaauauauagaguggugcgggaguguagcacucuaugggcuuacuugcuuguucuaggggugcagguacguaggcaaggcugauauuuaaccugggaccuguuggugcacugagaaaggauagaaguggcagaguuuggugacaugagugaugaggaaggaggcaucaggaauuauucccagcuauguaaugugagcagcugagcagaugguagugucauuuacugagauagggaacauuuugacagaaaguuugaguucaguuuuggguacauuggguuugagauguuuguaagauauguuucaguggcagauuugcuggaauggagcugagauaagaagccuugauuagagacaauuaauucgaaauucaguauauaaauauuaucuggaaagaaaggauuaguugaagucauuaaagagaguguaagaggaaaaaguauuaggacugugcugugaaggacuuccaauacuggccgggcgcgguggcuuacgccuguaaucccagcacuuugggaggcagaggcgggcggaucacgaggucaggagaucgagaccacggugaaacccugucucuacuaaaaauacaaaaaauuagccgggcgugguggcgggcgccuguagucccaguuacuuggagaggcugaggcaggagaauggcgugaacucuggaggcggagcuugcagugagccgagaucgcgccacugcacuccagccugggugacagagacucugucucaaaaaaaaaaaaaaaaaagaacuuucaauacuaauggagggggagaagaggaagaaacuagaaaaggaaauucaguaggagcagcuagagcagcuuaagggaaaccagagaagugauauauuauagaagccaauguaaaaguauuucagaaaguauugacugacgcggaaugcugcugccaucaacuuaagugaggacugcaaggcagaccuuggauuugcagcuuggacuggagugauccaaggggugaggaaaugggggguaacaaguguuuacaacuuguuaaagauguucgaaggggaggagaagaaaaagggcagcuagagggaugugagggauucuagaugguuuaaugcgugggauccaaagcgcaagagaaccguuuuggaagaaggggugcuauguuuggcuggaaggaggaaaguugaguaaaaagaugagcuuagugggaggacauaagagaaggugguuuauagcuaaaaguguguuuucccuuaucccauaaaaugaccaaagagguuauuacugaaagggacaaagaaaggcaggguaacuugggggguuugggggagcaggaaagaguucagauagauguuacuuaaagugggagaaugagcugucuagagacaaaguagaauuucuggacauuauugaggccuuaguugaaguuggugucacuaaaaacacauggucacuaaucuaccuaguguguauguuuuuuuccuccuccucuaguaggccccauuaucuggaaccuggacagaauacagaauauuggauaagauuauuagaauuguccucaauagacauuuugucagucagcauguggaaugaagagauagagaagcaagggaauuuaggguguuauugcccagagagagauugagaagauagacuguggaauuuaaaaugcugagugcccggacagggcuaaugaauaggagaaaggggagaaagggguuaguauacugagaaucuucuuaaauaaaaaugaagaaugggaguacuggcacaagcaaguuggaugguugguagguugugauuaaaaaaaaaaaaacagugggcuaucugauuuuaauguuuaugaagugaagcauuuuaggauauacggcaagcuucuggaugcaacugagaacugguggcugagauggaaugcggaagauuguugaugaugagauaagguuaaagaacugggaaaucagaggguuggaauuugguggaauucagugugauagcaaaauugggauggaggaguagauuauaaauaugguguaaaauccuuaaauacaugaacagugaauaagagguugaauaagagguuguuggaugacaaguauuaggaagauuagaggguaacuagcacaagccuuaaaagaaggggcuuuaauuuuuuuuuuuuuuuuuuuuuuuugagacagagucucgcugacgcccaggcuggagugcaguggcacagucuuggcugacugcaaccucugccucccggguucaagcgauucuccugccucauccucccgaguagcugggauuauaggcgccugucaccacaccuggcuaauuuuuguauuuuugguagagacgggguuucacuauauuggccaggguggucuuggacuccugaacucaggugauccgcccgccucggccucccaaagugcugggauuacaggugugagccaccaugcccggccacuacuuuuuuuuuuuuuuuuuaaaucuuuccuuacuuauuuuuguugucuuuuuauuauuauuuguuuagucuuacacaagaaaaucagagaagccaagaaggggcucuuauauaacaggguggaggaguaaucauuuuauaaagaggcucuggagagucagcauaucaguguccccaaacuguccugcucugaaauaguagggagggcugcaggaaaagaggcacccuuaguccaguguagggcaaagaagugguagaaagaaugaaccccagguguccuuuuaauuuuuuuuagaaacaaggucuuucucuguugcccaggcuggagugcaguggugcgaucauugcucacugcaaccuuaaacuccugggcuuaagugauccuccuacccccacuuccugaguagcuaggacuauaggaacgugccaccacuccuggcugauuuucaaaauuuuuuuuuguagagagagucuugcuuuguugccuaggcuggucucugacuccuggaugcaagugaucccccugcuuuggccugccgccccucccaccccaagugcugggauuacaggcgugagccaccacacguggccaauauugacauuuuaaaauauaacaugcaguuuagaugucauagugauuucuuuuaacuuuuuuaaauuguaaaauaaaacagaaaaccacacaaaagggucuagcuuaauuaauuauuagaagaggaacacuccuguaaccauuaccuaaguuaggaaauagaauugugccagccaguuuagaaguucuuucaugcaucacuuccuccuuccucacccucaaaguauuuuguuuguuuguuuguuuguuuuuguuuuuggagauggucucgcucuguugcccagacuggaguacaguaaugcaaucauguuucacugcagccucaaucuucugggcacagguaaucuuccugccucagccuccugagaaguugggaccacggguguguaccaucacagucagcuaauuuuuuuugauuuuaguagagacaaggucuugaacuccugagcucaaguaguccucacaccuuggccucccaaaguguugguauuacugucaugaaccagugcuucuggcccauaauuauuuucuugcuugcaaaugccauaauuacuugcuguucauucucuuuuuaaaauuuuuucuuuaauaauuuuucuuucuuacaaguccccauuaugccccagaaacuguucacuuucguauguuuaaaaaaauacaagaacaugcucuucaauagccagaauauaguguuccuuguucuuuuugaaauuguauuucuauccuacuuccccuucagaauuuuauccuaaugauuauaguauuuauguuuagucuuuuaguggucauccuuuucauaauucuugguauaaaaauauguauaugcauuuaaauucaaauuuuuaagagccgaggcugguacaaaaauauguauaugcauuuaaauucaaauuuuuaagggcugugaccgggcgcgguggcucaugccuguaauccuagcacuuugggaggcugagguaggcagaucacuugaggucaggaguuugagaccagccuggucaacauggugaaaccccgucucugcuaaaaauaaaaaaauuagcugggaauggugacucgcgccuguagucccagcuacucaggagguugagacaggagaauaucacuugaacgugggagguggagacugcaccacugccuuauugacagagcaagacucugucuccaaaaaaaaaaaaaaaaaaaaaaaaagaguugggcacuguggcugaagcuuguaaucccaguacuuugggaggcugagaugggaggaucgccugagucuaggaguuugagaccagccugggcaacauaaaaaaaacauaaaaaaauccugucucuacagaaaaaaaaacucuacagcuuuuaggaauuuuaugugacuguagugcucuaaacuguuuuaaaaauaauucuguacuacaucaugaucacaguuaucagugcuuuuauuuuuuuaaucaaaugcucucagaauauuugaucaaacuugaaugcuauaaucaaacuugaaugcuguauauauuaaagauaaaauuuauuggaaauguaucuuuuaagagaugagugggcuuuuuucaguuaguuuauauauauaugaaugaauguuauugcuaaaguauauaaagguuuuggacaaaaaaguucuuuggcaucaauuuuauuccuauuuuuuguuguuuuuuguugucaagauggagccucgcuguguugcucaggcuggagugcguggcuacucacacaggugugaucauaacagcagccucaaaugaaccgcuggccacagugcccuggguagcucuaggugggacuauaagcacguacugcuaugucccuguuauuccuuuuucuuuuuuuuuuugagacugagucucgcucugucgacggggcucacugccaccucugccucccagguucaagcgauucuucugccucagccucccaaguagcuuggacuacaggugugugcuacuacgcccggcuaauuuuuuguauuuuuuaguagagauggggugucaccguguuagcuagucuggucucgaucuccugaccucgugaucugcccaccucugccucccaaagugcugggauuacaggcgugagccaccgcaccuggccugaugguugcuuugagauaaaauaaauuaauagaaaguauuuagaauacuaccaggcacauaccgagggcuuauauaaauauaguucagcuuuguuuuacuuugaguuuuaauugugagugaaauugaguauccuucauaaguuauuuaauucauuauagauauauauuuuaaugaauugcuucuuuguguucuuggcuuauuauuuauucauuuauuuuugaggcagagucuugcucuguugcccaggcuggagugcaguggugcuaucucagcucacuacaaccucugccuccuggguucaaacaauucuugugccucagccucccaaguagcgaggacgacuggcaugugccaccacgccuggcuggguuuuuuuugucuuuuuaguggagacaggguuucaccauguuggccacacuggucucgaacuucuggccucaagugaucugccugacucggccucccaaagagccggcauuauaggccugagccauugugccuggccccuagcgccauuuucuacugggacauuggacuuacugauguguaaggauucuugguauauuaaggaauuuaccuuuuguguuucccuagcaacuaaugauaagcauuuuucauguguguauucuuuuuuuuuuuugagauggagucuugcucugucacccaggccguggugcaguggugugaucuuggcucacugcaagcuccgccuuccggguucacgccauucuccugccucagccucccggguagcuggaacuacagaugcccgccaccacgccuggcucauuuuuuuguauuuuuaguagagacggaguuucacuguguuagccaggauggucucaaucuccugaccugaugacccacccgcuucggccucccaaagugcugggauuacaggcaugagccaccacacccggcgaaguuuguuuucuuaucaugacagccauucagauauuuaaaggcagguuucauguaauggcaguuuucuuccaucccugcaccaauuaaaccuuucuaguugccucaacuguauuucauggguuauggucuccaagccacuuuguaucauuugcacagauuucuuacagguuaaaggcauuguuuaaguuuaguccucagcacaccgugagauaaacauuugcuauuuccaccucagccucccaaagugcugggauuacaggugugagcccccgcgcccagccagugaauuaguuuuguuguuguuguucuuuuaaacagagucucgcucuuuugcccagguuggaguacagugacaugaucuuggcucacugcaaccucugccucccggguucaagcaguucuccugccucagccuccugaguagcugggacuacaggcgcccgccaccacgccuggcuaauuuuuguguuuuuaguagagacaggguuucaccauguuggccaggcuggccucgaacuccugaccucaugauccgcccgccuuggccucccaaacugcugggauuacaggcaugagccaccacgccuggccuagcauuuuaguguuuagcagccaccacuagacguaguguaauauaguuugguaugggucuuuuuuaugaagucucuuuugacuauugauuuaauugagaaccucugcagucauuagccccucugggccuuuuuuucucaucuguguaaugauggguuugguaagaaaucaaaggaaguaucuucauuuucuuauaagaggguaaaggaagucuguauauauuuguguguauagacuaguauacaguuacacagauguauacauuuguguguuuaugucuacaaaaauaaugucuauuuguaucuccaucuccauuaaacaguucaacuguuuaaucuucaacaaacaauucauugccagucuuguuucauuuuuauccucacuaaaguaaauucaagauguuguauuugauucauaaauauauuuuuuuaacagauaaggacuccaaaaauauacaauuuuggcauuuuuuauguuuuggcuuuugaauagacaacuuacaugcaguauaaaauucaagaaguaugaaagucuuuucuuguuccuuaucccuuagucauuccaucucuaagagcauccauaucuguacauaauguagagcugccucauucuuuuuaacaacugcauaguauucagguguguugcuauaugguaauuuaauucuuuauuaauugguauauuguuuaugaaagcaaaaaccaggaaacaguguucuauugaguuucuuguuacuuauguaauuuuguguucguggaaaguuauuucuaaauacuuguaaaugaaacugcuggcuucaagaguaaguccuuucuuucacauguacauuuuuaguuuuaaaagauauuaccaaaucuuaaccuguuaaauuacauuaaaacccuuuggaggcuggacgugguggcucaugccugugauuguagcacuuugggaggcagaggcaggacguuugcuugagcccaggaguucaagaccagccuaggcaccguagugugacccugucuguuaaauaaaaaggggaguuaggcaggugugguggugcacaccuguaguuccagcuguuugggagugcugcucaggaggcugaggugggaggaucacuugaggccuggaggucucugaagcugcagugagcugugaucacaccacuguauuccagugugggugacagugagauccugucuugagggcaggaaaaccuauuggguagaauuaaaaauuaugcagugaaucuguccauguaaagcaucccucucaccuguauuugaugaugcuaauugagauuuguaaauagcuuuucuuaaauguagauguauuuuguagaaguaauuuuauuguuuggcauaggguauacauuuugucaguguuuuucuacaaguaaauguugagggaauuaauaauaccaguuggaaucauauuuguaucucauuuggaaagguuguaaaaauguucugauaguaaaaauugaaggcaacaaaaaugaauucuccacauaccagaugaauaggcaggcugaggauuuauuacuggcugauaugcauaaauagccacuauuagccauuuaacuaacacaccagaacuacugcuaaaaauucccuugagauuauauggcauuuaggauuagaagaaagaacagaaauagcuagagaaaccugauccuauggacagguuucuggauagaacuagcauaccuuaugggcagcccuaucccagauaaauaaaaacacugguagaagguuuuuauuaacuguucaguugguuuagguuuuacuaaaugauuuuuaauuuaagcaucuuuauuugaaaagcccauaauaccccuaagaagguuuggcugagucauuuacaugucauucugaauggauucaguugcuuaacccugcugaaauuucuugugaguuuacaauuuuaagggacuugguugccugaggaaaggucaguagaaggcaugagagcuauacacugaaaagauaggagaggaaaugucugauauguaaauguuaauuucuucacaacuuaaaauuauuugcaguucuuccaagauugaucauauacuauugauuaaccacauauauguuauuuauuaacuuuuauguugauaccacucauguuuuuauccuuugacuuauuuuuacagauaaaguggagaauuuucaugaagaacaugaaaagaauagucaccauauucacaaaaaugcugaugacaguacuaagaaacccaaugcagaaacuacaguggcuucugaaaucaaggaaacaaaugauacuuggaacucccaguuugggaaaaggccagaaucaccaucagaaauaucuccaaucaagggaucuguuagaacugguuuguuugaaugggauaaugauuuugaagauaucagaucagaagacuguauuuuaaguuuggauagugauccccuuuuggagaugaaggaugacgauuuuaaaaaucgauuggaaaaucugaaugaagccauugaggaagauauuguacaaaguguucuuaggccaaccaacuguaggacguacuguagggccaauaaaacgaaauccucccaaggagcaucaaauuuugauaagcugauggacggcaccagucaggccuuagccaaagcaaacagugaaucgaguaaagauggccugaaucaggcaaagaaaggggguguaaguugugggaccaguuuuagagggacaguuggacggacuagagauuacacuguuuuacauccaucuugcuugucaguuuguaauguuaccauacaggauacuauggaacgcagcauggaugaguucacugcauccacuccugcagauuugggagaagcuggucgucucagaaaaaaggcagauauugcaacuucuaagacuacuacuagauuucgaccuaguaauacuaaauccaaaaaggauguuaaacuugaauuuuuugguuuugaagaucaugagacaggaggugaugaaggagguucuggaaguucuaauuacaaaauuaaguauuuuggcuuugaugaucucagugaaagcgaagaugaugaagaugaugacugucaaguagaaagaaagacaagcaaaaaaagaacuaaaacagcuccaucacccuccuugcagccucccccagaaagcaaugauaauucccaggacagucagucugguacuaacaaugcagguaagaauuuaaaaaauauguauaauaaguacaauaguucccccuuaccugcaguuucacuuucugugguuucaauuacccaaggucaaccauauucugaaaagaggugaguacaguauaauaagauaaagaucccauucacauaacauuuauuauagcguauuguuaaaaucauuguucuauucuuagucauugcuaaucucuuacugugcuugauuuauaaauuaaacuuuaucauagguauguauacgaaaaaacauaguauauacagguuuugguguacuauuccugguuucaggcauccacuaggaacuggcauguauucccuguugauggcugggggggcuacuuuaaauguguuuuucaggcuugaaucaacagcugcauaguuucuuccuagauacucaaguuuagcuuguuauauuuauuaaaaguaccuguuagaaccguaaaucaccuuaucuaaagguacagcauuucaaguguuaaugaucaggucccaaguuguaaggaaccaauuuguagauuggagagucuucauauuugaguuuuaauuuaaccuuuagcacuugagaauuuuaaagcauauauguguauggggcagggacaccaaacaucgugauguuuccacuugacaaaugcaaaugcagugaaaacauagauuagauuuugggccuuuggaacuguacugauaacaggugguuauaaugagggaaauaccagaagauuagaauuuaaaaacucuuugugguuggcuaaaaacuaauaaacauucaaaacacucucaaacccuccuaaguugguuuaauaaaauugaaaagugccagguaaguaugcauucccucuuaacuguggaaauuuaauuugugccgagauuguagacucaguagugacuaaggguccucaaggaguucagucuccacugugagagacaaacaaaagaaauagguuagcucugccauaauuaagucauuaccugacaagggcuuugugaaguggauugacuaucuagugaggaagaauuugugaaagcuucuaggauacaugguuucuuaaccaaauauaguuuuucuggauugguuuacauauuaaauaaagcuuuuuuccugguagggccacagaagugucauuaugguaaauuagaauuacaguaguauuuugaaauacaaauucucuuguagaauauaagucauucuugagauuaccuaccauuuugcuuuauuuggccugaaaauaguuuugcuuaauuuauucuucaaaacuagacauacacaggaguaccccuaggggcucaccccugccucccccgaaaaaaaagaaaaaagaaauacauccaguguugucuuugaaucuuuucuggagacuggaaauuugcagcagccuuacuauagucacuuaagaucuggcuaggcagaacagcuaggcauuuguuuccucaguagaaugauaaauacugcuauacaauaccagcgcccuuguccugcuguaguuuacuuauaagcuuuuauucuaaccuggauagcaaguuauccccugcaauugagaaucuguggcugaaauuuacaucuuguguaauacaacuuuuaaagauguaaaaugugaaauuagacucccuuugagaaacuugaaguagaugcuaaauaacauuugaaaauuagaggccauuugguugaucuacccaaaguugaaauuugagucuucauaccauaagugaaacagcaaaaaauuuuaagcauugggauagagaagagucuuucuauguuuccuauuuuguuucgcuuagaaaaagauacauauuuuuaaccaguugggaaauaaacugacucuuugguuaguuguguuugaagaccgacaaaucauuaaacuuuguuauauuaggucauuuuaaaucucuugccaaggauaacuguccuccuuuucugguguuuuaaauguggcuuuuguaguugccagcaggcauucuuugaaggccaacaugauuuaguggauuuaaaguucugaaaaauguuacagguagauacgcaugauguuuuguguguguauaaaccuuaccauuccagugucaguauccauggauauccagcaguuaugugaccucucggaaguaagaaaauuauuuuggaaaagauuugauuuuuccauuugacauaaaauaagacuagaacacauacacagcaaccagguuuaugauuucucuugcgggagggacaagcaggaagggagaauggcagaaugaaacuucuuauucuagggaguauuuugucagcucuguggugcugugauuuccuuuauucuuuucuucccauuuucauucauucauguauauauaaucuugauagguugucugguagguaauuugaaauauuaguaagcuagauaguuuugauuaccauuucagaaaacuuggauuuuacagaggacuugccuggugugccugaaagugugaagaagcccauaaauaaacaaggagauaaaucaaaggaaaauaccagaaagauuuuuaguggccccaaacggguaaguaaagcacugucagugauuuuuauuauuuauuuguuauuggagggcucaacucuuaauuuuuuauuugaaaguuacuaauaaacaucauagcaacugucuuucaaaggauauguguaagucguuuuuucagauauaaccauuuuuuaaaaaauuguaaaauauacauauuuuuaaaaccauucucaaguguacaagucaguggcauuacuuucacgguguuauguaaccaucacaauuaucuauacccaaaaccuuuuuaucauauccaacaaaaacucuguacccauuaaccaauaacuuccucccccacugcacaccuagucaauacuauuccacucugucucuaggaaugugcuuuuucuaaguaucuuauauaaauagaaucauacaauauccaucauaaaccagauacaaaaggacgaacauuguaugaaucugguuuauuucacuaagccugauuuuucuaagguuacaucugucuuuuacgguaugucaaaauuucauuccuuuuuauggcugaauaaaauuccauuguauguaagauauauauguauauauauaaaagaauauuccauugugugugagacauacacacaccaccacaccuccaugccuuccacauuuuguuuauccauucaucuguugauggacacuuggauuguuuuuaccuuuuggcuacugugaauaaugcugcugugaagguuggcauacagauacaucuguuugagucucugcuuucaguucuuuuggauauauaccuaggaguggauuuccugggucaguaugguaggccuauaacuuucugaggaacugccaaacuguucucugugguugucugcaccauuuuacauugcuaccagcaacauaugagggcccuaguuucuucguauccuuaccagcacuucuauuuucuguuuuuugauaauagccuaaugggugugaagugguaucucauugugguuugauuugcacuucacuaaugauuagugauguugagcauuuuuuauguguuuacuggcuauuuuuguaucuuugaagaaaugucuaaguccuuugcccaguuuuuuuguuuguuuguuuuagauggaguuucgcucuuguugcccaggcuggagugcgguagcacaaucuuggcucacugcaaccuccgccuccuggguucaaggaauucuccugccucagccucccaaguagcugggauuacacgcaugugacaccaugcuuggcuaauuuuguauuuuuaguagagaugggguuucaucauguuugucaggcuggucccuaacuccugaccucaggugauacacuugccucggugucccagagugcugggauuacaggugugagccaccgugcccggcccuuugcccauuuuugaauugaguuuuuuuguuuuuauugaguuguaguaguauguuaauccuuagcaguaauaugguuuacaaauauuuucugcuauuucauuaguuguuuuucacuguauugauauuguccuuugaugcaaaaacauuuuaauuuugauguucaauuugucauucuguugucugugcuuuuggugucauauccaauaaauuguugccagauccaguguuacauacauuuuugucuauguuuuuuuccuauaauucauaguuuuaggucguuacguuuagaucguuguucuauuuuaaguuaauuuuuguauaugguguaagguuagggccaacuuuauuccuccuccucuuuuuuuuuugagauggucucacucucacccaggcuggaaugcaguggugugaucccagcucagugcagccuugacguccucgggcucaggugaucucccaccucagacuccuaaauagcugggacuacaggcgugcauuaugauaccuggcuaauuuuuguauuuuuuguagagacgugguuucaguuuguugcccaugcuggucuugaacuccuaggcucaggcuaucugccugccuuggccucccaaaauguaauaugguccagcauggguauugagaauaauuugacuucgccuuuuuuguaaaaaauuccuuaaauagcuuguuauaguguuuuguuauuuaaaguuaaaauuagagguugccaguaccuuuuauucuuguagauugaauugcuuuuaaauaacuaaagaaugaguguguucaauuuuuauggccuuauuuuuccuauuuuaccugaagagcccacuggggaucuuuucaauguaauuguccuauaguuuugcacucccaggugcuuaggugagacuuugaauuucuagaaaacuguaugacuucacagugauacguaguuguguuuuaauaagcuuuucagguaauuuuggauauucuucuacaguacuaccccaaaacucaagaaaugggaguuucuugaugauuaguugcaacuuggaaugugaaaccgugccaguaaccuuucauacauugcauuaaaaucugcugcuuuaucuugcauuuugaaugggcauuuacccauacaugcuuuguaacaucauacacuggucacuugcaaaauacugguuacgaugaauuaugcaaaucuuucaaaugaugacacauuucauuauacaguaucgaaaaaccauguuaauaccacugccaaacucagaaaaguuuguaaguacugggaaccuaucaaguucacagugguagauacaaguucucuaaaauuuguuuuugcuuaaaaguucaauuuuuuuuuauuggaagcaaauacuucaaggaaaacaacugaugguaacagauuuacucuuuguuuucgagaaaaugccugccacauucccacguuugaaucagcauaguuugucgaucuuuccaguaaagaugauguuugagaaaaaaguagcuaguuuggcuugcaacuuaaacaguggugguuuuuucuccauacaaccacuguacuuugcaugcagcagaaguguuuuaugcauacuuguuuugucacagagauuauuaguguauucagggauagagauuuaauaaaauuaacuauuuuuauuccuucauuaagggcuuuaagugaaacuggcauuuuacuuuuugacugcuacauaguauguagcaguuagaaguccuaccuuuauuugugcuaaggcaccagcaguuuuacccaccauugcuuuugcaccauccauacaaaugucaaugcauuaaaaaagccaguuaacaucuuuauaaaauauuuuuugaggcagagucuugcucuguugcccaggcuggagugcaguggcgcaaucucagcuuacuagagccucugccucccaggugcaagugauucuccugccuuagccuccuggguagcugggacuacaggcaagcgccaccaugccuggcuaauuuuuuguauuuuuaguagagggagggucucaucauguuggccaggcuggugucgaacuccuggccucaggugauccaccugcuuuggccucccaaaguccagcgauuacaggcgugagccaaugugccuggccccaucucuuaaaaaaaaaaaaaaauguaguugggcaugguggcuugguuguaguccaagcuacuugggaggcugagacaggaagaucacuugaacccaggaguucaaggcugcagugagcuaugaucacaucacuucacuggagccuggacaacagagugagacccugucucuuaauaaauaaauaaauaaaugaaaauuugaaauauacagaaaaugugaaagagcaguaagaugaguacccauaucccucugccuagauuguuuuccaguuagcauuuaaccauaauuguacauagucccuuuccuuucucccucucuauaauauauauuuacuguauaauacuuauauuaaguauauguacagucuuauuugaaaguuuauuuuauuaaauauauauauggucuuauuugaaaguaaguugccugcauuucuuaagaaaaaggucucauaccugugguuauauaacacuuaagucaauuccuaguaauucuuugauauaaucugauaaucacuguauucaguuuuccccaucuucaaaaugucuuuucauauuuuuuuucccaaaccauaaucauuuaguuaugucucucuuaguuuugaacaguaccccccuuugaaaaaaauuccccuugguccugaauuuuuuuuuuuuuuuugagacggagucucacucugucacccaggcucgagugcaguggugccaucucugcucacugcaagcuccgccuccuggauucacgccauucucccgccucagccucccaaguaggugggacuauaggcgcccaccaccacacccggcuaauuuuguuuuuguauuuuugguagagacgggguuucacaguguuagccaggauggucucuaucuccugacccucgugaucugcucgccucggcuucccaaagugcugggauuacaggugugagccaccgcgcccggauggcccugaugguuuuuuaagaggccaggauauuugucuuacagaaaguucugcauucagaauuuaucugauuguuuccuacugaugucauuuaauuuguugccucacugcauuaaaguaccagaauuuaagucuggaaguuugauuaaauucagguuagacuuuuugguggggggcgguggggaggcuauuucaccgguugcauuguguaugaugcuuuacaucagaagucucaugauaccugguuacuccacucuuagcauuguuugaccaccuaguuaagguugugaucaccagcucucaacaaaauaaaaguacauaucucauuuuauaauuuaguuaggaaacuucagagugcuaguccaguaccacgugcaugcccuguuccccauuauugucuuaccucauuuucguauccauuguugagcuuugccuacaucauuuauugcucgaguuacagaaugaugaguuuucuaaucguuauuucuuacacauuuaauagcuggaauuuuguaaagaggaaccuucaucucuccuucuuccccucuccuucuuccagcugucuccaucacuauagauucaguaauuuuugcuuauuggauaacauuuuuacuuacugacauuaugcuaagucaaauaacucagacacaaagaauauuaaaaacggcaugaucucacuuaacgugucaaauuaaaaauaguugaauauguagaaacagaauagaaugguggauaccagggaugaggagggggaggaaauagggcaguguuggucagacaguacauacuugcaguuacauaggaugaauaaauguagcuaucugauguacaguaggagaccuguaguuaauaauauaggacauuugcuaagagaguagauuguaggugcucuuaacacacacacaggguaacuggaaagugauggaugcuugcaguaaucauuguguguauuaaaacguuaucuugcauguuaaauauauguaauaaaaauaaauacuauuuacuaaauguuuuauaguugauuuugcuuuuuuuuuuuuuuaaguugaaguuguuuuauauuuggccagugugaaccauuucaagcggucucuuguauccuuuugaaauaaccugucaucuuugagcacuucccuugccuucuguacaauaagauggcucaggcucaucuuauagauucccuguuuuaagucauggagucauguguuuuucuaggaaccuugguucuuuuuguggacauuaguacuuagaaaccaagaucugagugcugaguguguucaucgcaucaagggccuuucuucagacagaguuaggagauaauguugaaaaaugaaccaugccgggcgugguggcucacgccuguaauccuagcacuuugggaggccgaggcggguggaucacgaggucaggagagcaagaccauccuggcuaacacggugaaaucccguuucuacuaaaaacacaaaaaauuagccaugugugguggcgggcgccuguggucccagcuacuugggaggcugaggcaggagaauggcgcgaacccgggaggcagaguuugcagugagcggagaucaugccacugcacuccagccugggcaacagagcgagacuccgucuuaaaaaaaaaaaaaaaaaaaaagaaccaugaguuuauguuauugauaguuucuuuuucaaauuuauuuauguauguauuuauuuauuuauuuauuuaagacagagucuugcucugucacccaggcuggagugcgguggcaugaucucggcucacugcaaccuccgccuccuggguucaagugcuucuccugccucagccuccagaguagcugggauuacaggcaugcaccaccaugcccagcuaauuuuuguauuuuuaguagagaugggguuuuuccagguuagucaggcuggucucgaacucccgaccucaggugauccaccugccucggccucccaaagugcuggaauuacaggugugagccaccgcgcccggccuucaaauuuaacaucacagaauuguauacuuauuugcuuuauccuacagcauacauauauaucaaaauuauaauuccaauaauaugagcaauaaauaugagugaauuuuaauuucuuuguaauugguuuuuuccuuagauuuuaguuuacuuaggaugaacaguuaugguacuguguuaaaauuuguugaaaugauuuuuauacugucugcuuauauguuaauucuauauucaguugaagucauuuguaccuauuuguguucuguuuuuuuaacuuaguuaugaacuuaauguuggaguaauuucuuugcuaguaacauagcuuagaaggcagcaguguacauguacuugaccugauuacaaaggaaucuaucuggccuaaaguaaaucaggucauggcaacuugagucagcagcaaaccuauuuacuguugauggaugcaaagugauagugucagaaaauuaagaaaauuauugcuaauuuauaaaacaaaaagagcuaugggacugagcuuauuugaaaaauguaauaugaguaaagcuguguguguguauguguuuuuuuuuuugagauggagucucacucugucccccaggcuggaguguggcgacgcgaucuuggcucacugcaaccucugccuccuagguacaagcaauucuccugccucggccucccagguagcugggauuacagacgugcaccaccaugcccggcuaauuuuuguauuucuaguagauaugggguuucaccuguuugccaggcugaucuugaacugcugaccucaagcgauccgcccaccuuggccucccaaaguaccaaaguuggccucccaccgugccaagccaaaacugugucuuaagcugugucuuaacguaguagccuuuuuuuuuuuuuuucaaggcaaaaccuuuauucauuuuaaugguaggccagugagaguaucuggauuuucuggcucucuaaucugauuagauuuaagaauuccaguggccccauuuccaggugguaaagagguagucugugacuuguaguggcaggaguuuuccuccuguucuaucacaguuuuucagccugagcacuauugauauuuuggacugaauaauucuugguuuggaggcuggcccuguacacugaaggauauucagcaacaucccuggccucuuuccauuaguugucaauagcaccccccucuugccuuguuguuacaacccaaaaugucuuuggacauugccaaauguuuccuggggagugaaaugcauccuccucccauugcuguauauguaugugugugugacuugauaguauuucagauaugaugcccauuacuccuaaauaccuaguuuguacuuucuaaaaacaagagcacuuugcuuuacugccacagaauacccaucaaaaccaaagaguuaacauugauguaauccauugucuaauccacagaucccauucaaauuucagcauuugucccaguaauguucuuuauagcaaaacaacuaaacuacacccccaugucuccuaaacaaagaacccaugaucuaauccagaaucacauguuaguuuaguugucacaagucucuacucuccuucagugugccaugggaucuguguuuccuggucuuuucaugguuuuuacaucuuuggcggaguuaaggccaguuauuuugucuaaugucccucaguuuguguuugauacuuucucaugauuagacucagauuagacaguuuugauggcaauacagaggagaugccauuuucuugcugcaucacaucaggugguacuuaaugucagcuuguaccauuacuacugauguuaacugaucacuugguuaagaugguauuuuucagguucgucaccuuuccucauuagacuucacccccuaguuuuggcauugauuguugccugagucaguuuuuacaacauugguugccaaaugugauuuccuaauuauagcauuuguucuacaguuauuaguauuuggccuuguaguguuagguagauauuuucuuccccuccauguagguuagaguauaugcauguauuuuuauauguauucauuuaguuauuacaguaugaacauggauuucuacuuuauucagucauuuguuacuguauuuauuuaaaucauaguucugucauuaguuugaucuucuuagauuuaguugguggauguuccuucaagcuggcuuugaugugucccacuauuuugcauuuucuuacuuacauucuauuuucuuuaauuuuaacgcucuacgaauuugugugucauccuugugcaggggucaugcuaaucuugguaucguuccaguuuuuguauaugugcugccgaagcgagcaccuuacugacauucuaagauguuccaggcucauccuauacuuucccaguccuggagucagccauuucuucaaggauuccuguuugcaguucauggagaaugguauuuagaaauaaauacuuguucacuagguaugguuauuucuucugaagugucauugcuucuaggcccucucugaguagacagcuaggaaacauguaaaaauaugcauauacuguuucauauacagacacaugucuauuucauggucauucuguguauguuuagaaccaugaguucacacuaauauuuccaauaccacguuuuauucuagacuucucauuuuccauauuuuaauucccuucgccgagagaaaucugguuuccauuauccuccacauguguucuuauuuucacaaucgucauguauguaacuaguuucuugacuaugcugaccaucuuccucaccuuaguucugcugacauagucuggccaagaggucccccuucccucuaccuaccccucuacccuguguuagaaagcauuaacucuuuuuuuguuuguuuguuuguuuugagacagagucuugcucuguugcccaggcuggagugcaguggugcgaucucagcucacugcaagcuccgccucccagguucacuccauucuccugccucagccucccaaguagcugggacuacaggcgcccaccaccaugcccggcuaauuuuuuuuugguauuuuuuaguagaggugggguuucaccguguuagccaggauggucuugcucuccugaccucgugauccacccgccucggccuccuaaaguggugggauuacaggcgugagccaccacaccuggcccagaaagcaugaacucuuaagcauacgugucugugagaauuuccuuuagugucucccaggaauauagaguuguuaauaucaggauugagggcugacucagaaagaagaugagggugaagaaaacuuguaguaagaacauaguugaaaugaugauucagaaaaguugucacuugcuggugagaaaaagaaagauaggauuugauaaauaggguugaaacauaccuggauuuaacuaccuauuguuucuagguaagguuuugaucauugagcaguucuugguacuuucguucaugaaaugucauccaguuucugauuucuggcuacagcuucccuacaugccauuauuuguagcugucauaugugugcugauauacuuagauuauuucuucugcuugcccugcuugugguuugacuucuaccuuuucauucagcugcugccugucaucccugcuuguaagcauucauugucuguauagucaggcugacuguacagguuuucagugcuugcgggguugguuguguuuuaccugggauguuggccaucuuguuuugcaguuaagacugcugcugggucauugaugaaacuaaccauaacgucaaucucaguuucaauucuccaauauuuauaccuuuacguucuuuuuuuguuguugagacaggguuucacuccaguugcucaggcuggagugcaauggugugaucaugucucacugcagccucgacuuccugggcucaagugauuccugugcuucagccucuaggguagcugggacuauaggcacacgccacugcguccagcuaauuuuuuguauuuuuuguagagaugggguuucaccauuuuucccaggcuagucucgggcuccugagucuagccaucugccggucucggccucccaaaguggugggauuacaggcauaagccaucaugcccagccuauaccuuuacuuucaucauuccccugugguuuaaagcuaggcccuucuagcacuaucuuuugucuaacucuuuaaggaacauucuggacuuaauuuuuucuucccaucuguccuucaauaugacacuggauagggggcuucugggcaauuaaaauuuaucaguauaaaucaugguuacauauuuaguuguuuuagaauguuguaauuacauaaaccugcaguuuuaaaguugaauauagcuuuauacuuugauaaacuucauuuuuuguuuuauaaaaugaguuuauacggguugucaacuuacuagcaaaaucuuacaauugaagagacuuuaaaggacaaguacucccacaucucacccaagaacaaauguuccuuccacacagugucuuccuuuagcaguuagaacccacucucaugaaauagcauauuuuucugucagaacaguuuuacccaguguuaccuuuguuauauguauggggacucacugacuaucuugagauccagucaucaugugguauugugagauccacuauauucucaaguacuagaaaccugauauauuaauugauaugaagccugaaaaaaagaaugacuguagcaauuggauuggugaugagggaaacuggcaaaaguguggaaguuaauagcugcugccauucacuuacagcuccugggugggugauccaaagaguuguugaagcugagcagguucuggcugggccuagguauggaagagagggagucgguuuuaguuggcuuuuuuucaucauuguuuuuguuugguguuuacuacaugacuuucacugugcuagggauacaaaaaugaauaagaagaguaucuuaaaaaggcagaauuguuuuuuccuacuggaauuuugagcagucuuaguauuuccucaguguguuuguuccaaaccagaagcauauugcuuccuuuuauauagguaguauuuaacuuaaauauuaaaccagguaauuaaaaucauugaucuguauaagucaaaaaggcuuaggaaaauguaaauuauuuucucucugugauccaauucuugugcuuuuuuuuccuuuaauacuuuauucuggaaggauuuuaauaaguaaugaaaguacuguuaaucuuuuuuuuuguuuuggauauggagucucgcucuguugcccaggcuggagugcaguggcgcagucucagcucacugcaaucucugucucuuggguucaagugauucaacugccuuagccucuugaguagcugggacuacaggugggugccaccauguccuagggcuaauuuuuguauuuuuaguagagacgggguuuuaccauguuggucuugaacuccugaucucaagcgauccgccucccucggccucccaaugugcugggauuacagaugugagcuaccgugcccugccuaaucguauuuucuuuaguauaggugccuuuaaaguuugaaaguucaaaguauuuuacucuuauuucccaggaaaugaggcuugaagugagaaaauguggccagggguuaucaggagcuggaaagcacugacaucuauuugauaguuauagaugggaaggagggggguagggguuggggggugaguggggggagaugggagggacgggggaggggagagagagagcacgagugagcacacgcacaugcgugugugccuguguguguguuaggguguuuauaguuuggaauuucauuuguuuuuccauuuuguacuacagucacgcauuacuuaaugacaggguuacauucugagaaaugcaucauuaggcgauuucauugugcacacagaacacaaagcuagaugggauagucugccacacaccuaggcuauaugguauagccuguugcuucugauauguugccguacugaauauuguaggcaguuguaacacagugguaaguauuuguguaucuaaaccuagaaaagguacaguaaaaauacauauaaaaaugguacaccuauauaggacacuuaaccaugaauggagcuugcaggauugcaaguuucuuugggagucagugagugaaugugaaagcuuaggacacuacuguagacuuuauaaagacuguacacguaugcugcacuaaaguuauaauaguuucuucaaugauaaauuaaccuuagcuuacuguaauggcuuguuuuuuucuuuuugcuuuuuguuuugagacaaucucccucugucaccuagguugaagugcaguggugugaacacuguucauugcagccuugaccuccugggcucaacugauccucccaccucagcgucccuaguagcugggacuacagguggacaucaccacacccuggugaucuuguauuuuuuguagaggugggguuucaccauguugucgaggcuggucuugaacuccugggcucaagcaauccucccagcuuggccucccaaaguguugggauuacagacgugaggcacuguggccaaccagcuuacuguaacuuuuuaacauuauaaacguuuuaauuuguuuaaaacuuuuuggcuauuguuaauaacacauagcuuaaaacaaacacacuguacuacuguacaaaaauauuuucauucuuuauaucuuuauuccguaagcuuuuuucuauuuuuaaaauuauuuuuaauuuuacuuuaaaaucuuuuuuguugccugggugcgguggcucacgccuguaaucccggcacuuggggaaguugaggcaggugggucaccugaggucaggaguuugaggccagucuggccaacauggugaaaccccaucucuacuaaaaauacaguuagccaggcgugguggcgggagccgagaucgcgccacuguacuccagccugggcaacagagugagacugccaaaaaaaaaaaaaaaaaaaaaagaaaaaaaaauuuuuuuuuuuuuuuguuaaaaacuuaagauacaccagccuagaccuauccagagugaagaucauaauucucacagucuuccaccuccacaucuugugccacuggaaguucuucaagggcacuaacauacguggagcugucaucuccuaugaugccagccuucuucuggaauaacuccugaaguaccugucugaagcgguuuuacaaugaacuuuuuuuuguuuuacaaguagaaggaguauauucuaaaaugguuaaaauauaguaaauacauaaaccaguaacugcuauuguuaauagucauucauugucaaguguuacuuacuguaucuaauuguaugugcuauacucuuuuuuuuuuuugagauggaguuuuugcucuuguuguccaggcuggagugcaguggugggaucucagcuuaccgcaaccuccgccucgcagguucaagcaauucuccugccucagccuccagaguaccugggauuacaggcaugcaccuccacgcccagccaauuuuguauuuuucauagaggcaggguuuuuccauguuggucaggcuggucucaaacucccgaccucgggugauccacccaccucggccucccaaaaugcuaggauuacaggcgugagccaccgcaccuggcauguauguacuguacccuuauaggacuggcagcacaguagguuuguuuacaaaagcaucacuacaaacacucgccuaaugcauugugcuaagaugucacuaaauguuaggaauuuuucagcuccauuaaaaucuuaugagaccaccguuacauaugcaguuuguaauugaccaaaaccuuguuaugugguacauaacucuguaaaguacauuauuauuaacuguaguuaccaugcuauaagucagaucuccagaagcuaaucauuuuauaaugggaaguuucuacccuuugaccaaaaucccauuuccccuaccugccagccccuggcaaccaccuuuccacucuuuguuccuaugaauuugacuucuuuagugaaucccuacuuuuucccaaaugguuuauaaucuauuacuguauuuaauuauuuggggccuaaauuuguccugauuuggcuaguagagccucauuaagcuggcuguuugauuugucugccauguccccaucauuuugugaaaacuucuuucuuccugguguaacacaguguucuagguucaucuuguaccuggucagcuguaggcucgggaucagguccauucuccgaggaguaaugauucucuuuaguggagaaugguauuagagacuaugauaaugggcccuagguguguccuuugcuucuuggcgcuuuuagcaaacgggcauaggaaacaugcacguauacauauauuacauacauacauauauauucacauacauucacauacaaauauaccuucacauauauauguggauucaugccuguguacauaagugaucuagaaaucaugaauucacacauaaucuucaguauccaugcauuuucacaggauuauuucuugccuucugucuuuuucacagugagagcccaggguucuuucuggccuuaugucuuuuucacagugaacaacagcagcagcacauuuacucaacuuauaucuaaauagguacagaauugcuuugcccauuccacuacaauaaguaaauuuacaaaaauuuucaggaauuguuuggcaauucugcccuugcccuacuccacccugcccaagauugaggguauaaagucaaauaauauguucacaaauuacuugggauuauuucugccugccugccucuugacuggucagugcauugggugguuugucuggcuucucuucacaguguuugcuguccaugugaaauaugaguagguuucuuuguucugguuugcuuuaaguguugggguuuuccguuuccauucuuacuuuuuuuuuuuuaauguguacaacauuauaaaagucaaaacuauauaaaaagguaaguuuaaugaggucacuucaucugagauguguuccagucugucacccacccuuguagggaaccaauuuuauuguuuucugcugcuucuuuucuauguuucuuuuuuauauaaaaauaaacagacuaaaauuuuucagcccggcgcggugguucacgccuguaaucccagcucuuugggaugccaaagcaggcagaucaccuaaggucaggaguucgagagcagccugaccaacauggauaaaccccgucucuacuaaaaauacaaaauuagcugggcgugguagcacaugccuguaaucccagcuacucgggaggcugaggcaggagaaucgcaugaaucugggaggcggagguugcagugagccaagaucgcgccauugcacuccagccugggcaacaagagcgaaacgcugucucaaaaaaaaauuuuuuuuuucuuacauaaaaaguagcaucuauauguccuguuuugcacugucucuccuuuaaaauuuaguaauauuucuuggaaaucacuaucaguucauguagaucuuccccaguauauauuuuuauaauucuaaagauugguuuuagauuuuuuuucuuuaguuucugucuuccuccauucucuuacauguugacuguuuauaucuuuuaaauuguuucuuuuuaacguuguaugugcauaguuuacccacauccaguauuggcaaaauuuuauacuuucagcauguccuguuauuauuuguuucuaaucucaauuuacuguuguucaaagguggcuucuuaggaucugguucagauguuguaaaagaaaucccaaauuaguuauuaauagauagcuuauuuuucucuggcuuaccagucucugguuguuuaucucuggacaauuuucaaauugcugcaguguaggggacccaaguuucccuuguguggugguauucuaccauuucuggacuauugauuaagauagaaggaacuagaagggaaggcaaugaaccaucccuagaagccaggacccagaagguguaccucacuucucuucacacuucauuggcaagagcuuagucacaugcccaugcaagcaucaagauguugagaaaucuaugugagcauuuguccagcuaaauguuuuuaaaggaaaaugaaggggagaauggauauucucuaaucacaggugguguugucucaagauauuuauagcuuccgguuuuuuuauuucuaaauuugauaaucaucuuucuaauacaacuugucaucaauauuuaaugguauuuuuaguugugagaacuguuauuuuagcugauuuuggucauggcucucauacuaguaucuuuuaguuuuaauuguugaauuauaggcuaaguuauguucucacaaaaugccaacuacugaauuuuaugguuuuuugcauggacuuuuuagaacuuaugaccaaguuaugcuauuuccuggugauauucugaagugacaguuaccuacuuuuaauaaaaccguggcuaccaauuaugcuuuugaaguucuacucacaguaguggugugcauuguucuucaugaagauaggaauugacaauuuuuucauaaaaauggcagcugucuuuaaaagucauuacuaccuguuguaugcaguugauucgggcagagaagaaagacuuugcagcuuuauuucuucucguuagauguggauuagauucucuacaguguuucauauugcauauuacaauuucuaauucuugauaguacagaugcuguugguuuuaauuuaggaguuucuguagucuuccuucaaauaauucaauacucuggauauuuaacauguguuauguuuuuuauaguuuaagaccauuugagauuguaugauuaugcuuaaaaggaaguuguaaagagcucaaagauucuuuguaagacuuuucuucuccugcuucugauuccaauugucuuuuuuaaaggauuuuuauaaauccuuuaaagaaauuuuugacaauccagauccaaauuguuuuuuucuacuucccccuuuugaauugccgcuaaaguacugugcacacauacacacauaguuaugcauugcaguacuucuucagaguucauuuaguuguacuucgugcugauugauugaauuacuggugauauccuuggguggauaaagcuggaugaauucuuaucagcuuacuauuuugucuucauauagcacauaguuuuuaaaacguauaaauaaauuugcucuucuuguucauaaaguauuuauggcuuaaaaacauuccuuuuuuuuggcugugcgcuguggcucacgccaguagucccagcacuuugggaggccaaggcagguggaucaccugaggucaggaguucaagaccagccuggccaacauggcaaaaccccaucucuacuagaaauacaaaaauuagccaggcgugcuggcgcuuguaaucccagcuacucgggaggcugaggcaggagaaucgcuugaacccgggaggcgcagguuacagugagccgaaaucacaccauugcacuccagccugggcaguaagagcgagaaacuuugucucaaaaacaaaacaaaacaagaacaaaagaaacccauuccuuuuuuuccuggcuuuuaugagccagcccagugggggauaacaugucauuuccucuuagauuuucaggaaggaaugcuuucuuuccucuguuuuuguuguuguuguuuuguuuuuuuuguuuguuuuuguuuuuuugagauggagugucacucugucacccaggcuguagugcaguggugcagucuuggcucacugcaaccuccaucucccaaggcucaagugauucuccuuccucagccucccgggguagcuggaauuacagaugugugccaccacacccggcuaauuuuuuuguauuuuuaguagagaugggguuucacuauguuggacagccuggucucaaacuccugaccucaaguggucugcccaccucggccucccaaagugcugggauuacagacgugagccaccacgcccggccuuuuccucugguuuauaguugugauucaguaauccagucuguuaacaacaaccuuugugguguuauuguaaaaaccaacuuuuauccauuguuuuuauagaaacuauauuaucucucaugaagaaaugccccaucaguuugucaguggaauauuuuuucuuuagcuuuaauggaaugucacauuugagguuuuucuugcuuaugccccuggagcacugaauacaaaagaauaauauauuuaagauuacuaguauugaaauaugcuaaaaugguucugaauauuuagaauguuagauuauuauuaugaacuuuuugcuuauuuuguucuaaguauuuuucucauuaauuuaccuagcacacagaauccauccuuuuuuuuuggagacaggaucucgcucugucacccaggcuggagugcaguggugugaucuuggcucacugcagccuccacuuccuggacucaggaggugauccucccaccucagcgucucgaguagcugggaccacaggcacgugccaccauucccagcuaauuuuuguauuuuuuguagagacugaguuucaccguguugcacaggcugucucaaacuccugggcgcaagacaucugucucccuuggccucccaacuugcugggauuaugggugagagcuaccaugcuuagccacaauuuuuuuuuuuuuuaauacagaaaaaaguuuagguaucugguuuauaugcuguaucugcuuuucuuucuuucuuuuuuuuuuuuuuccgagacagaguuucgcuuuuguugcucaggguggagugcaauggcacgaucucaguucacugcaaccuccgccucccggguucaagcaauucuccugccuuagucuccugaguagcggggauuacaggcaccuaccaccaugcgagacgggguuucaccauguuggccaggcugguuucaaacuccugaccucaagugauccgcccaccuugaccucccaaagugcuaggauuacaggcgugagccacugcacccggccuguaucugcuuuucuguugcccaggcuggagugcaauggugcaaucuuggcucacugcagccucuaccuucuggguucaagcgauucuccugccucagccucccaaguagcugggacuacagugccugccaccacaccuggcuaauuuuuuguauuuaguagagaugggauuucaccauguugguuaggcuggucuccaacuccugaccucaggugauccaccugucucggccuaccaaaaugcugggauuacaggcaugagucacgguaccuggcccuguaucugcuuuucaaacaagaauaaaauuaagaagauuaaagacaagccugguggugcaaucagaaugacucuguuaacauuuagcuagguugcuaaaugguaagggugauuuuugauuuuccauggaaaguugauugcuguaugauacuuuuacauauauuguacacacaaucacuuccacugagugaaauuagccugugacauaccacuguuuugugcuuuacauacacaguucacuuaggagcauguggaauuacuguacuguuuuggaaugauguaaagagcucagucaguguucccuuuucucucuuucccuguuucuuccucucccugccauauguguauguuagccauauacagauauuacuuauuuuaauuuuuaauuagaugugucuucaauaucucuccucccauaauaaacccuauauuaaucuuguaagacacugaaauaaaagucaagaaaaaguucuaauuggacuacuucccuuuagauugcuuauuaguauuaaaaugguaaaacaucaucaaaagcuuuaaaacuaauaguauuacuaaauugccuuguucaacagcauaaccaaaaguuccuuuaauaugaccuuuuaauauaaauuguucaauuauucuguaugcuguuaugcuucaaggacuuuugagaugaauagacacaucaguuauuccauuuguuuaucauauucuuuauuagguagguaggcuauauauuucuguuuucuuacgaauguguuagacuuaaaccuagcagcacaucaucacauaacaauuaauaauaacauuuaauacuuacaaagcacuuuuuuuuuuuuuuuuuuaaagacagucucgcuuugucgcccaggcuggagugcaguggcgcaaucucggcucacugcaaccuccaccucccggguucaacugauucucccgccucagccuccugaguagcugguacugcaguuacucaccaccaugccuggcuaauuuuuguauuuuuaguagagacgggguuucauccuguuggccaggcuggucucaaacuccugaccucagucgauccgccugccuuggccucccaaagugcugggauuacaggcgugagccaccacacccgacagcacauauucuuucaggcacucuuacaguguuuuaauuuuuugagacagagucucgcucugucgcccaggcugaagugcaauggcaccaucucagaucacugcaaccuccgacucccggguucuagcaauucuccucccucagccucccaaguagcugggacugcaggugcccaccaccgugccccgcuaauuuuuuguauuuuuaguagagacgggguuucaccguguuaaccaggauggucucaaucuccugaccucgugauccgcccgccucagccucccaaagugcugggauuacaggcguaagccaccgugcccggccuagucagugcuuuuuaaaaauaauuucucuuuuugcuucuuuaauuucuuuaauuuuauuuuuuguagagacaggaucuugcuuucuugcccaggcuguugugaacuccuggcuucaagugaucugcuuccugccucggccuagaggcgugcugcaauuacuggcaugagccacugugccuagcccaaucaaugcuuuuuaaaaagaaguaaaaugcuugagcuuugaggcacucauucuugccaaaaggcuguuguuaccagagccugggcucugaguaugcuugagguacuaaagguaguucaaauuagggauccauaacuagcagacacacaaguuacauagcuggucuuugaaaagaauggaaggaauagagagguugguuuuaaaauuuauguucaguccacuuuauguguugugucucaggaagccagaucaagucauugcaugagugcauaaauuguuucagauugcuaaugcaucaucauguuaugcaaaccuggcauuuaugaaugauggguuuguguacacaauccaaaugagaauuuuuccacuuuauuagagauaauauauuaaaagcuaacgauuaguucacacuaaugcuuaaugcuaauuauguugcuucagugcagcuaguaaggggauauaguuaaguuuuuuaauguagauuuuuugacggucuugaaguaugauuuuccacuugucuucuuauuuuuguuguacugaaaauaagauguguuucauaagagaaaaucucuaauuuguccaaaccauguauuugaaguucaaaacauaauuuaacgucacuuuuguagaggauagagaggaugagguguuaccuuucuauuuugucuuuguaauuaugcaguuuucucuugaaagugaggguuuuguucuuuuacuugauuugauuuuguagguuuacugucauuuauucucaauucggaaauucaguguuaaaacugaaaauccccuggaaguuuaaguaaauugauagggcagcacaauaaccucaauugaugugugagggacuuuacaucuuuguccugcuuaguguaacauuuugcugcagaaaucauguauguuauuacaugguacuuuuuuggaucccacugugucuuggaauaugugguauauguauuauauuuaccuugauaaaauuugagaacucuugagugguggcacacagcuggcugcagugguuugcuuuaaaugagcgcauugucugucauaaacugcuggauucccauuguuggaagauugugaggcaugaauugguaguaggaagaauaaaguuuugccaaagaacccauugaacuauuauuauuaucaucauuacuauuuuuuaaauuuuuuugagacggagucuugcuuugucacccagguuggucuugaacucuggggcucacccagguuggucuugaacuccuggacucaagugauccuccuuccucacucucccaaagugcugggauuacaggcaugagccaucaugcccagcccauguugaguuaaauguguugauuacuuaguaagccuagcaagagguuuaccuuuuuuuuuuuuuuuugagacggagucucacucugucacccaggcuggagugcaguggcacagucuuagcucacugcaaccucugccuccggauucaggugauucuccugccucagccucccaaauagcugggauuacagaugccugccaccaugcccagcuaauuuuuuuuauuuuuaguagagaugggguuucacuauguugaccaggcucgucucaaacuccugaccucaagugauccacccgccuuggccucccaaagugcugggauugcaggugugagccaccaugucuggccuagguuuacuuucaagugccaucuuuucuugguuagucauaguugcacagagcacuaauuacugauuuugugaccuaguacuacagugauuauauuugccauagacaugagaaugggaauuauggugggacuguucccagauaguauccauccugcuguuucuaggacauguuuaugcauauaaauuauucuuuaugauuuuuaguugagagucuuuuauaaggauggaagcaguugaucuuucucucauuucucuagucacccacaaaagcuguauauaaugccagacauuggaaucauccagauucagaagaacugccugggccaccaguaguaaaaccucagagugucacaguaagugaacuguacuuauuuauuuuguguuuuuuaauaagcuauaaauuaagcaguuacucuuuuaauucauaauuuguaaaucuuugacuuuucuauuuaacaguuuauuuuggcuuucuuuacugaaacuuauuaguuucaguuuaauucauuggaaaacugaggauugucaguaagauagcagaaauucuagugcugcuagguuaaacaaugaaagccauaaaaaauaaggcucuuguuacucaugacccacauuucauggaauuuauaguauuuaguguuuaagagcaagauuguccauauuugauguuuguauaagagcuauguuguguauuacauccuauauauauuucuaaguggcuuucagugcuuaauuugcuuuucagagacaaaucucuuccuguauucuaguaauacuuuucaauccaaaacauuaggaaaaagauucuuagcaacuuauuuucuccagaaugacugguaauaucauacaugauuucuagguuaacaguaaagcuucagucaucuggaguuaucaaguaacuuaguucuuuauaacaauaagaaauuuggggauagaagucuuucuaaaguauaauguacaguucccugucuucuuaaacugauuagacuccuuuugauaguauaaagaaaucauuuuguauauuaguaguaauauagcaugcuccuguuauagcuauuuauuuuuacccuaaacuacuucacacucuugugcuacuaaaauucuuuugacucugucugguuuuucuguccugucccuuucugcuuaugaaagcuauuuuugcaugcaguugugguucuuuagucuuucuaaugguacuagagacaaacgacaaauugugugaaauaaaaaguuuaaaaaagaccagaagaaauccuugagugguucuucugugugcagauauacauaugucuuaccuguuagugcauggaauucaaaguauuucuaaagaccuuugagaggccucccugcucccugcuuuuuaaaaagcuuuauuuacuuuuuuuugaagcugaauuugccagauagaugagacguuccuauuuuuauauauuuauuuagaacaacuaauuuaauaccuuuauuaauaggugaggcugucuucaaaggaaccaaaucaaaaagaugauggaguuuuuaaggcuccugcaccaccauccaaagugauaaaaacugugacaauaccuacucagcccuaccaagauauaguuacugcacugaaaugcagacgagaagacaaagaaguaagcagccauauacaguguuuacugcauguugauagauuuuuguauguaacauuuagccauuuaauaucuucaacaaauaucaguauacugauacucaguuuugaaccacaaacuucuuuuguccuaccaucauccuuguucuaaaaauauuuuuguugccaucuaaugaacuauuuuaugcacuuauguaaaguacagugagcccauagauuuaaauaugcuaguuccuaguuaaaaaggggugaacuuuuuuuuucuuggcaguuauauacuguuguucagcacgugaagcacuucaacgauguuguagaauuuggugaaaaucaagaguucacugaugacauugaguacuuguuaaguggcuuaaagagcacucagccucuaaacacacguugccuuagguaagaucuuauuuuuauauuuuacaauuaugugcaugcuguauuaaauuuuuucaacuagguguuguccaaaaagccaaacauuuuuuauuuuguuaugaugggguaguauguauagccagugauauguuaaaaugcuauccauuucuuuauaaagaauuugauucugcaugauaagagggaaagcugggugaugagagccuuuuuaauauagcauaggcuucaguuuucaagagcuuaaaaaaaaaaaaaaauuacgcuaaagcaucuuuuugccuugugugguggcucauaccuauaaucccagcauuuugggaagccaaguugggaggaucauguguguccaagaguucgagaccaccuugggcaacauagugagaccccaugucuacaaaaaauaaaaaauuaaugagucaugguggcauaugccuguaguuccagcuacuugggaggcugagguggcaggauggcuugagcccgugaucaugcugcugcacuccagccuggaugauagagugaggugaggcccugucuccaaaaacaagaaagaaaaaauuaccagaaagaaauaaaguaaauaauuaaaaaaaaaucuuuuaaguucuuuuuaccucugauguucaaguaauaaguuagauuuauuuaagcauauugugaucuggacgcuuacauuuguacccaaaugcucaaaaagaugaucuuuuguauuuccuaauggauugauugaauacuauaauuuugauuaaauuuuucagucauuuggaguauauccaaucaaauauaauuaauuaauugugauuuuuaucagaaguauuaaugaaaggcagcucagauuuuaagcuuuuaauggugguaguaguaacguaaggaaugcacuaaagacaauuacguuauuuuuuuaaaauacaguguaccuaaucaugcacuaggcaucaguauauuuuuaauaauguguuuugccuaugguuuuuauauugugaucauguaugggcaaugcuuugacccuuuuacccccuuccuauuugcugguuuugguauuacacaaacucaaaacuaauguacuagcuguuuccagccccccuaaccugcucuauuuucuuguaguguuauuagcuuggcuacuaaaugugccaugcccaguuuucgaaugcaccugagagcacaugggaugguagcaauggucuuuaaaaccuuggaugauucccagcaccaucagguauuuuuuaaguuucugagauugagaagccuuauguugaaaacuacuagucuauuuggcuaucaaaaauaucuucacugaauauucuauaaauauauccuaauuauagauugaguucauuuuauuugcuaaauuuguagugcuuauggccagaagcuuuugcuuaauacuuauuuuaucaugaaaacgugaaaacauuuuuucuuaaugugucauuuuauacuuuuaaaauuguauuuuguuaucuuagcuaauguaguauauugauacagaauuuuguaagcauaauuuucucuauaaucagaaagcacugagaagaaucuuuuaauauuauuugauacuaaugaauggaaaaaaacugguuuggaaaugcagcccuaauuuuuuagaaacguuuuuguccaguguugaaucuggaacauggccucauugugauaaggaauaauuucuucauuuuccuugccuuugaugcuuuugcauaaugauaaacauaacaaaaguuauuagguuuaacauuuuccaaaauuagaagaaaguaaccaucauugcuaauuauuagcauuaguaguauuuugagauggccuuacuauauuuuuguuaaagaaauuauguucuaaauacagauuaggugauaauuaauuuaauacugcaucuucugggcugggcgcgguggcucaugccuguaaucccagcacuuugggaggccaaagugggcagaucaucucaggucaggaguuugagaucagccuggccaacaugguaaaauccugacucuacuaaaaauacaaaaaauuagcugggugugguggcaggcaccuguaaucccagcuacuugggaggcugaggcaggagaauugcuugaacccgggagguggagguuguagugaucugagguugugccacugcacuccagccugggagacagagcgagacucugucucaaaaaaaaaaaaagaaguuaguuuguugcugggcaagguggugugcauucguaaguccuagcuacucuggagacuaagggaggaucucuugagcucaggaguucagauccauuuugggaaaccuagugagaccucaucucuuaaaaacaaacaaaaaagagaauucguuugcuuuguuaugcaguuaacagugaacuuagacauuacagugugauuuuuaagggcaguggaucccccauggccuuuacaaugcauccuaauuuccaaaaauaauuugcuguauaaacauuuaaucagacaccuggucugaugcuucucuacuucugggggcucaaaguuuaaaucuuuagaugguuguguuuucuguauauugaaauagguuuaaguacagaauaucucaaguguuggaauaucccaaauguaagaccuuuuuuuauauucacauuuaucuaaaauauuucaccuucaguauuuagauuguguaaguagaguguccuggccaggugcgguggcucaugccuauaauccuagcacuuugggaggcugaggugggcagauugccugaguuuaggaguucgagaccagccugggcaacauggugaaaccccaucucuacuaaaaaugcaaaaaauuacucgggcgugguggugcuugccuguaaucccagccacucaggaggcugaggcacaagaauugcuggaaccugggaggcggagguugcagugaucugagauggugccauuguacuccagccugggcgacagagcgagacuccgucucaaaaaaaaaaaaaaaaaaaaaaaaaaauuauuugguucaaccagacuugauuguuuuauuuuauuaagcgauccucacaacucacccucccaaguaacugggacuacaggcuccugccacuacgccaggcuaauuuuuguauuuuauuuuauuuuauuuuauuuauuuugagagagucuugcucugucgcccaggcuggagugcagugacacaaucuuggcucacugcagccucugccucccggguucaagcgauuguccugccucagccuccugaguagcugggauuacagaggugcgucaccaugcccagcuaauuuuuuuuguauuuuuaguagagacaggguuucaucauguuggccaggcuggucucaaacucccgaccuuaggugauccaccugccucagccucccaaagugcugggauuacagacgugagccacugcgcccggccuaauuuuuuuguauuuuuaauagagaugggguuucaccauguugucagguuggucuugaucaccuuaccucaggugaucugcccaccuuggccucccaaagugcugggauuacaggugugagccaccacgccuggcgauugguuuauuuuaaagaaauccaaauauguauauuucagcauccuggguuuauauacagauguaaacacagcuguguuuuccaggggaaaaaauguguuaaggguaugauauagauuuaaaauuauuauuuaaauuauugauuuuaaacugaaauaugacuaucugcuguaucauaaagaauaggcugggcgugguggcucacgccuguaaucuuagcauuuugagaggccaagguggguggaucauuuggccucagguguucaggaccagccucggcaacauggugaaaccccauccacaaaaaauacaaaaauaucagcugggcaugguggcgccugccgguugucccagcuacuugggaggcugagguggggaggauugcuugaguccagacggucaaggcuacagugagcugauaugugccacugcaguccagccuggaugacaaagugaaacccugucucaaaaggaaaaaaaaugagguauaucauaauaagguuuuuauauauauauacucacacacacauaucugcaaaaauguuuuauaaacucuuagcauaguauagccuaagaaauauguaacucagcauauauucuuagagcuaucaggcauucauauauggaggauccauugaaagguaaauuuuaagcaacagcauuuuauuuuuuuaaacauguuucuucagaauauuuuuagagaggggccgggcgugguggcucacaccuguuaucccagcauuuugggaggccgaggugggcggaucacgaagucaggagaucgagaccauccuggcuaacaccgugaaaccccgucucuacuaaaaaaauacaaaaaauaagcugggcgugguggcacacaccaguaguccgagcuacucaggaggcugaggcaggagaaucgcuugaaccugggagguggaagcugcagugagccgagauugcgccacugcacuccagccugggcgacagaguaagacuccaucucaaaaaaaaaaaaaaaaaauuuuuuagagggaccgcugaauaaaacguuuuugaaguuuccaacaugguuaguaauauaaguuuuaagcauuaacuuguaaacaaaagucauuaauagucuuauuuccugagaugucaggaguugcuuacaugaaguuuuuuuucuuuucuuuuuuuggccuguugaagaaucugucccucuguacagcugcccucauguauauacugaguagagaucguuugaacauggaucuugauagagcuagcuuagaucuaaugauucgacuuuuggaacuggaacaagaugcuucaucagccaagcuacugaaugaaaaagacaugaacaaaauuaaagaaaaaauccgaaggcucugugaaacuguacacaacaagcaucuugaucuagaaaauauaacgguggguuccuucuuccuuccuucuaagaugagaauuacuuucagaaagucuuugguuaguugcaguagcugugugacugugggcaaauuauuuuaauucuaaccuugguuuacaguuuggcaaauuucuuauguuuagaucugagcauaauuucauuccuugccugaacuuccuaaacuaguuuaucuguauuuaggcuuuuugcccaauaaauaguugcacauuuucuguugcauuuugucuaauccuuuucucuuuauuuuuuaagaaaaaaaaggggccgggcacagugguucaugccuauaauaccagcauuuugagaggccaaggcagguggauugcuugaaccugggaguuuggguccgucuugggugacauggugaaaccccagcucugcagaaaauacaaaaaaaucagccagauaugguggugugcaccuguagucccagcuagucaggaggcuuaggucagagaaauauccugagcccggggaguuugaggguacagugagccgaggucgugccccugcacuccagccugggugacagagugagauugucucaaaaaaaagguagaaacuacauguauauuaggaauuuugaauucuuauucuccauggauuucagggauaaacauuucagaggauuuacauccaccauuuucuuuuuuaauuuuuauuuuauaauaauaguaauaauuacuguuuuuugagauagcgucuugcucuguugcccaggcuggaaugcgguggugcagucauagcucacugcagccucaaaccccugggcucaagugauccucccaccucagccccccaaguagcuggaacuacagguguaugccaccauaucuggcuaacuuuuguauuuuuaguagagaugggguuuucgccauguugcccaggcugguuuugaacuccugggcucaagcgaucuuccuucagccucucaaaguguugggauuacaggcgugagccaccacccccgccauaacugccuuuucaaugagcaagcaucuauuuaucccagaguaccucagggugucuaacugcuucaugggacuugaagaacccugaagacaccacaaggaagauuccuaggcaccucaccuccccugaggugguguuccuuauaauacagucauggccaguggcugcucuuaaugcucaucacaaugccccaugugugagauggcuauuccauuuuugcuuuaguucaguuuugccuucuucuggcuuuuuacuuguagaaucaauauguuccauucacauauuggugauuccauccacuucuaggccaguagaagauaauuggccugugguuuugaaaaaaaagaaaaaaagaaaaaauaaguguuuauuguauaauaaccugguuuucagacauuuccaacaucaaaacucuauaaacauuuauuauugucuacuguucacaauggacaaguccaugcaaauguaccuccagaguccaaggaagcugagaggccaaagagucugauaaauccaguuuuuuagaaagaaacauuuaauagggacuuaggaacaaaagccguaucugugucucgggauccccaugccauuacaccccacauccgggauuuauaugcuauauggaaagcauaauucagaauggauguguagggcuauugcaguguacaucaagguuguuugacauaagggcaggauauacaguaaguaccugauuuuacacuaggaucaauggguaaacuggaaauuuuagaggcuuucccagaacagauguuaaucagaagccaggcugggcgguguggcucacgcccauaaucccagcacuuugggaauccgagguggguggaucaccugagaccaggaguucgagaccagucuggccaauauggugaaaccccaucuccacuaaaaauacaaaaauuagcugugcgugguggugggugccuguauucccagcuacuugggagucugagacaugagaaucgccugaaccuggaaccuaggaggcgaggcggagguuucagugagccgagauuggcgccacugcacuccauccugggcaacagagcaagacuacgucuccaaaaaaaaccaaacaaacaaaagacaaaaaaacaaaagccagugucuccacaucuacuuaacugaagacugcagcaugugccacaaaaauuuauaggaugcuuugugcuagccagaugugacuuaggcucuugcucuauucucuauuuuaauuaagguagaggugguaauagauucugguuaugguggaggaugggagagcaauuuaacuuuaaacagcaagauacaaaacugacauguauucaguacuuuucacuuuauaagauuguggagagagguguugugcccagauggcaaaucaaugauccuccaugucaucacaucgucuguaugcuacauguaaaacuuuuuuuuguuuguuuguuuguuuuuuugagacgaagucuugccccugucacccaggccggagugcaguggugugaucucggcucacugcagccucuaccucccagguucaaaugauucucaugcaucagccucuugaauagcugggauuacaggcgugugccaucacgcccagcuaauuuucuuguauuuuuaguagagacagaguuuugcuauguuggcuaaacuggucucgaacugaacucaggugaucuguccuccucggccuuccugggauuacagacaugagccacuacgccuguccaaaacauguauaauuuuuauuuacuucuguauuuuugcagugucuacugauuuuuuucaugcuauaaaagaauaaauuugagccuauaguuuuuauuugccugcauaguuggaugaauaugacuuuauuuuuuugucuucuauauucaacauuuagauucauuucagguaugcuguuaaauaacaugauaaacuugauaauugaauuugucuuauguuuuguugaauuuauuaggaugauaaauaccagaauaaaaacuuuccuacacucuauuaaauaguuuacucauaugauuaagccagagcacacuugucaauuuuaggauuccucuuuuccccacuaauguuagcuguccuugaauauuuuuguuuuaaauuguacaguagauuuacuguguuguuuuguacaaugaauauccuuuacacguuuuuguuacuaguugcuuaauuucuugaauauauugguauggcugaugugccaugaaaagauaauuuaaaauaguaauauagucaugcuuugcuucaugacagauaugcucuaaaaaugcaucguuaggugauuuuguugcugugugaacaucagaguguacuuacacagaccuagaaguuauaaccugccacacaucuagacuaugugguacagccuguugcuuuuaggaugcaaaccuguauagcauguuacuguauugagcacugaaggcaguuggaacacaauggugguaaaauuugugcaucuaaacauaaaaaagguacaguaaaaauaugguauaaaagauuuaaaaagauacacccauauggacacuuaccaugaguagagcuugcaggacuggaaguugcucuguguaagucagugagugagugaugaguguaugugaaggcuuaggacaugacggcacacuacuguagacuugauaaacaccauacacuggcucccaaaguuuaacuguugacucuuuuuuaauaacacuuagcuuaaaacacaaauuguauagcucuacaaaaauauucugugagcuuuuuucugcuuuuaaaauuauuauuuuuuaacuuuuaaaacuuuuucuguuaaaaaugaaggcgacacacacacguuaaccaagguccacacagggucaagauuaucaauaugacugucuuccaccuccacaucuugucccauuggaagguuuuaggggcaguaaaacaggcauggaggugucaucucccuugauaacaaugucuugucuuggaauaccuccugaaggaccugccucgggggucccccccacugccuugaaacucucuggcucugucaaccuggcuggagugcaguagcacgaucucagcucacugcaaccuccacuuucuggguucaagugauccuugucucucagccucccaaagugcuaggauuacaggugugagccaucuugcggccuguuccucuuauuuucugauuagugauuuggcugugcuuuaauucugaguacuauuccaguuuucaaauaaaaugcuugauuaguaggcuguuuuuaaaugcuagcuuauaguauacugacuauagccuaaaauaucaaagaauccuuuuuaugccaauagaaacaaaaacaaaacuuccuaaaaaggcucgaguuuuaauuauuaauaucaaauuaccaucaccuuucuucuaaacaaagaaugccucauuaggcuucagcuuugccuguaugacucaugaauuaacacacacgaaccagucuaaauuacucuuugagggacagaaugaaaaaugggcacaauuguaucuguuuuugugguauuggauucuaguucuauauuugucaccuuggagaacaacucuuuuuuuuuuuuuuuuuuuugagacgggaucucacucugucgcccagguuggagugcaguggcacaaaucuuggcucacugcaaccuccaccucccggguucaagcaauuccuccugccucagccucccgaguagcuggaauuacaggcacccaccaccacgcccagcuaauuuguguauuuuuaguagagaugggguuuuaccauguuggccagacuggucuuaaucuccugaccugaggugaucagcccgccucggccucccaaagugcugggauuacauacaggugugagccaccgcaccuggccgagaacaacuuuuuuaaaagaaguagauuaaaaucuucuagaucuuuucuaaaugugcagucuuaagguuuucacugguaauaucuguuauuuguauuucuaaauaucuaauuuaugugcauuuuucaaauagaccugaaggacuuaauguaaacucucaucuuuugaaggggagaaacuuagggagaaaaaccagaucuugucagucuuugcuaguuaaagcauuucuuuuguuaugcugaaguucuuuauugcagcaggaaccaaauugcucuuuguugggaaguggcugucugcuuuaaaaagaaaaacaacagccaaagugaaauaaagggcaauaaaaacuuuacucagguugugaguguggcucuuagcuuuuguacucuucugguggugguccuaaagcauuauuuguauacaguuuugucaucauggccacaugaugaauaucugagcugcuaagcccgcaguaugcccuuuaaaaacuagucagucugcaacacuaaagugaacaaaggauuuguaugcagaauagacaaaauacaccaaauaauaagaaaagacaaucagucuugcaggaaaauauggaaagaauaaugaacaggagucucauaguagaaacauaguuaauaugugaaaaacuguucaagguuacugucguuguaaaaauacaaacaaaagcaguauguuaccauuuuguacccucagacaaaaauguuaagugauaacuuguacuuuugaagauucagggcaacuggcacucccacacuuugcuccugagaguguuacuuguuaaauccauugugguaaauuaauccaauauugauuuacaguuaaaaaauacauguacccuuugacuuagcaguuccacacuugaccuguauacuguagaaauaagaguaccuauauauauguauaauauuaaacugacaaaugauagacuaauagcacauuuucucuaugaaaagcugguuaaaaaacuuuguucaauguggacuauucugauaaaauugaaaauuaguucaauuuuauguauaaaagugguguuaaacuacauguagcaugcaguaaauuuuuguaaagagaaacaauuucuagaguuauugcuaaaaguugauauucauuaaugaugcuucugguuuuuagacugggcauuuagcuauggagacauuauuaucccuuacuucuaaacgagcaggagacugguuuaaagaagaacuccggcuuuuggguggucuggaucauauuguagauaaagguaugauauuuacauuuagaauguuuuuauauauuauuuaaagccugaagaaaauacuccauugacguacuucaaaaaauaauuguaucaguuuggaaaugucuauuaucauuauuauuuuuuaguugcauccugcaaauuucuaacauuuaaagaagaggccggccgggcacgguggcucaugccuguaaucccagcacuuugggaggccaaggcgggcggaucaccugaggucgggaguuugagaccagccugaccaacauggagaaaccccgucucuacuaaaaauacaaaacuagccaggcgugguggugcaugcuuguaaucccagcuacuugggaggcugaggcaggagaauugcuugaaugugggagguggagguugcagugagccgagauugugccauugcacuccagccugggcaacaagagcgaaacuccaucucaaaaaaaaaaagaagaggccauuaacauuuugauauugggggauuauggaaacaaaauaauuacagaguaugcauuucaaaaucucacaguaugaaaccuagaauaaaaaauguucagagagguuccagcauguucauagcguguguacagauggcuucuaauguuagcuaaaaguauucuauugguaaguaucgaugauaaauacuaacuuacguuuguuucuuuucaccuaguaaaagaauguguggaucauuuaaguagagaugaggaugaagagaaacugguagccucacuauggggagcagagagauguuuacgaguuuuagaaaguguaaguauggaugacuauuuggcaaaaauuauucagucuuaauugugauuguguguguaagagagagacugccaaauauuuuauauaccccuggagguucacuucuguuaauccagauagaaauagcaguacauuuuuugagcaaccaguuguuaauaaacaagcuaaaugaguaguuuuauauuuuaagaguacauguauuauugcugcaaaugaaauguuaggcuuguuuguuuacauaugccaaucuuuuuuaaagauuuuauuauuuuuauuauuauuuuuugagccagagucucacucugucacccaggcuacagugcagugacaugaucuuagcucacugcaaccucugcuucccggguucaagcaauuucaugccucagccucuugaguagcugggauuauaggcaugugccaucaugcccuucugauuuuuguauuuuuaguagagucgggguuuugccauguuggccaggcuggucucaaacuccuaguuucaaguggccugccggcuucagccucccaaaguauugggauuacaggcguuacacuuugcugggccccuccaaucuuuauuguuuuuuccuuaaugugaauuucuacuugacuacauuguuuguagauaacaauagugaaaugcaaucagguuuuauuuuuaaauuguuauuagcauuuuguuuauuugacuuuuauuugagucagauuguuuauaggcauggccugucauaauauuuggcuuuggagaaugauacuguugaacugcagcgaguauauuuuguucuuugacucuuacgaaagacuuaacccaguuccguauagauuagaauuuauacugccagcuaauuucaggaugcauagguuuguucaccagguuauuuuaaaaguaguauaguauaaauuaaaagcuccuggcauagauuaaauuguagcguuccaugugucuucuagagugcuuugggcacaguagauaacagauacuucuuuguaaaaauguguucuaaaugaaucuacuuaugaacuuuacguuauuuguaaguugaggacugcucuauucugacauucaguguguuuggcaauucguuacagugaauauguaguguagaauauguuaauuaugaaugaauauaacagugaugucuuaauuuuuucauaaagcauuagcuuucuuauuuuacaccuggaaccuguagguugugaaauuauucccuuugguaacaagggcuguuucuuccucaucuuuguaucuuuuacgcaccaggcagaaugugguguuacaugaaugaaugaaaguuuuggauugccacaauuauuucauauucuuccuuuuuagguaacugugcauaaucccgaaaaucaaagcuacuugauagcauauaaagauucccaacuuauuguuucaucagcuaaguaaguuuuuuguuuauuaguuaacaacuaacauuguuacuuauuuuaaacauuuggauugaccauaaaugaaagaaauuuggauuagcuuccuccaugaaaugcucuguugaguucugugaauugguucacauuguguaacaaaaguuuuaagaguacagauuuuggacacaaaaugacaguguggauuccagcuugauaauuucagcuguauaacuuuuguaauguacaaaucaagcucuuuacaagggggauaauaauaguggcuaacccaccuaggauuuuuauuacaguaaaaugaguuaauuuguauguuuguaagaaauauauacauaguagauauuuaaaaauauguguauauuaaaaauacauauaaaaaauuuaaauuuaaaugauuuuuaaaguaucuuuuguaucauuugugauacauauuaaugaguuaaauuaguuaaugugcaaagccuagaacaguacuuggcguauaguaaauacuaagcauuuuuccucauucuuguuuuaaauggacuuuucucuguucuucugcacuuuauuuagaccuguuuuucuauaucuguauguagcuucuuccauuccacauuuauuucuucccacauuucaucacaauuaggcuaaugcugucaccuccuugcagguaaaauucccaaguaugucuccaguccugguucugucuuauuacagcaaccucuuccugauaucucuguccuaguucuugauaucugcccuaguucucuggccuuuagccuauccagaacaauaccacauggaguuaacuuucuccaaaucgcugcuuugaaaaaauaauuuuaauuucucaaaucucugauuccuuauugucuuuggauauauguacaacuuucuuauugaagucagccuuaucaaaggcccauugcagucuuacucuaguuuaucuguuuuuuaaccucuuauuuuggaggaauucaaauauaaauaguguaauaaacuguaauguacacauuaucaaucauggccagucugguuuccaucuguaaccucauccauucccucuccuguauuauuugaaacagauccagauauuauuucguccauaaauacuuaaguacauaaugccuagaagaaaaggacucuuuuaaaaaauauaaccccagugccauuuucaugccacacauuauuaguugcuuaauauuuuauguuuagucaauauucuaauuuucaguagucucaaauuucuagucucaguagauuuucuuaaucuguagguuuuuaaaaucuccuuuuuuugucuuggauuuguacguuuuguaucuugcauuuguauauuuuauuuuucuuuauuuuauuuuauuuuuuuuucugagcccaggcuggaguacaguggcaugaucucggcucacugcaaccucugccuucuggauucacaugauucuccugccucagccuuccgaauagcugggacaacaggugugcgccaccacacuuggcuaauuuuuguauuuuuagcagagacgggguuucaccauguugaccaggcuggucucgaacuccugaccucaggugauccacccgccuuggccucccaaaguguugggauuacagaugugagccaccgugccuggccuauuuuauauauauuuagcacucucuuuuuuuuuuuuuuuuuuaauagauacagggucuugcuauguugucccagcuggucucaaacucgugggcuuaagugauucuccugccuugaccucccaaaauguugggauuacaggcauuagccacugugcauugccuguauuuagugcucuuaccgcaugcauucugguuguuugcuaccauguuuuuacccuuccuuaccaaagauuauugaaguuaaauguuucugauuucauuuucuuuuuuaaauuaagaaaaauuguguauguuguuucugauuuaaaaauaucucuuuuguauacuucauaaccucugacaacuaccuuguaagaggaaguauuugauaugacaggugcucuuuuguugugauuaggaaauucaggccaaaugucuuggaaguggcaguagaggucagaauugaguguuuguaaaagagcacuuaucucuagguuuuuaagcuuuucagcagaaaccaugaucaauucggagauagcauacagaaagauuaaauaacauaugcugaaccuccuuuugucuucaaagccccaguuuagcccagccugaaaacaguugaguuaccagugacaguaugguaauccugaccagcauucaauaccagaagaacaaauuauuuuagguuagacaugaggaacaccuuccugaccaaaggguuguaaaauauuaagaacuuuuacagaacuuccucaguauguuuuaaagggcaacuaggcguagauuagauacgguuucuuuaagaauuuugugugauauauaaugcaugaagaaucaacugacagagugagcuuacuugauuuguauuaaacuuaaaaaucguggacuuggugauuuaaauagugucuuuagaaauacuagacccauuagggauuauauuuccuuguuauuuuggguaguaucuugagaauccuuuuuuuuuuuuuuugguaucauaaaguuuuuaaugacacacacauuuuguccuuuaccuuacaaauauuucuuuggguuuuauucugaucaucaugcaauauacagaauaguuucuugccauuaccuuauuaggguagaaccaccuuugcaacuuuggacaccauuuaguagacgugaaauggaauauagaaagauagaaugcuugaacaaaaccucucagugcuagcugccuuaacuaagguccuucucucagcuuaguaccccugugacagcuugcaagacacucugacuuuguuuuauugugcuuauguagucagauuaugaggcugaucauugaguguccaucagacucuacauuauugauuccucucucaaguugccccaauauccuuuguggccagaggaagagaaaaacauucaacuaguaaauccaauuucucuugcgaaaaagacucauaguucugauaaagagucauuucaauaccuguuucaccauuuagaaaacauguuucuguuuguauagcaccucugggaaccuaaugcaguaauaucgccuucuuuuccauuugucccugaucuagaugcuauauuuuuuaugcaacccaccugcuguuaaguauuuuacaauuauagauuuacgcucuaucuuuuauucugucccaucucacccugcuagcaaauuuuuauuuguuuucuuuuuuucuuuuuuuuucuuucuuucuuuuuuuuuuuuuaguauuuauugaucauucuuggguguuucucggagagggggauuuggcagggucauaggacgauaguggagggaaggucagcagauaaacaugugaacaagggucucugguuuuccuaggcagaggacccugcggccuuccuuguguuugugucccuggguacuugagauuaaggaguggugaugacucuuaacgagcaugcugccuucaagcaucuguuuaacaaagcacaucuugcacugcccuuaauccauuuaacccugaguggacacagcacauguuucagagagcacgggguuggggguaaguuugcagauuaacagcaucccaaggcagaagaauuuuucuuaguacagaacaaaauggagucuccuaugucuacuucuuucuacacagacacaauaacaaucugauuuucuuuuccccacauuucccccuuuucuguucgacaaaacugccaucgucaucauggcccguucucagugagcuguuggguacaccucccagacgggguggcggccgggcagaggggcuccucacuucccagacgggguggccgggcagaggcacccccccaccuccuggacggggcggcugccgggcgggggcugccccccaccucccucccggacggggcggcuggccgggcgggggcugccccccaccucccggacgggguggcugccgggcggagacgcuccucacuucccagaccgggcggcugccgggcggaggggcuccucacuucucagacgggguggccgggcagagacgcuccucaccucccagacgggguggcggucgggcagagacacuccucaguucccagacggggucgcggccgggcagaggugcuccccacaucucagacgaugggcggccgggcagagacgcucgucacuucccagacgggauggcggcugggaagaggcacuccucacuucccaggcugggcggccgggcagagggccuccucacaucccagacgaugggcggccaggcagagacgcuccucacuucccagacaggguggcggcugggcagaggcugcagucuccgcacuuugggaggccaaggcaggcggcugggagguggagguuguagcgagccaagaucacgccacugcacuccagcaaaaaccagucagguguggcggcgcccgccugcagucccaggcacuaggcaggcugaggcaggagaaucaggcagggagguugcagugagccgagauggcggcaguacaguccagccucggcuuggcaucagagggagaccguggagagagagggagagggagauuguggagggagagggagagggagagcgagaauccuuagauguagcucauccccuuggaaaauugucgaggagacaugucaauuugaaugaacuuaaauuaaaaaauaaugauuuauacugucaacguugguagugaagguaauaaaaauaaugauuugcucuaaugcguaugaaauauuuaauacuugucuuuacauuaacauuuguuauguaguaauaacauuuacuaccucagaaguguccaacauuagcuguuaaccauuugcccuguuugagaaaggguuguggucugucucuuauauuggagagaucaauaacaugcgagacaauuuggaaauaaagagauuacuagugguaaauguagauaguacagauauaaacuucugccauaaguuuuuaauuuuaacauuccuugaauaaguuuuuuaagguaucagauuuuuccaaaauaaagugaaauuucauccgauagccuuuagguucaaguaaauagaaauuugcuguguaccuauuauuauuuacuauaauagucuauauuuuauuuccuuuuaagagcauuacagcauugugaagaacugauucagcaguacaaccgugcugaggacagcauaugcuuagcugacaguaagccucugccucaccagaauguaacuaaccauguaggcaaagcaguggaggacugcaugagggccaucaucgggguguugcuuaauuuaacuaaugauaaugguaagauuuuuuuccauuuuuuucucauugaaagauguauauugcaugugaaaacaaguuauuuuuguuucuccuuuuccugggguagugauuuuuuuauuugucauaauguacuugacuuacucauguguagguuuaaauugcuuuuaagaguugauauuuuuagaagccuaguagcuugacccagaaguaucaauaguauguuucaauagaggaaugacuauacaauucuaaguuaauauccauguuaauaaaucuccauuauuaguguucuaaggaagaaucaguaaccauuuuccuguauccauuucuuauuucagaguggggcagcaccaaaacaggagagcaggacggucucauaggcacagcgcugaacugugugcuucagguuccaaaguaccuaccucaggagcagagauuugauauucgagugcugguaaguugaaaugacuuuuucagaaaugaguaucauaucuaauaaggugugcaaaauguuaaccuuaguuuggguuuaagaaccaacccuuuaauauauuguggguuuuuuuucaugaauuuccuuaugaacuuacuguguguguuucuuuuuuuuuuuuuuuuuuuuuuuuuuuuuuuuuuuuuuuuuuuuuuuuuuuuuugggagauggagucuacaguggcaacaucuuggcucacugcaaccuccgccucccugguucaagcaguucuccugccucagccuuccaggugcugggacuguaggcaugugccaccacgccuggcuaauuuuuguauuuuuaguagagacgggguuuugccauguugccaaggcugguuucaaacuccuggccucaagugaucugcccgccucagccucccaaaguggugggauuacagguaugagcuauugcgucuggcugaacguacuucuuauugugcaaaagaaagccaugaaaagacccuauguaaaaauaaaaaguacgaaagcuaaaauuggcaauuaaaaauaaaaggaaugauucuuugggaaaaucggugguuuuuuuguuuuguuuuuuuuguucuuuuuuuguuuguuuuugagauggagucucacucacucucuugcccaggcuggagugcaguggcacagucucggcucacugcaaccuccaucuccuggguucaagcuauucuccugccucagccucccaauuaggugggauuacaggcaucugacaacacaccuggcuuauuuuuguauuuuuaguagagaugggguuuccccauguuugucagguuggucucgagcuccuggccucaagugauccaccuaccuuggccucccaaagugcugggauuacaggcaugagcgcugugccuggccuuuuuucuuuuuuuuuuuucuuuuuuucuuuuuggccuuucauacugguuuuuagccauuuuguaggugguagaacacugauauucagcuuuuuaguugccauuaaaaauuguguauauuguguucauuuguuuuaaguacucaucucugauaauaugugucuuuuaaacuuuuugaagggcuuaggucugcugauaaaucuaguggaguauagugcucggaaucggcacugucuugucaacauggaaacaucgugcucuuuugauucuuccaucuguaguggagaaggggaugauaguuuaaggauagguggacaaguucaugcuguccaggcuuuagugcagguaagcaaccacuuuaaaaacaaacucauaacugcaguuuguuggauuuguccaauuucuuuuaucauuugcaccuuuuaccuccuuuucuugcccauccacugcuggcccucucugccccucccccggccuuuuuaguuagaacuccugaagcaugucucugcugggguagaaagggacuguuuuacaccugaccaauuuuuaaauauucacagcgucuagggugaaagcuuauuuuaaaccagaauuuguaaccaauuaaaaaugugguauaggcugggcgcagugacucacgccuauaaucccagcacuuugggaggcugaggcaaguggaucacuugaggucaggaguucaagaccagccugaccaauauggugaaaccucaucucuacuaaaaauacaaaaguuagccaggcaugguggcaugcaccuguaaucccagcuacucaggaggcugagaggcaggagaaucacuugaacugaggagguggaaguugcggugagccgaaguggcaugucacugcacuccagccuggacaacagagcaagacucugucuccaaaaaaaaaaaaaggugguauaauuucucuguagaucaguaagagguacacugcuuagaaugcauucuuacuuuauuuugcugauuuuuuuucgacuguuauaaucacuccuuaagcauuguuaccaaaaagcagagacaaaggcacauuuguucuauuaaugaaauugggugcaguggcuuacgccuguaaucccagcacuuugggagacugagguggggaggaucacuugaguccaggaguucaagaccagccugggcaacauagugagcucccaucucuauuaaaaaaaaaaaaaagucaagaauccaggcccaucacauccacuucguguccucuaguauuuauuuacucgucugaucuguguccagaacuuugaccuuauggaccacagaaaacuggaaguccuuugucaccuguucccuuacccagucuggaaaguggcaaaguagccgagcaugggaaauugugaaugagaguguuucuuugagccauuuaaagucauuuuuuauuauccucuuuuguucucuauuaugugugauugaauguugacuauagauaagagguaguuaaucccuaggcuuuucuucuuagacucagaauacuccguuuugacuagccuugaaguuuuaguuuauuuaaaauacaaaauuaaaugugaaacuagugauagauuaucauuacuuaucaguaacaguaauaguaaaugguaguaguaauuuacuaucaauaguugauaauagacugcuuuuagucuccagauaccauuuagagauuucauuuaaugcaaaaaacauuugaaaauguuuggcaccuaccgcuuugaucccauugacaacauuuauuuuucugcuaaaugaagcauuucuuggccgggcaagguagcucacaccuauaaucccagcacuuugggaggccaagguggguggauuguuugagcucaggaguuugagaccagcaugggcaacauagugagauccugucuguacaaaaaauaaaacaguugguugagugugguggugcaugcucauaguaccagcugcucgggacgcugaagugagaggauugcuugcacccaggaguuugaaguugucgugagccgugauuacaguacugugcuccagccugggcaacagagugagacccugucucaaaaacguuuaaaaaaaguauucuuuuuuucuguucaguagacuuguuuuuaaacuuuuuauuucaaaauaguuauagacucacaggaaguuacaaaaauaguacaaagaaucccucccauuuacccuuuaccuaacuuccucaaauggugacaucuuauauaacuguaguacuauagcaaaaccaagaaauugacauuaguacauuacuguuaacugcacuuuagaccuuauucaguuucaccauuuucaucugcauucauuuauguuuguguguaacauauguaccucuguucaguuuuauuacguguauagauucauguacucaccacuacauugagauauagaaccgucaccauaaaagaauucccuuuugcugcucacuguacagccuaccugcccucccugucuccuagcuaccaccaacguguuuucuaucuuuuuccaucucuuguuuuauuuuuuucuaucauucuagucucuuucuuuuaaaaauugacuuuucuucaaauggaaccuagaaaugaauaaaaacuuaccgucagucgccucaggagcuguguuugaaggcacagaugauagaucugcauuauccacauaauagggguucauuugcagaagccauccccacacccucagagaucccuguuugugaguuguuucagggauagucucaaauuuuccuacugugucuaauugaccugggaauaucacuuccaguauuccucuuuugcacuuaguguuauagaagccucuuguccuucaggguaucauccuauaucuucucugucuuucuuuuaucugcuaugguuuaugguuugucauuuuuaaaucaguuuaaaguuuuuguuuuucaauuguaauaccuuuugggugauggguucuguuacucauuuuagaaaauugugcugccuuguacucacaucaguuaccuuaaagugucaagaaauggcucuuaauucuguuauucaaagauagaguggaaaaauccauguucagauuuauaucguuuaugcuacugauaacguuggccugaauccaguaauuuucaaauuacguaucuuuucgauaauguuguauaaauggaaucuuacagguaguucugauuacugacaugaacuuuccucuuucuagcuguucuuuucuuaccuauuuauggaucuguuuauuuuuuaaaaaccaaacauaauucacauacguagugggggaaaaaaagucagauccagaaagguuuaaacuccacagaucuauuuccuaaaacguuaccauuuguaauaguuuuguguuuguccugagaaauuaguguuuaugcauauaucaaaauaaaugugcaggccagacaugguggcucaugccuguaaucuguaaucccagcacuuggggaggcugaggcaggcagauugcuugagcccaggaguuugagccuggccugggcaacauggcaaaauuauguuucuacuaaaaauuaaaaaauuagccaggugugguggcaugugccuguagucccagcuauuugggaggcugaggugggagaaucacaugagcccaggaaguugaggcugcagugagccaugauccugccacugcacuccagccugggcaaugggaauaagacccuguccgaaaaguaaauaaaaaaaugugcaauguguuuuauauaaauggacucuuacuguacauaguauuuagucuauacccacucuuugcuuaaugugucuuccugagcucuucaugucaacacguagguucaucacauucuuuguaaugacugcaaacuaguagcuuuuugauuuauacauacauacauacagggucucacucuuuuacccaggcugaaguacagugguccagucacagcucacuacagccuuuaccucccaggcucaggugauccuuucaccucagccucccaaguagguggaacuacaggcacaugccaccacguuuggcuaaguuucguauuuguagagcugaggucucaaacucuugcacucaagugauccuccugcuuugucuccugaagugcuaggaucacaggcaugagccaccaugcccugccuuaguacuuuauuuaaccaaaccucuacugauacacuuuuugaugguuuucuguuuuuuuaaguuuuauuuuguuacaaaaauuacagaaauaaauaccauagcaucuaaaucuuaggccauacuuuucuuuuuuuuaaauuuuuuuggagacagagucuugcucugucguccaggcuggagugcagcggcaccaucucagcuuacugcaaccccugacucccagguuccagugauucuccugccucagccucccaaguagcugggauuacaagcuugcgccaccacgccuggcuaauuuuuguauuuuuaguagaggugguuucacuguguuugccgggcuagucgccaacuccugaccuaaagugauccgccugccucagccucccaaagugcuaggauuuacaggcaugagccacccugcauggccaggccauacuuuucaaaguaugucugugggcauaauuuccugguuuaggaauugugucagaauauauuguacuguauuuaaaguugauaugccuaacuccucccacccucaucaccaaacacauacuuccugugcccuuaauuuauacuucccccuaaaacuuuuuuuuuuuauaagaguccccauucuuucauacucuugccaagauuuuugccagucuaacagguuccuggauguuuuugguauuuccuuaaauggcauuuuguauauguccagaaacaguagugguucauucuuuuuauuuuuccaaagcccuugcuguguuuagcuuccuuuuuuggccuuuucaaaagcaguaauccuugaaguugugucuucagaguaaccuguaacccccaacaacucaguucuuccuggagucauaaguaggaguccaucauucucuucuaauacauuuuuaucucagggcuugaaaauuauugggaaauccagagagcuuuuguuguuuauaugugcuuuaucugucuauauuuacugaauuagaaauugaaacugggagacauuacauuagcuguuagagcagugacauaaucacauggcauguagauuccaaaacuccacugugcacucagugaaagaagaaacaagucagcagaccccuuaguaguaguaugaguguaauuuugaccuccuuuacucccugauagggucuuaaggauccguagggauucuuagaccaauuuugagaauugcugcucucuauaaaguuuaauuuuuauuuucugaaagauauuauuuuauauaaucucucuuugaaguuuguauaccacucuucuguauacucaacaaaucuuugaggucuacuuggcauuugauuuucaggcaauucuuucuaguaacuuggagcauuucccaaauugugucaguguuuuuucuaugugucaguacuauaccagcauagggaaaauaaaguaagugaaggcaaggaauuuagcauauucccuuuugacuuaagaauuuuccaauuuuguauuuuuuugcuugaauuucuuguauuaugcaaauuaagggaaauuauugagacucauucuugcaucauuauuagaugacuucauugaaucuuagcagcauuuauacuuucguuuuggcuuucaguaggguguagagcaaaagcuuuuacuuauacucaccucuuuuuaucacauaaccaucuuagaguuagugauagauuuaaaagcaacuauaacuuuauauuugcauauaugcauauugauuggcaaucucuuuuuaaugaucuucaaaaauaauuuuuaucagcuauuccuugagcgagagcgggcagcccagcuagcagaaaguaaaacagaugaguugaucaaagaugcucccaccacucagcaugauaagaguggagaguggcaagaaacaaguggagaaauacagugggugucaacugaaaagacugaugguacagaagagaaacauaagaaggaggaggaggaugaagaacuugaccucaauaaagguauauuuacuuugaaugguguauuuaaauugaagauagugguuugauuuuguuuuuuucuucaaacuauuuuaauuugcagauugucuuaaucuggcuauugcuugaggaccucucuaguucaguccagacaagcuuugauacuuaagugcuugugguaguucucccacagugaggaaggugcgugccaguggcaggcaugcuagugacgggaaagauccaguuaagucacucuuccuuccggggcccuccuuuccuuuacuuaucugugaagagacauauaggagacauaauaggauuuuuucaguuuucaguuuuugagauuguuuuuucagcuucacuuuaaacuugaagaucuauugucagauuacaguaauaguucucaaaguguaaguacuagaugguaaacacaguaagaaauauacuguaggcugguggcucacaccugugagcccagcacuuugggaggcugaagcaggaggauuacuugaggcuaggaguuugagacaacaaucuagcaagaccccaucccuacaaaaaauauaaaaaauuagccuggcaugguggcacaagccuguaguccuaggugguugggaggcugaggugggaggauugcuugagcugaggaauucaaaguuacagugagcuaugauugugccacugcccuccacccugggugacagagugaggcccuuucucauuaaaaaaaaaaaagauacuagagguaauaucuucgcuaaucauacauuauugaguaucuacuguugucagaauuugugauacaacuuuugccauuuauacaaguucugcaaaauagccauuuguaacuuuguaucacuaagguuaugaauuuaaguucaguccgcccuccauacauguggguuccacauccacagagucagccaaccacaaaucaaaaauauuugaggaagaaaaaauaauacagguuaguaaauaauauaguauaacagcuauuuacauaacauuuacauuuuauuaggugucauaaguaaucuagaaaugauuuacaguaugccagaggaugugugugacuuauaugcaaauacugcacccuuuccugucagagauuugagccuccuccaguuuugguauuggagggugcuggcauccuggaaccaauaccccuuggaugcagagggacgaccauauguucagcuucacaucaguaggaagcaagccgcagcaacgucucguucugagccuuuucuccuguuacucccacuccuccccaaaucugaucaccauuaguuuuaauauuguaauacuugucuuuuccuuuuucucaguuacuagguuuugaugcauuucuuuuuuuuuuuuuuuuuuuuggcguaauaacauuuuugguuuuuuagcagucuuuuaaaaaguuacagcuuuauugagauagaauucacagacuguacaauucauccuuuaaaaaugaguaauucaguaguuuuucauguauucacaagguugugcugccaucaccacuaauuccaaauauuguuuuuaucaccacuaaaggaacccaauacccauuagcagccaucaccccuauuuuccccuccucccugggcacuggcaaccacuaaucuacuuucugugucuauggauuugccuguuuuggacauuccauuuaaaaaggagucauacaauauguugccuuuuaugacuggcuucuuucagccagcagaauguuuucaaaguucauccgugauacaguauuuguuaauacuguauuccuuagacaaauaauauuccauaauauuguuauaccauaguuuauuuguuuacugauggacauuugagugguuucugcuuuuuagcuuuuugaacaguuaucuacaaguuuuuuuguagacauacauuuucauuucuuuuggauuuauaccuaggaguuggaauuguuggauuguauguaacuguguguuuuaacauucuaagaaaaugccaaauuguuuuccaguguggcugcacuauuuuacauucccaucagcaacguaugaagguuccaaguuacuuguauuguaaaagaaaauuuuuagucauccuagugggcgugacaugauaucucauugugguuugauuugcaguucccuggugauuaaugaugcugaccaucuuuucaugaacucauuggccauuuguguaucuuguuugaagaaaucucuaagucuucugcccgguuuuguggguuguuuuuguuguuuuugagacagagucuugcucugucacccaggcuggagagcaguggcacgaucagggcuuacugcagccuugacgucccaggcucaagcgauccucccaccucagccuugcaaguagcugggagcuacaggcgugcaccgccacacccauuaaagguuuuugaauuuuaauggagaggaggucucacuauguugcccaggcuggucucaaacuccugagcucaagugauccuuccaacucagccuuccaaagugcuagaauuauaggugugaggcaccacgccuggcccuuugcccaguuuuaauuggguuguuuuuguuguugaguuguaagaauguuuuuuauauguucuggauacuugacccuuaucaaguucaugauuugcaaauauauuuucucauucuguggauuaaucuuuucaguuuguuaauuguguccuuugcaacacaaaaauuuuaacuaaaaguuuuaugguuucagcuuuucuuuuggaucccuauuucauuuugauuaaauuuuuguuaaucuguggauauccaguuguccuagcaucauucguugauuuguagcaguuuuaaaguaaagauaacuaacagaaugguugguuuugugagguuuguguuaauuaauauacuguuacaauucuuuacuucaauucucucagcccuucagcaugccggcaaacacauggaggauugcauuguggccuccuacacagcacuacuucuugggugucucugccaggaaaguccaguaaguacauaguucagugauguuuuauguaucuuugaaagauuccaauguaacgacuucauaccuuuacauguuucacuuauuuauuucuucaguguuucccccuuaauguccaacuuauuccacaaaggcuauuggcugauuauaggguuguuuaaauuguuuguuuccuauggaggaaaaauggcaagaaaauguguuaacauuuccaguaguuuuuuuuuuuuuuuuugaggcggagucucguucugucacccaggcuggagugcaguggcgcaaucucggcucacugcaagcuccaccucccugguucccgccauucuccugccucagucucccgaguagcugggacuacaggcgccugccaccgcccccggcuaacuuuuuuuuguauuuuuugguagagacggggauucaucguguuagccagguuggucucaaucuccugaccucgugauccgccugccuuggacucccaaaguucugggauuacaggcgugagccaccgugcccggccauuuccaguaguuuuauuuaaauuaccuaaauaguuuuaaaguaaaaacuuuaguacagucuguauuggaaagggaauguauagcauuuuuuacaugcuaauccuuuccaauauagguuuuacuaaguaaggccuggaguggaguaaauuaaauugauuuucacuuuuuaaaaagugaaauaaaguugaucuuuauggcuuuauuaggaaggaugugccugucagaguuaggcuguuaaagauguaagaaaaagcaguucuggaaaacaagcuagucagugcuuuaaucucaugaaaaaggaagaauuacauacaugaaauaaaauuaaaaaucaaaauaguauauaauauuaaaaacuuuaaaauacuuguugagcuuuuucagguacaucccaaaggucagaauacuaaugaaaaagcucuuguggccgggcaugguggcucaugccuguaaucucagcacuuugggaggcugagaugggcagaucacuugagguuaggaguucgagaccagccuugccaacauggcagaaccaugucucuacuaaaaauauaaaaauuugcugggcguggcggugcacaccucuaaucucagcuacucgggaggcugagacgcaagaaucgaaucgcuugaauccuggaggcggaguuugcagugagccaagaucgugccacugcacuucagccugggcuucagagugagacuguuucaaaaaaaaagaagaaaagaaaaagcuguuguuugauggaugaaucuguucacaugccuuugguuggaguaaaagaagggauaguaugaaaccuguacucaucuggcuuaaacaagauggcagagucuaauuugggugaugucagugccucacugaggucaucagagacucagaucauuucugucuuuauuauuuuucuguauuuuuuuguagagacaggguuucaccauguuguccuggccggucucgaacuccugggcucaagugauccuccugccucgaccucucaaagugcuggcauuauaggugugagccacagugcccaccccauuucucucuuuaaacugcuguccuccacauguuguccucugcuagcccuuauggucccgugcugacuacagcuaggugucucaucaaauuaaguagugccuagcaguaauagggccucuuccucuauaguuuuuuuuuuuuuuucauaggugcauuggcuggaaauacauaucuuuuuaagacaacuguuuguuuauuuccccugugggaccccaugccacucucaccccucaccagguagacuucucaucuuggccagcauugggucacaaugcuuuugucugaaccagucacuggcugggaacaugggauuacugugaguggauuagaucaucaggauucacuuaggagaaauacaaaugucuagacaaucaggcugagucagccugaaagugaaagguugugacuauggggauagucugcugccuugggaaaaacaaauaugaaggguaaaacuguugaagaaggguccagcagaaucauugugaguguucucuuucagaugggggguugggcauagguggauuauuuuuaaguguaaaguccauuuguaaagccagauuuugaaauggaaggcagauuguuuucuaggagcaagggcauugagggaacaagaaagaguggagaccuauaggaggggggcauuaguuucagcaggaagcaggggccaucucuuuuugaagcuggaggacuggaagaacagaguuaaugauaaaugaauggcuuuauuugagcaggaacucaugcuggcucuguguaccugggcccaucuacccaccccacguuuccuuacuuuagccaucuaauucuuuguauugccuuuuuuuuuuuuuuucacuuuguguaucuaaguccuguguguuuuucugaauccaucuuguccaucucuuccauacuuaacauuuuaacuaaccuaaauacaacagcccacucuguguggccccucuggguaccgccgauuucaggaucaagaccaaaguucucaucguggcucuggaggccccgcaagaucuuuauaucccuuuuucuuauuuccaaugacaagauuuuaagagcaaaucagaaacccaucacacacaggaaaggaggaagaggcaggccucaaaagcagugaaaaaaggccgggcgcaguggcucacgccuguaaucccagcacuuugggaggccaaggugggcagaucacaaggucaggagaucgagaccauccuggcuaacacggugaaacggugaaaccccgucucuacuaaaaauacaaaaaaaaaauuagccgggcgugguggugggcaccuguagucccagcuacucgggaggcugaggcagcagaauggcgugaacucgggaggcggagcuugcagugaguggagaucgcaccacugcauuccagccugggcaacagagcgagacuccaucucaaaaaaaaaaaagcaaugaaaauaauauuuaaauuuaaagauuuuuagauacucuguuuuuuacacacuauagguuuagucauauuucagucacguucuuucuuacauaaucguucuugaaauuguguuauuaccacauaugauuuaucuugggccaucuuucccaugcuaauuccuauuuguguuugccuguaucuaucuugucucuaaaaagagaauguucuuaaauugugggaaauguugugaauucauagagccccagauuuauuuguugccuuggagauuauuaugauuaacaccaaaaagcuagcugauaccacaaaauguaaaggaaguuugguuuaccuaauguguaagugaaaagagauagacaagaaagcaugugguuguugcaguaaaugcugcuuuguggucugaucccauuuucacuugcccuccaugucuucucacuuugcagcuggugcauugcaguggucagucuccucacugcucuuccugcuuuguugccccuccauuccugggacauugcacauugccacuggagcuaacuuacuucagagcacuuacugaucacguagcuccuugcccagucuuccuuggcucacagccaggaaggggacucaugacuguuuaguguugcaagacccuggacuuaagacugcuucuccaauuuccaaaccuacuggacacuuuuaaaauuuuucaaauaggccaugcuguaucaugccuuuucuuuuuguaccugcuauauucuguuaaaaaaugcugucacugucccucccauugccucagaaacgcuguaugucauguucuguaguguguugauagagaaggguuugauuuggauuaaugaggggcuuucauccaaaauauaggagcuaaucauauauucucuauuacagaggcguacuuuucuacugagcaguucuccagagacaccuuagccacuauuuugcccaccacugugauagcuuuuggugggaggaucaguuugaauguguguaacugauaucuucagcacaugaguacuuuagcaguguuuugauuagaucuuuucugaagcuguauucaucucauuuuuuugcugcuuucuaauuuugcgaguacccuggcaugggaauaggaaaaaggggguggguaguggcaaauuucugaagagaaauaugucaucucuccuuuuuugcccccgcuaacaaaagucgaauugggagcuuuuguguguuuucuuuuuguuuuuugguugguuuuguuuaacccuuuaccuuguguccccaaacuugggacaguauacuuucuuuugccccuuacuacaggugaaccuuccuaaaagauuuuuucuuuuuauucuccguaaaacauuuaaagcauucuuuaaugaaauaguuuuuuaagcagguuguguaauguuuuccauguaacagauugguuuauauauaguuuggcugcuucuugcuaauaaugaaggguuuucucuccugauauugucugagaaucuaucauagaugagguuagauugccuuuggaaagaugcuucuaguuaauuccuguccuauauaauuaguugaauucaucugugaaggaugugaauuuuucuuugaucuuuuuauuucaugagcagcuuugugaguacauucucaggucuaaaguccucacccucuucuccuauucccccagggcccccagugaaacacacacauacauuaaacagugcaguuuguuauuucaggccuuuuucuuugcauuuaugaaaguaggucggcaugcugccucacaccuguaauuccagcacuuugggaggccaaggugcguggauuacuugagcccaggagcucgagaccagccuggccaacaugaugaaaccacgucucugcuaaaaauacaaaaauuagccaggcaugguggcacgugccuuuaaucccggcuacccgggaggcugaggcaugggaaucacuugaacccaggagguagagguugcagugagcugagauuacaccacugcacuccagccuggguaacagagugacuguuucauuuaaaaaaaaaaaaaaaaaaguaaauguguacacaaauauuucuuuguagcuuuugccaacuuuaccuuucuccuuucuuucugagggugagguaggaaaucacaugcagagugaguguggaaagagaauaaauaaccacguguuccaaggaucuuaaaaauuugcaccaagaugugugucaaaaccaacaacauuguacgaggugcaaucucauguuuucugccagcugaccaauauuucuugcucuguuuccucagaucaauguaaccacugugcgggaauaucugccagaaggagacuuuucaauaaugacagagaugcucaaaaaauuuuugaguuuuaugaaucucacuguaaguagcuuuuauuacagcuuauaugauuuuaaauuuauaauacauugacaguagacauaaaaauacuauggccauaguaagugggagcaaaaagggauuuucuuuuaauuuuaauaaucguguucuauuucuucaagguaaucauugcauguuauggcaaauaacuuuaucaaacccacaauuuaaucucgguguacuuugauuuguaguguucaguuuaguaaaucuagagguaaacuuuuauuuauacuucuuaaaaucuguuaaauauuaacuguuacuuccuuuccccuucacccugcuuucagugugcuguuggaacaacuggccagaaaucuaucucuagagugauugaauauuuggaacauugcuagcugcuuuaccuuugcuucaggugcucgguaaugcuggagcuauccuuagacaaagaaaagucaagucaugaaagaaguccuugaagauauaccaagaacauucaucaguaucauucguguuuggauuuuuaaggccaccugauuucuucgucaugcauucggcauuugcuaaaugacaguuacuacaucaaucugcaacuaucaaaaaugaggggaaaagguucaggcuguuaacaauuccaugcaguauuuaaauacauuuacuuuggcagaguuuauacccuccccuuguuuucuugcuuuauucugggcaaguuugaaggggaaaauuugugcugcuguuagugcaacugcuguguauguugagccacuguugucaugccagccaggugcaaaggcagcuuagcuacugagguagcgaauguucugaggacauucuagacaacagcuuaguuccuuuuucaggcucauuugcuuuugcuuuuuuguugaaugauuccaaucguaaauaaagcuuuuaauaauuuugugaauuuuuugguuguuguucccugaacuacugucuauauuuaaaauuagauggaauccaaagauacacgggauuaauaguauauuuuuuuauucuugauuagguuuggguuauugaacuauuuuuuacuuuugagaccacaaccauauucaauaucauaccauaaugugucauagcuauaggcacaagaaaaacaacaguuugagagaauauuauauaagaugaugugcccuguuaaaaggaggaggcaaaauagucaaacccaggguaguuuacacuuaaugcuagggaggcucuuaaaacauuauuagauuuugaggaaagacucucuagauauauuuucuaauguucaguacaauaaauauaaggaagcuaaaacaccaauguggaauuccuguuuccagauaacauguauauucuucuauagagugacaggaucaauugcauaagcgcaaagccuuaaauugcugguuuagagaagacccuuuuuucauucagauucuuuguucguagagcaguuauuugaaaaacaguuauggaacacaaaacauuuuauagauuuaauaucauaacauugcaaauuuuucuuguauuauucacaccacugguuauacuuuuuuuuuuccuuuuuuauugauugggccugaauacaggcuuucuagagaucuuuuucauuaauacuuuuaaauaccuuucagguaguuacaucauguuucuucauuggauuuguaaaacuugaagccauaaaaauauuaguuugguguguauuggggaaaauagcuaaaagucuaauuuuuacccauuuagacuuuguuauuuccuuguauaaagugacaaaucggggcucuuguaucagugccagcuguaauguuuuuaaaugcaguggcugccuucuauugucuuccuauuuuugauaaugcagauuguugggaaaucuguaaggaaguaacugauuccaggcaaauuguuuucuuccuucuacccaccccaaccccuacccaucaccuuuuaagaacauaguacgccaguguaacgugggaaccauugagauuguauuugcccugaguauuaaagcuagcuuagcaaaauacuuuuaaaaacauauugguaaaugauacccguaaaauuaaauuaguuauauuuuauuuuaaaaugcaaaauacauugauauuuauuaaucauuggauuuagggaaagggacagauuuuuggugaaccugacuuguggcagaugguaaggaauauuauaaaacauuuggaugagaacaaucagggcgaacugcauuuuucuguuacacugguaaucauuugaaaauugauuuaccucaguguuuaacaguuuuuuguuuuguuuuguuuuuuaaauaauaacuaauugucgagcacugauagagaugcagauuuugguggggggagguggugggggagauaaucacuucaccaacugcagugcauuuguguguuuuuaacccucagagaacucugcauuuuaggguacuugaggcugacuuaacuaaaaguuuuaaaguaaccuuuuuuccauuguaaauauuucuguaaauacuaccaauuggaaauuagaacaguagaguacuuuucugaauccaauccuauuuuuauuuuauacaguauuucucagcugugaucuuuggagcaaaagccaacggcaggaaaaaauaguuuguaccaguuucaugaaguaugucuuuggguuuuuguaaauaauuuuaacucaaauaaaauugcuacuuucaauaca

SEQ ID NO: 192484 - RNA, 66424 nt, Homo sapiens
acuuccggcguaugaggcggugacaaugggagcagcgcgggcggcgccgggaggcagcugacaagcguuugcggcuucgcuucauggccgcucucccgccccuccugggaucuguggggagcuggggagcccgcagcggcccggagccggagcuggcgagccgagcggagaccugugcgccgcgccucugaggcgcagcaugugaagcggagacggcauccaguggggggcgagccucucagccggccgggauggcuaccacggccgagcucuucgaggugggccccggcggcucuacagggaguggcaggcccgggguuugcaggcagcugggugggcgggccgaggagcgggcguuugcuggcugcccaggaggagcccucgggagagaggugcgaaacagaaggguugggguggcagcuccgugucagcgcgggcggagcgugaaaugggggaggggugcuuggggccgaggugggcugggcggccggucggcagagaggggaagccgggugucccaagggaggaggguugcuuuuguuugugggggcaagagggaaagucuggaagguucggguguuggaagaugucuacuccggaugaguagugggaagggcugacucaggacgaggaaagagagccaggagccucagguugggcgagucuugucgcugggguccucgcgggaauaauaggaggaagccacuugagaucgggacucuugggggcuucucguuuugaguaauuauuccauuaguaagguugcagguggcauucauaggacugccaguuuaaccugacauuugaaaaggcugggacaauuuuuuuuuuuuuggacaauaaaggccuacuuaucucuuucgacugaagagagauagacugaagggaggcaaaauucaagugaacacuuuauuucauguaauacauaauaauacacucgaggcauuuacguguauuauaaaauaaaaaaaguuuauaaaauaaaacgaacacuucguuucauguauauaaugcaccuuaaguguauuauaugcauuuacauguauuauaaaaucaccuaacugcaagcuagagaauccuuaauauguaauagugagaauacuaaugucuuuccucgagcguuuacaguaucuaaaccuuaaaauuuaauuucgugaaguccguuguaagaagcugugauaaaaguuugagauaauagaauaggaaaacucuaauuaggcuacaaaacaaugacacguauaaagcaucuccuugugugaaagaaaugaaaacggauaagaaaaaggaaagaaagaccccuuuuuugugugugugcuuguguuucacauugaguaacaaaaguguaauaauugagaagacuguaauccacaauagggaacuucuccauaagugaaaaugguauccuuuuucugcguaagauucagcaguuuuuguggcuuacaauuugaaugccacaguuuuaauaacaaauggaaauuuacauuuguuauuguuacuauauuuugcauaucagucagcuuuuggauagauaaugcuuuuuuugagaggaguaauauauguuauuguuauaauaaguuguaauaagacaguaauuugugaaugaaggauuguaauuacaagaaagacuucagagauauuguauuuucucacuuaaguguugggagauaugcuacauuaauuucuguaauuccaaaauugugccaucuguuuauugacacaagaacggggagacauuuuuccugcuaggaacuuuuacugugucccuagguacuaaguagugcugugguuccuuguuuuauuuuucacaucuuaaaaagggagaaaacgaugaaguuguaugagaucuuuaauuaagguauuugccggcaagccagcucuuaacugaaaacuguuauauauguugucauacaguucauaagacauuauccuuugaguuaauccugcuugacaguuccaguuguaccuuggaccaucuuauguauauuuuuauuuaaauguuugaccacaugauuucaguaacuuauuuggaaauauguuugauuuuuuuuuuuccccucucccuagcggggaaggggaggagguggggaaauauauauuuugcuuucugggguccugcuauuagguuaaguaguauauauauacguuuuauauauauauauauauacacacacacacauacacauauauauauauaacguauauauaacauacauauauauaauguaauuuagugacucuaguuacaugguagccaguaagauucugugauaauagagacaguagcccuuagacuacccuuaggccagaggguuuuuaggacaaauuuaaacguauuuauagaucuuaaaacugacgugacuuuuuuucuugacuauauguagcuuguugcuucaucauaauuaaaagcauaauaguuacaauuaaguuucaauaguuauaauuaagaagugcauuuaucuuuucugguacugcuaugaauccagcccuacaguggacucuacucuugaguaaguuuucauccccaagugaaaaguugaucucuuggccuuggagggaggaggaaaaaaaauccugucacugcucaguuuccuguaacuacugccauagcaucuagguuguaguaagagucacgggaaguaucuuuuucuccugcuucccuuucuuagucccagcuggagaacuguggaaaacggaaggcaggauguagucaaggauguuugguuuuuaugcauccugauuuucaugcacuguuaaauagaauuaugcuuucacuuuucauguuaggagaaguuaaaugaaaacaaaauuaagcuuuugaauccaugacauuucauuauguuaacucugcuucuuuuaaaaucuuauuggucccaugacucucaaugaaaacaacuucauauaacaaaaucaaacuguaauauauuuccucaguugaccgaaaugauuuaguaauagaugauuuggcuauuguaauaguguauauccuggaaguuucucagaauaccuucuuaguuucaacuuuuguugacagaucuuucugaaaagauccauguacaguguuuuaaaaucuccucaggauagacauucugaguaaggauucuuaugugguguagauaaauuguaucuucuacauauacaaaguggcugggcucagaaauuccuuuucuuuguuuuugagacagggucuugcucuaucgcauaggcuggagugcaguuggguaaucacugcucgcugcagccucuacccuccuggcacaauccaucugcccaccuuagccuccagaguagcugggacuagaggugccugccuccaugcccagcugauuuuuaaaaauuuuuugcagaaauaagguuuuaccauguugcccaggcuggucuugaucuccugggcuuaaacaaucugcccaccuuggccccacaaggugcugggauuacaggugugagccaccgugccccgccaguucuuuuuauguuguugcaaauguuccucucuccuuuuauuguacuacugaggacauucuuuccucauuugcuuaauuuuuucccccauaauucuucaagaaucuucgcuuuucucuguuugggcuaccauuacgggagaguucuugguuaguaacuaggguuaauuauucauucauucuacagauauuuguugaguaccuuuuaaguucaagauaaaguucugaaauugacgaggcugcaugucucaaagggcaugccauagaaauauuaauccuaugagaugugucgcaaaaaaaaaaaaaaaggguucagugaccaaguaaguuauggaaaugagcauagucuguuucguuggagauuugcgguauaccuuaauauguuaaagaugaugagaaguccauuuccccaacuuuuuucaccaugagacuguuuucuuucuuuuuuaaagagacuuuuauuuucuacugcuuguuaacuuaauuuugugaauuacaagguacauauuuuggaaaauagaauuaaguauagaacuuguccuuaucaaauagagggagagaagguggauauaugauacuauacucuuaaaaauaagguuauaaaugguuucaaagaggucuagaugugccauagguguugagaggaugggaagauugccucuagaagaaagaaaggauuagaagguggcauuugaauuaccuacagaggauaaauuagauuugaguuuguggaacuggauggagggacuuuucaguaaagcagacaauaaaagcuaagacauaaagggaggguuguaggcccuggagauaaggggagcauucauuuuggcuggaguauauauagcacacauaaagaggaagaguggcauguaagguaaaucgggguuuaauuuuggagguccuaaaugccaggauuaaaauuucauuuuuuuuucuuucuguaaauauagguuccuugauaauagugcuugaggucagguaauuuggcuaugauagcaauggcuguuugacuuccaaauuagaguaugaauauugaagaacaccuuuucccacauuuauuugucucuuaauuuuucaaacuaaauuacaaaagcuaguuaaacagaguuguugaaaaugaugucucuuguucaauuagcuagccagguauauacuaacgaacaugagauacacaaguaaggagcaccccguuacugucaaggugcugaaaugcuauuuauuuuaaccauauuaguuguuaaguguuuauagaccuuggcuaccaauuguaguaacauggauaugauagaauguauucauucugcaaacguugaaugaaucuguaggccagacauuccagguacuagaguuaaaagauguugaguuaagcaucugguugaggaagacagacauguuaauacauuaauacagcgcagugggaguauagaaucuuuuccagggauuauuaggaaagguuucauuuaguaauggcauauagaaauuggauguugauggaugaguagagauuuuucagacaggagaagggcauuccaaggcagagacacaagauggcuccaguuuguuguaaggugaggcaguugagaagaguuaggauguguaugugcauauuuuaagaauagggagugguggcaaggcauugagaccauaggaguucgagggcaguuuuuuuguuuuuuugcuuuuuuuuuuuuuuuuuuuuuuuaggcuggagugcaguggcgugaucucagcucacuguaaccucugccucugguuucaagcgauucuccugccucagccuccuggguagcugggauuauaggugccugccaccaugcccagcuaauuuuuuuauuuuuaguagagaugggcuuucgcuguguuggccaggcuggucucgaacuccugaccucaugaucgaccugccucggccucccaaagugcugggauuacaagcgugagccaccgugccuggccaguuuuuuuguuuuuugagacaggguuuugcucugucacccaggcuggagugcaguaguguaaucacagcucacugcagcgucgaccuccuaggcaaaagcgauccucccaccucagccuccugaguagcugggacuacaggcaugugccaccaugcuuggcuaauuuuuuauuuuuuguagggacggggucucauuguauugcccaggcuagucuccaacuccaggacacaagugguccucccaccuagggccucccaaggugcugggauuauaggcaugagccacuggguccagccugggggaaguuuuaagaaggcuuuuuauaccucaugcaagagggcugaccuuacuuuuuuuggguaagggucagggagacagacaauuuuaauguuagugugaagaauggccuucuaugggggaagaaauuguuagcugggaaaauagggaucgugggcaaccugacauaguucuugucauuugguaaguguuccagaauuaucuguugacugauuaaucuggccagaugaaagucuaaccuaauucaauggugacagagaagaaauuugaaaagaauuuuggaggaagaauuaaaggaauuugauuacugaggaguuaaaauuccaaauuuguaaacuuugaaaaguaggugguuggugauucauuaacugugacagagaaaauuagaaggacccuugcagggggaagaaauaauauauucauuaaguauauauauacacacacacauauauacguauauauacacacacauauauauacauauauauauacauauauacuuaauguauauauauacacuuauguauauauguauauauguauauauacuuaauguauaaauauauacauauauguauauauauacuuaauauauguguauauauauacguauauauauauacacacacacacacacacacacacacauauguauuuacacuuugaguuuuuagcaagacauccugguaaagaaguccacaaggcaaauggaaauaugaauuaguaacucagaaagagaucacaguuagacauagcaguuuaggaaguaucacuuuaugugggugguaauuuagccaggagguggaagacaucucucagcucugccucuuacuaguugugugaucuuggcaaguuacccaaccucuuuguaccucaguuuucucaucuguaaaaugggggaaauaaugguaucuacuucagaagguuuuuuugaugacuaaauugaguugagaaauuuaaauugcuuagaagcauacuauuaagagaguaguauccauuuuaaaaaauuagguguuggccacuuucaauuuaaguggauugagaugagaacuagauuagagaucuaucagggagggaacacuucagccuucucagucucaguugacucagaguaaaugauccaagaaguaggagauuauaguaggagaggauuacaaaaaggggcuguggaagguuguauuuuucaggauggucacaagaucugccauccuacauugugauguuuaugccccucccauaggaaguagguucuguguucacuucuugaaucuguacaggccuaugacuauagaagugaugcuauguagugauuugcaagguuagguaaccucuuggacucuagcagccaugccaagagaaagcccaugcagcccuuugaaagaaccaaggcccuuugcccuuggcucuggcugaacucccagcuaacaguaaacaccaacuugccaucuuggaagacuaucuucuagccaaguugagcagccccagcuuauuucauguggagcagagaccagguuucccugcugagcccuccuccaaucagauuugugaacaguaugauuauuguuauuuuaggccacuaacuauuugagugguuguuaggcagcaauagauaacuguaacagaggccgaucaauuucuuaccugcaccaagaucuaauagccuucugcuggucuuaguggagacagugguagagguagagguugaugcuuaagaguaauagaguuccauuuaaguauuuuaugcuuuggaguucuccaguccaagcaacuuggaagugaacuuuuggaauaagcaagucauuaaauugaggacaguauuauagacugcacauguguguaauuaaucuaaaauacugagucccugguguucccaggaaauuagauaguugaggugugugugugcccacaugugugagagagauuugaaagagugauugauugccuuguucucuuaaaaguggauugcaauuucauguaacaccgugcaaauaaacauaaccuacaaauuaaacgaaaguucuaguugagugauaaauaauuuaaaaguuugauugucaauaguuuauguauauauauauuuuuaaaacuuagcaaacuuuucugauguuacuuccuugaagccgaaauuugaaaaugagaaaauauaguuauuuacauaucuuugcuuauucaaguuauaauaaacgaaagaagcaaaugauucuuucacuuguuuaauuucauuuccaaggugucuauuaaaugccuguaagaauauuuaacguguguauuuggcaauacacuuaauuugauuugaaaugcuaauggcagauuuuauuaaauauuuaaaguaauuucacagucuauaaauguuaaaggcacuauaauagagugggaaaaauaucuggguuagaauccugguuuaguaccuugauaagacuuaaauuucauuuccucaguuucuuuauuuauaaaaaugagaugaaagagcugggcugugaugauauuuaaagaacauucuugcauuacgaauuuuaaaucuaauuauaugauucugcugagacuaguguaacaggaauuguaacauuuguuaccuuucccuuuuggacauagacauaauauauauaacuuuacuguucgaaaugagauauauucuauccuggaaaaauauuuugcuuaagagaaucuaaaauauuuuguaagauucuaaacuaccaucguuuaaauagucuucaaaacaauuuugauaacaugauuaauuggcuaauuucauaguuuaaagggcuucaagauugaauguuaacauugacuaauuuuaaaaaguaaaauuauuuauuuuguaguguuugugcaaguaguuuucaaaauacuuuuucaaaguuugcuuuaguuauauuagugucuuaaugagcuuuauuuuucuaccuuuucauacuaccuuugaaauccauuuugcuagccugagacaaaauauuuuguggugcuuuuuuaaaaacucaguauucaauaaauauaacuuauuuauuaauauacagaaaacacguaaagaaucucacugaaaaaucaaagaaaaugggguuagaaaguagaggccgaauauuauaaaauucuuuuaguucuuuguagugccagaauuguauuaggcucauauuugguuucuguuagaaucuuugauugauaguaccauguaaugccuguucuuuauuucuggguugugggguggugguccugccuuuuugguuuuggauguauggaucaagagcaugacuuucaagacccucugcagggguuucagccauggccccaacuagcuaguguuuugguaugcucggcauuguucuguugacuacagcuggaaagcaagagaaauguaugacacagcauccccuugcuuucaauuuaaguauggagaaaagagugaaacuuaugaaaaugauucuaaaucaauaaaugacaaaaugacaauuaguaauguucuguguugggauuugaauuuuuaagcuucauagggguuuaagaguggagaaauuaauggagaccauguaaggaaggaacccuucaaagaagaaacgggaauagagccaggcuuugaauaaugguauagcaguguuugaauuguuggaggagaaaggccauacuugguggggugaguuaccuggccacagguuaggaagcaggaguagcaugggcuugaaaagaagacuggaauagucugacggaaguguggcuguuuguuuugagguacagagaaauuuggguaggugguacaagauaagaacccuaaaggguagauauaagagugugaacuuggcugcauguggugacucacaccuguaauccgagcauuuccagagacugaggcgggcagaucacuugaggccagcaguuagagacuagccuggccaacauggcaaaaccccaucucuacuaaaaauauaaaaauuagccggaugugauggcgcacacuuguaauaccagcuacucaggaggcugagacaugagacuugcuugaacccaggaggcggagccgagauuguaccacugcauugcagacugggugacagagugagacuguaucucaaaaaaaaaaaaagaaaagugugugugaauuugauaguguaguaggaauuauauagggaaguuucucacuaaaaggagguaguguuuuaaugauuuguuagacagugguauccauaauaaauuuaaggaaaauacaugauaggcaguacuuuugaaccgauggguuaguugguuuaacaagauacagaaauaucucucugaaacgaucugagacuuacuuuauuuuuuuuaccuaggcugggggaaauauccuagcuucuuugaguuuuugggugguuccaacacauuguauuggaucugcuuuugggaauggagauacaagaaaauauaaaaauugaauuugugucaaggaagcaacauuauuuaauuagggauuuauguuccuguccaagggauugacauccaagagauuuuucaguagaaaugaccacaaauaccauuaaguucugggauacaugugcauaacguacagguuuguuacguagguauacacaugccauggugguuugcugcacccaucaaccccucauuuacauuagguauuucuccuaaugcugucccuccccuaguccauuacccucugacaggcccuggugugugauguuccccucccuguguccauguauucucauuuuucagcuuccacuuaugagugagaacaugcaguguuugguuuucuguuccugugugaguuugcugagaaugaugguuuccaguuucauccaugucccugcaguggauaugaacucauccuuuuuuauggcugcauaguauuccaugguauauaugugccacauuuucuuuauccagucuaucauugaugggcauuuggguugguuccaaaucuuugcuauuaugaauagugcugcaguaaacguacgugugcaugugucuuuauaguagaaugauuuguaaucuuuuggguauauacccaguaaugggauugcugggucaaaugguauuucugauucuagauccuugaggaaucgucacacugucucucacaaugacaaacaucauauuuuaauguuacaauugguaacauuuguaaagcauauaaaaucaguuuaauggagcaauauaacaaccaauuauguaaagcuaaauuucauaugguaguaucuuagugcauaguucuagauuuuuguuuuggcuugguaauuuuugcuuuugauuacuauagcaaaacaaagugaagcuaaaccuuugucagccuuauaaaauucugaaggauuuaaaaauuuuuuuacagguauuuguauuacagggaauuguuugagaagucuuuugggaggacuuggucauuuggaggucuuaggauuuguuaauuuggcuuuuugucacuguaagcgccuuugcagcaagauaaaguauuagaaagcaaggcauuaggauuuauuugcuuauauaagcagaauuuuuaaauuuuuauuuauuuauuuauuuuuuauuuuuugcuuuuuuggaacuuccaucccuuggggaucaauugcugacuucucguaaacccuugugauaauuugucucugaggauaaaauguguacuuugcuuucaggacacugaccucuuauuuucuuccaccuacacuggugccucuugcuuucuuuuguuggauuguuuuccugcucuuaucuccaaaucuuggcaugccuuucuuccucguagaucucaaccaguccuuaaguaaccaucuauauguugaugauucaaauuuugugaagcuccagcuucuuccguguaguaaaaauuuguuuuuccaucuaugugcucuauauuucucuuacauaucuaauaggcaucuacacuuuaacauauguggaacaaaacucuuguuucacugcucccucauccaucuccuucccugaucuucccaucucaguaauuagcaccaccauucacaaaguuguccuggcugcaaaccucuaccucaaugaguaaucuuuuauuccuuuuuuuucuuucuccacauauccagucuaucagcaacuuauaugaaugcaugccuuaagacgucaugaaccuauuucucagcaccucauccacugccacuuucaucugagucacugccaucucuugacuggacuacuaagguguugcagguugggucuuuugggaagcagacuuugagacaguuuaguaugcagaauauuuauuaggaaguaaccuuggaugaacauuuaugaggggcagagcaaggauacaagauugagcauguggagaaguagaguuacaguuuucguccaguggcaguguugauggcuucuguggggaggucugaaacuaaaaugaccugucagaguuguccugcuuuggaccaaaguggucuggcccuuauacucccaucuuaaucagucauuggguauggaucacauugggaaagacaugacauugggugaagugucucuuugcaucugaugaggucccugaaaaucugcccaugaaggcuuuuuguugacagcacuauuagcaguuagagcaagucccuucuugaagggcaaucuggauggcacauuauuguguucaccacagacaacccuuguuccacuauuagacuuuacuucuucauauacauuuggggagcagcucuucugacauucugguugggucucauccuggaggaaaauuagaagaagaaggcuagugagaugaacuguggcccccacugcuauagcuggucucggaguugcaacugauauucacugucucucaccucuacuaucgauuguaacucugccuuaccuucaacugguaccucugauguucuugguaucuuaacugguuauaauacccuuuuuaggccaggguuguaacacuuguccauacauuuucagaauugguugaggggguguuaagagaucccugagaggaucaucugugugccaaacauacugcucucugcccccauuguguauuagcagcccugccucauccugaucauuaugguugauugcccuagccaaagaugaucacuccucuucuuauucccuagauauaaagagacaauaugaccaggcaguacuuguaguuauaguuuaaugacacucuuacuauguucguaggcaaaaguguuccuucuuugggcaccaagacuauuccggaagaaccuagaguuacagggaucccaagcacaaacugggagucaugauaagugaacccacuuucugcuuuuaccucuuguugccagacucauguguuuuuccuaugggagucacagcaucauauaaagccuuuuaauucagaauauauacugcaucuuggagaauagugcuuccuuuuuuuuuuuuuuuugcuuuuggagacggagucuugcucagucgcccaggcuggaguacaguggugugaucuuggcucacugcaacuucucccuccuggguugaagcaauucuccuaccucagcuucccgaguagcuaggacuacaggugcccaccaccaacccagcuaauuuuuuguauuuuaguagagacaggguuucacuguauugcccaggcuggucucgaacuccugagcuccggccugagccaccacacccgaucagugcaucauuuuaauagaguaugcccucugaacuggugcuucagcugugccuucaucaggguguuccagugcucuguuagucugccuaccucugguuggugugguuuaugauaugaccagugaaucccaugguuaccuccuuugcuguaaacugggugccuggguccuuuggugugauaugguauguggaguccugugccagaggaacaaacacugccucugaggaaaggcaaauccaucucaaauguuucuacuucuaucaaaguaaaauauucuuuuuucuaggguagaaagggcccaguguagucaacuugccaaccaugugauuagucuugaauggggcuauuuuaggggcuuagaguuggucucugucacuguuaggcuagauauuugguuucacaguagcuggaucagccuugguaaguaggaccccuugcaguuggggccauguugucuguacugugucugcuuuguucaugugcucagagugcuaaugccaagcaaagucauuuuuucuacuugguugcuuaguuccucuuucaugguauauguucucuggugcuaacauguuauacaaagaacuucauacuuugcauccaguuucauguaucugucugucuuagucagcucaggcuuccauaacaaaauuccauagacuggauggcuucaacaacagaaauuuauuucucaguguucugggggcugagaaguccaagaucaaagugccagcaagguaguuaucaugcugaggccucuucucuuagcuuguaggcaccaccgucucacuuugugcucacguaaucucuucuuugugcagagagagauuucuuuuuccuguaagaacauuaaucccauaaugagugccuguaccuugugaccucaucuaacacugauuaccuccccaaaggucccaucuccaaauaccaucacauugggaguuaagucuucaaccuaugaauuuugggaggacaguucuuucauuguauaguccauaugccucucuacuccagacuuucuuguccuuggucuuccaaucuuaacuuacuucucugauagcuaggcccuuugccauuuccuguguaagguggcaucucaugguaguuuugauuugcauuucccuaaauauuaguaauguugggcauuuuuuuuuuuuuuggaacagauucacucacucuguuacccaggcuggagugcaguagagugaucugggcucacugcaaccucugccucacgaguucaagugauucuccugccucagacucccaaagagcugggacuacaggcacucgccaccacaccgagcuaauuuuuguguuuuuaguagagacagggcuuugcuguguuugccauccuggucucgaacuccugaccucaagagaucugccugccucugccucccaaagugcugggauuacaggugugagccacugcgcccagccaguguuaggcaucuuuucaugugcuuauuggccauuuauauaucuuuggagaaacaucuguucaguccuuagcccauuuuugaauuggauuacuuguuuuuauuaaauuuuaggaguucuauguaguccagaauuuaaaauuuuucauuaagucugauuggucuauuuuuuucuuuuguugccugugcuuugguaucauauucaagaaaucauugccaaauccaguaucuagaagcuuuacccuguauuuucuucuaaggguuuuauaguuuuagguauuacaaguaagucuuugagacauuuuuaguuaauuuuuguuugguguuagguaaggaugcuuuugcauuugaauacccaguuuucccagcauuauuugcugaaaagacuguccuuucuguuuugaauguucuuggcacccuugucaaaaauuguuugaccaaauaugugaggguuuuuuuucuaggcuuucuauucuguucacuuguucuguaugucugucuuuaugccaguaccauauacugucuugaucaguguagcuuuguaguaaguuuugaaauuagaaggugugaguccugcugcucuguucuuuuucaagauuguuuugugcucuucgggguuugucuauuuuugaauaaaacaaagucauugggauauucacaaggauugaguugaaucuguagaucacuuuggguaguauugacguuguaacaauauuaagucuuccaguuuguaaacauaggauguguuuccauuuauuugugacuucuuugauuucuuucgaaguauuauaguuugcacuguacaagucuuuagccuccuuuguuaauucuuauuuuauuccuaaauacuuuguucuuuuuggugcuguuguaaauggaauuguuuuuauaauuuccuuuuuagauuguucauuguuaguauauagaaauggcaacuaauuuuucaguuuuucuuuuaucuaacuacauauuugugucuguuaaucaggcucucuucuugcucccugccuccgcuuuagccuucccagccuuugguaaccaccaaucuacucuuacuucuaugagaucaaauuuuuaaaauuccacauaugagugaggucauguggcauuugucuuucuauuccuggcuuauuuuacuuaauauaauguucuccugguucauccauauuuuugcaaaugacgggauuuccuucuuuuuaauggcugaguaguauucccuugugaauauaugcuguauuuucuuuauccauucauccauugauggacacuuagauugauuccauaucucagcuuuugugaauaaugcugcaguaaacaugguggugcagauaucucugacauacugauuucauuuccuuuggauauauauuuaguaguaugauugcuggaucauuaugguauuucuguuuuuaauuuuuucaggaaccgccauaacauuuuucguaauggcugugguaauuuacauucccaccaacagugugcaaggguucccuuuuucuccacauuuucaccaacacuuaucuuuugucuuuuugauaauagacauucuaauaggugugaggugauaccuuacugagguuuuaauuugcauuuccuugaugauuaaugguguugagcauuuuuucguauacuuguuggccauuuaugugucuucuuuugagaaaugucuguuucugcccuucacacauuuuuaaaauccagguuguuuucuuccuauugaguugaguuccuuauguauuuuagauaaaccccuuaucagauguauaguuuguagauauuuucuccuguucuguggguuguauguaaucauguuaauaaugcuauggaauuuggcuugcugauacuucguugaggauuucugcaugaauguuuauaaagggauauuagucuguaguuuccuuguacagucuuuguauggcuuucguguaucaggguaaugcuggccucauacagugaauuaggaaguguuuccucuuccucaguuuuuuggaaaaguuugagaaggcuugguguuaguuuuguaaaauguuuagcaaaauucaacagugaaggcaugaguuccagggcuuuucucuguugggagauuuuugauuacugauucaguccccuuacuggcuauagguguauucauauuaucuguuuuuucaggauuuagccuugguagauuuuguguuucuaggaguuuuucuauuucaucuagguuaucaaauucauugguauacaauuguuuguaaugcugucuuauaauccuuuuuguuucuauaaaauugguaguaaugucuucauuuucauuugugauuuuaguaauuugagccuucucccuuuuuuucuuagucuguuuagcuaaaggcuuuucaauuuuguugaucuuuucggaaaaccaacuucugguuucauuaauuuuuuuccuauuguuucuuuauucucuaauuuguuaauuucugcuccaguuuuuauuauuuccuuccuucuguuagcuuuggcuuuaguuuuucuuuuuuuucuuguuacuuaaguuuauacuucuuuuucuaauaacuuaaguuuuaaaguuguguugauuugagaucuuuauuuuuuaauauaaauguuucuaguugcaaauuuacuccuuagcacugccuucacuguguccuauguuuuuguauguuguguuuuuauuuucauucauaaguauuuuacaauuucccuuguaauuucuucuuugauccauuuacuuaaauccucugacagucacuuuauccagagggagaggagcuugcaaaaauggggaaggugcaacaagaaaggccaccagccucuuuaugccucuguggucugaagcagcaauuagcccucagagcagggaucucagauauuuggaggacaggguccuuuuuggacaugcuggccccuacaagcugugugcagguuguuccaggaauuuuuggacagcacucugccacagggcuagggugggaccuggguagcugcuauugugcuaagagcugaaauugaccaaaauuaccacauuuucuugucuaagccuuccccugggaagauauaagccuucacuagccuacagaguuccaaaauagaaagauucugcgagugcaguuguuaccuagauggagagacagauuuacuccaccaucuucccagaauccugucuguuuuauugauacacaaccaugcucauucauguguuguguauguuugcauuugcaccacaguggcagaguugaaugguuguaacagagacuguacggucugcaaaccuaaaauacuagcuaucuggucuuuuaagaaaaacauuguagaucucuacuuuauauucuuaaggguagcauuaauuuuugccauccugcaugauuagcuaccucaacuggacaggggcgacuuuaggauuuuuaccugggcuuccucauuauaauaguucuuauucuguagacccauaucagccccuaagugugucuauaccuguuaaacauuuguagacugcagaaaugaccacuagguaugcucauggacauauugguuugacucugccagaucuuggccaggaaucuauuacccagcccccauguguucucacucugacacgguccaugaugcuuugggucaaucaggugccagugccaacuagcaccguauauccaauagacuucaaaauauuugcauauuuuucuuuccuuaguguacuaaaguaaauggugguagcuccuuuugggagaaggaauaggagaauuauuauuguguauaggcauucccaagaagaagguaauaccuuaucuucuugagaaccuggccuuuucuucagucaauaacagggaauauaucauaguacauccuauaagacuuugguauaaacucuggagucucauuaccucucuugaccucauccacaauuauucuccccugcauucacucucuuuuagucacacuggccucuuuucauggauuguauaccaagaguguucccugugcuuagagucuaccucccgcagauggcuuauuacuuagcugcauacagaucuuugcucaaaauuuauuuucuuagaaaggccuugccuggugacuucuuucaaagauaaucucacucuggccaggccugguggcucaugccuguaaucucagcacuuugggaggcugaggcgggcggaucaucugagguugggaguuugagaccagccugaccaacauggagaaaccccguuucuacuaaaacuacaaaauuagccaagcauaguggugcaugccuauaaucccagcuacucaggaaggcugaggcaggagaauugcuugaacccaggagguggagguugaggugagccgagaucaugccacugcacuccagccugggcaacaagagcgaaacucagucucaaaaaaauaaauaaguaaaucaucaucaucaucaucaucccacucuuauccaucauucuguauccucuuucauuuucuucaugguucuucuugcuguaucauuuuuugugcucguuuaucugucacucuccuccacuagauccagaggagcagagauuuuucccuccuuuuuuuacuauuuccuggauauuuagaauagucucuagcacguaguagguccucaauuaauauuugcugaaugaaggaauacuauauuuucagguaauugaaaauauuuuguaugaaaaaauccuuaauuuuuugucaguaaauaccugcuauuuauaagucuuuaguguaugucauuuaauaaaaauauauuaaaauugaugaacaguauaacguguuuaauugaaaacuaugauuacuuaacacauaaaauuaauaacacauaagaacuaagauuauuaaguauacuaauguguaugccaagaaaaugauagggaaagggauaugauuacuauaugaaguuuuuuaauggaaguacuguagauuuuugaaagggcugacuacuuccuaauuucacaacuguaaauugaauugguauuaauagaaccuaccuuguagacuuacuacuuaccauaguacauauugaauaugauaaaguauguaaaauacuaggcaaugccuggcacauaguaaguacuuaaaaaauuuuagcugucaucaccauuucauuauauagggguauuucaugugauggucaaguuuucuaaaauuuuuaaguagcuuaguuucuaaaguucuaaguagcucuaaauauaaguucaucuugagucaauauuucucaauuuuagaugacguuaaaaaucuuuagauucgcauccacucuuguuucgacagaagugaggcagacuagaggcugauuaucuaaauauguugcuaaaugaguucauuguauuucaggguggcauauuuuuuacuuugaaggauauuaauucauccuugggacuuaauucucaaacaugucagcacuuuauaucuuuaaagguuuaagaaaaaacuuugcagauauaaaaguucaaauuguaaucaccaacuaguuuaaguuacaugcuagguaggaggcaauaugugguauccauuuacaugaaagaggguaguaugaaaaguauguaaauuaguguguauuagucuaaaaaauguauuaucuguugauggugaacauuugaaauuuuauuuucuugauugagccuucucuaauauccuuuuuuaaacaauuuuuuuuuaagaaaauuaaaagauuuuguauccugcuuuuuucaucagcuaucauauguuagacuuuuuucucauuucuaaacuuuuuacauuaucaugauuuuaaaaggaacauuguuuuucauccuguaaguuuacccuaauuugucaacuauggcuuugugaauauuuauguaaacaauuucuuaguaauauacauaaugcucaaugaacauucugcagagauuuuugcauucauauaugcuuuucccuuagauuuuaaaaauggaauuacuguuaggguauacgagcauuuguaacacacugauguuaccuaauacuuacccgcuggccuccaaaaagauuguaccuguugacauuucuaacaauacugagaguauaaauuucaguuuauccuuucuugccuugcucauuauaauuaaaaaaaaaaaaaacuuugugagauuuuuaaaaaaggauaauuugaucuuauuugauuacuaguaaggcuguacauuaaaaauaauuuuuuugaccauuuuauuucuucuacaaauuacuuguuuguuuacuuugcucauuuuucuguugaguuguuccaguuggucauuaauacuguucuaguauuuuaauauccuaauuuucauuaaguaauuuguuuuguuuauugaagauuuuuuaauugaaaaaaucuguacauuuuaauaauauagauguauuuaaacaauuaguaauuucauuuuaaguuuuuaccuaguagaagcuguuuuaauuuuauaaguaauauuaaguacuuguauaugaaacuuuguuaaagcguauuuuuuuguaaacuaggagccuuuuguggcagaugaauauauugaacgucuuguauggagaaccccaggaggaggcucuagagguggaccugaagcuuuugauccuaaaaggugaaauaaaaaaauuuuuuuccccacagaucuaaucugguacacauuaguguuagaauagagaugacuguugagauugcuuucagcauuccucuacaaggauuuuaguuaacauuuggccaauaaaagacaauacaacagagcauuaaaaguuugagauuuuuucuuugacguucuuuuaaagaagcaauuuaacugguaugcaggaaguaauuuuauugaguauaagaauuugacauuucuucuaaugagucauaaacuagaaaugauuauacuucuaaaauaaaaacauuaaauacauuguuuuaaauauauuuguaaauugggggaacaaagucacugaacucuggaauguauauuauuauuuuuauauaguacauuugccuucuugacuauuuuaaguaggcuauaaaguguauuucuauucuagggguuuauuggggauucugggugagguuuucauucaccucugagaugauccacgaaaaagucaauaguuaaagccuggcuauauuuucaaaugucauguuugcuuuaaagccauguggccuggacaaaacuaugaggaaguuaugaaauuacagaaagacuuuaucuuuugaugaagaaauuucuaacaagaugcuauagaaaaaauuaacaugaucauuucaagcucaaggaacucuucuuauuaagacuaugauuauaaguuaacuggucaguuccuaaggauuaauaauagguagauugauacauauucaaacuuuccucuguuagauuauuagaagaauuuguaaaucauauucaggaacuccagauaauggaugaaaggauucagaggaaaguagagaaacuagagcaacaaugucagaaagaagccaaggaauuugccaagaagguacaagagcugcagaaaagcaaucagguaaacguuuuguuaagaaauggguauuuuauauaggcuauaauaucuuuauuuucuuccaguuuuaagcucuuaaaaaagucuagucagaugauaguaacugucaagauuucuuucuacugcuuuagucccaugggguaaaauguuaaugaauuguuaucaaguacucuuggcauuggcuuuccacagaguguugguuuaggaucacaguacucuucuuaggauagagugguauccaguuuagugugguccuugauucuccucuaacaaugcgaacuuugaagaaugacacuucaguagaccccuaguuuuaggaacucuuuauuagcuuggauauuuagguagucauuugcuuucucuuuaaucguaaaacaaaguaauaugaaagcagcuauugucugaauuagguuuucccuugagaaaaccuggucugggaaguuucacaaaagucaugaggguaugcuccaaugagaauucuaguguaacuguaggaaaaacugccuugaucuguuuuggaguaaaaccaaaucacuagauugguccuggggcucagcaggccaaacuucuuagucacucuuagguccuagacuuaaucuggaaccucugaaucccauucacaggcugggccuuaucuggaauuugauuccccccuuuuuuuuuuaagacagaguuuuacucugucgcccaggcuggagugcagugguguguucuuggcucacugcaaccuccaccucccaaguucaagugauucuccugucucagccucccgaguagguaggauuacaugcacaugcuaccacacccagcuaauuuuuuuguauuuuuaguagagauuuugcuauguuggccagguuugucuugaacuccugaccucaggugauccgccugccucggccucccaaagugcuaggauuacaggugugagcuacugcuccuggccuugauuucccuuaguguaguuuggaauauuguuuagcuuugcugccucucagggaucauuaguucuuuaguguuagggauuagcaaacugauugcugcuaaaguuucaauuuuuuagauuccuuuucuuaaacauauguggcuaugagaaauaaggaagucaguaauuuaagauaaggaaugcauuuuuaagaguuaaggugacaguuucuaaauacuuuuaaugcaguuuucccuugguaauaauaauaauaguuaagcuaauaaacucugggacaagucugccugaguuugaguuucagcucugccgcuuaugaacuguguaaucucaagcaauuuaaccuuuucauggcucagguuuuuuuuuaaucuguaaaguguguuguugagagaauuauauaaguaaauacauguaauaugcuuagaacagugucuagucuagcacagagaaaguccuuaauaaauguuuacagcucuuccccaccucaguuuaagguuggaaaaacgucccacacuagauuaucagcaauuccacuguuggcaauuacaaggcauucauugcauucaauuuccauaugccacaggacaaucaguguacccugggagaagggaaagaauauucuagaaaguaauauaccuuugccuuaguagaauaauugcuacuuuucuguuuucaaaacugggaaagaacuauuuuacuuuauauauaaacaucacuuuuuaaauauuuaaaauaaauugguauauuuuaccacugacuuuuuuuuuuuuuuuuugaggcagaguuuuacucuguuaccuaggcuggacugcaguggugcaaucucagcucacugcaaccucugccuccugaguucaagcgauucuccugccucagccucccagcuagcugggguugcagggcccaccaccaaacccagcuaauauuuguauuuuuaguagagauuggguuuuaccauguuguccaggcuggucuugaacuccugaccucaagugaucugccucccucggccuccuacugacauauuuuuuauucuuuucaguuuaguagcaagagagcucuuuagaugucugguccuuuucauacuuagcuaauuguuuucagaaucaucauuuggggcuaaaugguguugaguguuuuuuuaaaacaggaugaggaguaaacagcuuuuuuuguuugcuuuuuuguugauuaauguacucacgauaaauauuauuuuaauaguuaaugguauaaaaguuugcaguuugguuaacagauuuucagaucaugucacacuaaugagcaugaauuuuguagaucaucucguauauaacuucuguuaucuuuaguuaguagcaauaagaguaguaguuuagauuauaaacugagcacacugauuguauuuuaugcuuaugcacauuuuuccuagguugccuuccaacauuuccaagaacuagaugagcacauuagcuauguagcaacuaaagucugucaccuuggagaccaguuagaggggguaaacacacccagacaacgggcaguggaggcucagaaauugaugaaauacuuuaaugaguuucuagauggagaauugaaaucugauguuuuuacaaauucugaaaagguaagugcugucagaggauaaaaccaaaucacagcauuaauaacagugcccuaauuaugagcugcaauaauugcuuuccagaguuagacuucaaaucacugaguagcugacuuauuaaaaguuuuuauuguucugaaauguaaacuaauacaguuucuuguagauugcugaugaaguguuaauauugagauguuuaauuggguuuccuggcauuuuuuuaaugaaauuuuuuguggcuuaaaaaugcugugguagcuguguucauaaauaucucuuuaccauagauuucuuucaauauuaacagaauuucuauaguuuuuaaauagugacaguccauugggugguggugggguggucugaccuaaaucauugauaagcugagaugcuuuucuguaaagcaauaaggaauucagaacuucugguuuuuauuacuugaauaaagaucucuuauaaagaauuaaagcaguuuggaccaaggagagcugaaaaaaauucugaauuaauuguuuauguuaauccuuuucauagcacuagucacuuacuccuggucuaaggguacaugguauuggcugcucuacaaucuugaaagaagguaauuuagcucacuuucuuccccucaggggaaaaaaaaucaaaaugugcaagaaaauggacauucuuauggaucuuguauguacauagcaacauuguccacucauauugaauacagucuuccugaauuauuccagauuuacuccauagaauauuucagauaguggaauguaaaagcuaaguauuauugacacucacuuugaauuaagcaacacuuuuuuuuaauagaacucuauaggguuauagaauuuauaauuuuuagaguucuuuggaaaauaguuauguguguacagauaauuccucuaaagaaaagguguuuuugaaaaauuuaguuuuucaaguacaggugguuuuuugguuauaagaaugaguucuuuaguguuaaauucugagauuuuaguguaccugucacccaaacauuguacacuguauccaauauguagucuuguaccccuuauuccccucucaacuuccgccuuuagagcccccaaaguccauuauaucacuguguauguuuuuguguccucauagcuuagcucccgcuuauaaaugagagcauaugguauuugguuuuccauuccugaguaacuucauuuagaguaauggccucccgcucuauccaaguugcugcaaaagacauuauuuuguuccuuuuuguggcugaguaguuuuccaugguguaaacguaccauauuuaucuuuaucugcucguugguugaugggcacuuagguugguuccauaucuuugcaguugaauuaauuuuuggccuaguucuaccaguuagccauccuuaagaacucauauaguauuagauugccaauuauuagauaaacuccuagcugucucaauuucuggacucuguaccaaucaccuucccaauggaaagaaaaggaaaaagcacccacagagcuagaccagugugugauugugggaggaauuagaaugggauaagauaucaacacaucauauucuuuuccuucuuucccccuagucauuuuuguuuuuuuaauuguucuuuuuuggcaucuuggcugggugugguggcucaggccugcaaucccagcacuuuaggaggccaaggcaggaugauugcuugggcuuaggaguuugaaaccagcccgggcaacauggugaaaccgcaucucuaccaaaaaaaaaaaauuagcugaccguuguggcacauguccauagauccuagcacucaggaggcugaggcaggaggauugcuugagccccagagguugaggcugcagugagcugugacugccacacugcacuccagccugggugacagacagacccugucucaagaaaaaaaagaaucuucucauauucugaaaacaaaaacaaaaacaaaaaaaacccuauuauguguuuaccucuguccuuacacauauguugguuuuguuuuuuuuucuuuuuuuucuuuuuuuuuuuuuucagacggagucucgcucugucccccaggcuggagugcaguggcgcaaucucggcucacugcaaccuccgccuccuggguucaugccauucuccugccucagccuccugaguagcugggaccacaggcgccugccaccauacccggcuaauuuuuuguauuuuuaguagagaugggguuucaccauguuagccaggauggucuccaucuacugaccuugugauccgcccaccucggccucccaaagugcugggauuacaggcaugagccaccgcaccuggucuguuuuucuuuuuuaccuagaauggcagcuuauuguuccucauguggauaauacuugaugacugugauuaucuuuaacacuauuagcaaggguagucucucaccucacccaaaugucaauaacuauuagaauauaguuuugccagcuuuuguuacuuauuguuguaguauguuuuaacugacuaaauguuguauauuguaaccuuaagagauaucugugcuuuacacaauuuuuauaaaauaauuugcuauggaaauucaauauaaacaagugccauuuaccccuauacuaguuaguacauuaaacaaaguuugcaauagcacaaugaugaugaugacuucuuaaaagaacaaaaacuccuuauggaagcauagagcaggcugugugccaaguauauuauuucugaaguggguauuaaggggguauuggugaggagaaaaugauggauuuugcuaauacaacuaaauggcauggugaggacagauacugcagugauauuugugcccauauacaacaggacagagugaguguuugguaguugaaaaugauagugaccugcugacuaggagaaaagggaugacugaagcagaaaugcuauauucacuauaauuuggagcaagaagggagaagaggcucugcuguuguuauucacaguugcuugucagaguucacaugccuacuuagaaaaaucuauauugggcagggcguggugucucaagccuguaaucccagcacuuuggaaagccaagaugggcagaucacuugaggccagguguucaagaccagccuggcuaacauggcgaaaccccgucucuacuaaaaaaauaccaaaauuagcgggugugguggugcaugccuauaaucccagcuacuugggaggcugaggcaugagcauugcuugaacccaggagguggagauuguagugagccaagaucaugccaccgcacuccagucugagugaccgagcaagacucugucucaaaaaaaagagaaaauaaaaaaaaucuauauugauguucuuagcucuuccuucguauuuaugagucucacuguuuuuucaaauguaaaagaaaaugaaucuucauaaaaugaauuauuaaaauugugccaaaguaaaacugagaacuaguuugagauuuaaagaauaaaugaacauuguaaacuccccugaacuguuguguaaauaagcacagauaucugcauuaaagaauuuuagaacucuugccuaaguuccuuaguuccacaacuugaauaaauuuacacauuucuggcugggcucgguggcucacgccuguaaucccagcacuuugggaggccgaggugggcggaucaccuaaggucaggaguucaagaccagccugaccaauauaaagaaaccccgugucuacuaaaaauacaaaaauuagccgggcaugguggcaugcgccuguaaucccagcuacucgggaggcugagacaggagaaucacuugaacccaggaggcggagguugcagugagcagauaucgcgccauugcacuccagccuuaagagauaucugugcuuuacacacaagagauaucuaggccacaagauaucuguggccuuaagagauaucugggccacaagagugaaacucugucucaaaaaaaaaaaaaaagacagaaagaaaagaaauauacacauuucuauauuauauuucaucauggggcuuuacauuaaacuuuauauuuucuuuuagaacaaguguuauaaauucauaugaucaguaaugacaggcauuuaacuuacaguaggauauauguggcaguaugcucuaaauuauuuuuauaaaucucguuuauccuuuucggguucauaaacuuagaauucugagauuuacaccuggcuuucagcaagcaaugauuuaaauuucuuuggaauaaacuugaacuacagguuucauugggaagggauuguggcaucaaaaaaaucacagaauuucaguaccagaaagcuaaauguuuauguuauuauugacucauuauugguaacaccccaaauguauucuuguugcucauaaaguuuuauuuguuguggauuuuuaaaggaaauuuuuuuagggaagggacugugggcacaugcagggagauauuacuaauuucagauauauaauuauuuuuugauaugccuaaaaguuuuuuaaauuauugcuuuuauuuauuuuuucauagauaaaggaagcagcagacaucauucagaaguugcaccuaauugcccaagaguuaccuuuugauaggcaaguucauuucucaagagcuaauuugaauaugugguauaauuuauaaaauaaaauaguaucuuuuccuguaugauuuucuuugcccauuaauuaaacggaaauuuauugagcacuugcugguucauuuacuugcuaguuuauucacuuuguacaagaugcaguguaaaauaguuuauugaaaaaauacagucucuucuuaauaucuaaauuuaaugauaggccuugaaauaauuucagucccugucuccugaaaaaaaauuugaugaaggagaauuuugaaaucgacugagguuaaauuuggauuuucauacuuuggacuuugagaaccagguaggggauagagagaacacuuuuccuauuuccugaugaagguucuuaggcuuuuggaggccuuggacaccuuugaaaagcugaugaacgcuaucaccuuucuucaggaaauuaagauacacacagauuauuguauacaauuucauggaguuuuagacucuagccuauccacagaacucuuccuagggacuucagguuaagaaccccuuuuuuuuaaaaugcaaggccccagagccauuacuaaguuagauuucauccuaaaauaaacuauccacugagaaggaaauuuuuucaugauuucuucuaguguauggaaugucagacucuuuaauaaacuguugguaaaauaguacuuccuccaugugaauauuugaaagaaauaugauuuaauauauuauaaaugauacauaguaauagacauauaauauguuauuuuuguucauacuugaagaucuucaggaacagguaaaauauggauauauugcuauacuuagcuuaaccauuaucucccaaacauguaaugaauucccccuaaaaauguaucuauuuuauucucaacucugauuaucaugaagaauuagcaauaaugaucaucuaucauucuuaauaauaaucugguaguugcccagcauuaugauuuaacuuacuguaauacuuuuuaaagucacccaccaaaacuucucuuuaacuuuaugucauuucagaauuggacuauuuacuuaaauggguaaaaugucuagcucaaaauaggcucauaauaauuauugacugcaucccccuacccugucuucauccuauuuuuccacuccagaacacacaugcauauauacauauauauaugaauaugaauauguguguguguguguguguguguguguguguguguauauauauauauauauauauauauaugucuaauuaggauauauauucaacuccaaggcuuggugaagaggccaaaacaaaaccauaagagaaguauguaccugagugguggugaauaugaguguguguguguguguguguguguguguguguauauauauguggaguugaauauauauccuaaauagauucaauuuuuucacacagauuaauauggccuuauaugugaucugaucuacugugacuuugauacaucauuuuuguauaacacucuagauuuuuguuuccuucuucauuugucuuuggcaucucuuuugccagccacucuccucucucuucaaacaauugcacacaaucuuaaaauauuucuuuuucaugcuaugcauuucacuuagauauuugagauuugaaaaaauucuacugcgugguauuuuaguuuuuuaauuuguaaagauugaauggcuacucugcuaggcacauugcugggucuuaucauuugucauuaauauaucaucauauaauauauuauuugaucaucuuuuucuuuugaauaauaaugauggaacuuuauuuuuaaaaauaccaaccaugggaauggggagggagacaaauaaucaaguguauuuaaaaugccagcaaauaaaaguaagaacaguaagucaguuuugggacuggcuggguuguuagugucuuaugcagagcaguugauucuuuaaaaagagaauugauuuucaaugugaauuuccuaaaugagaaccagcuaccuaccuacauuaaguuuuaucaccuggcaugcuuccuaucagaauucucuccucugauuuugucuuuuuucuuuuuacaauaaccuuuuaacuuuauaaugguuuuggauuuacagaaaaguugcaaagauaguacagaugguucucguaucuccugcacccaguuucccauuugguuagcaucuuacauugccauaggauguuuaucacaacuaacaaaccucaugguugguuuuugucuuucagauuuucagaaguuaaauccaaaauugcaaguaagugauguauuuauuuuaccuuuuuuuuaauaaguaaaaaaacuacuuguguaaaaauaaaacagcaaaaggagaaaaagcaggaacaaugucaucuuccuacccuaguaggcuacugcauagaagaucccugaguuugauuucucuucccucaaaacaaccauuaccaguuuuuuuggauauucuugcagaauaaucuauggauauacaagcauaagacauaaauucuauauauguguguguguacauauguauguguauguauagauauuuauauguacuucuauccucauuuauuuuuaaauaauugcuaccauacuauauaaauagcuuuauaccuugcauuuuuaauuuaauagugcauuuuggaaauccugugcuuuccauacaucuaucucugaauaagauucucucuuuuuuuuuuuaagauuauauaagcauuucaguaucuauuuaacuccuuacaugauuaguuugguucuugccagucuuggauuuuaguuuagguuagaucauucuagguuuuugaaaagaccacuaaauuugcagguucugugguagcuggggucacuauuuagaguaggccacugcauagaagauucaaagauucaucuauauucccaaaaagucuuagaauaaggaugacacagcuaguuagacuuccugggaauauuuuugaucacaauagauuggucugaaguucagguguucguuaagaaccauacuagccucaagaauauagugaauagggccggacauggugguucgcaccuguaaucccagcacuuugggaggccgaggcggguggaucaccugaggucaggaguucgagaccagcuuggccaacauagugaaaccccgucucuauuaaaaauacaaaaauuagcugggugugguaaugggugucuauaauccuagcuacucaggaggcugaggcaggagaaucgcuugaacccagcagguggagguugcagugagccgagaucgcgccacugcacuuugacugggugacacagagaaacucugucucgaaaaaaaaaaaaaaaagaaaaugaaaaaaauauaaauacugcauauuaucaggaugagauuugguguucagucaucaguccacuauuguucuagguagaggcaucagaacucuaguaaagaguucuguaguccucuucacccuuuccauguguaggauuuuucauguguguugcuaucagaaauagcaucuggaggauuuuuuccagucagcuacugguuuaaguaacaauggcauaugacagucagacccuggaaagcucaguaauuuugccaguuuggaaguuuuuugucuugaaaauauagauuuauaugccacaguauauuacaggggcuggguucacggccuauaaucucauuuguuuuuguaauuccuucaaaagaaagcuauauucauagucauuauauuuguaaauaauguagauacucuuaaauaacguggaugccuuguaugccucaguguagcugaaugacuuuauuuuuagguaaauaccaugauuuagaaugccagcugauucaggaguuuaccagugcucaaagaagaggugaaaucuccagaaugagagaaguagcagcaguuuuacuucauuuuaagguaaauaguaggaauuaaaaaugaauaguguucaaggcuauggaaauuacguaaguucuauauauuauagucucugauuucccccauucauuauguaacuaucacagugauaauuuucacuguuuugaguaauuuguacauuugauacucuguaaaugguauugaauguuauauauuuaauauuuaagguuuuauauucaauaauauuaauauugaauuaaaauuaauugaucaauuaaauauugaugaauuuuuauacuuugauaaagaaaaucauauugucugccuuuuugcuuccacauauuauaauauaggugaaaagaaagaaaacgugaccguaaauaucuguaggauauaggaaccagagaguagauggaacaugacuaguaagagacuuaaauccaggggaccucaggagguaauacaaaagaauuuuguauuacggaauuguuuaccuagaauuugaacucgggagagaaucccuguguaggaguauauuucugcaaagaaagugcuuaaagaaaugguucuuccuucaaucuguuucuuugauuuguaucagauuagggaaggggaagcuauuuguuggacuuuucauuuugguaaaaucugaaugaguauugagaauggcucuugagacaguagugcacuuuauauugcuuuccuuacugguuuuuauguaugauuuauuaauaggcaaaaaucucauuauggugagcuuaaugacaaaucaguuuguuuuaaacacauuuuauuaaaauacauuuaguuuaaaaaguaaauuuccaaacuaccagcugaauacaacuguccagauucuugcaaggaaaaccaaaugcuagagaaggccaggcgcaauggcucacuccuguaauccuaguauuuugggaggccgaggcggguggaucaguuuagcucaggaguucgagaucagcuuaggcaacauggugagacccugucucuacagaaaauacaaaaauuagccggaggggaggcaugugccuguagucccagcuacucgggaggcuacagcaggaggaucgcaugagccugggaggcagagguuguaguuagccaagaugacaccauugcauuccagccugggugacaggagugaaauccugucucaaaaaaaaaaaaagaaauauauauauacacauauauauauauauacacacacacacacacacacacacacacguauauauacacacuuuaauauauauaaauauauuuauauguauauaaaacacauacauauauauauguaaaaccuuuucccaagaccuugacucucuguguauguguguguuuguguguaugugugugggugggugugaguggguguguuuuggaguugaaggagauggcuagaugaucauaggacaaaaauuacucuaaagaacucaguuacauacuucaucuuucuuguuuuagucuaaaguucaacaaggauauguaccaacugauaaauuuuaucauagaaagugacuagggagacgauaccuuuaucaaguuacugguuuucugcaguuaauuuuauuuaaguccaacagguguugcuauuggccauuuacugguaaauagucauagcuuuaugacauauaacacuucuuuuuuugaaauaauaauuauuauaauugaaucagaauaauaacaauguguuucuuccuuguaggguuauucccauuguguugauguuuauauaaagcagugccaggagguaacauaacaguacacuuuguuggauauuauuuuaugcuaauuguuguuuuaaaaucauguagaaauuauauguucacuguauaaaaugucucugcuguuuagggugcuuauuugagaaaugauauauuugaagacgcuggaauacucugucaaagagugaacaaacaaguuggagauaucuucaguaauccagaaacaguccuggcuaaacuuauucaaaauguauuugaaaucaaacuacagguaauuuuaaauaguaacaaauuaaauaguucuuaaagcaauauguaauuuuuucccuauauuuuaaaaguauuuuuaaaauuuaguuuacuuauguaaugaccuuagaaauaguaaucuaguuaaggagaaaggaauccucaugcuuuuuaaaaaauguuuuguauucaccaagaagaaagugcuaaucaauaaguaucaucagagaacaugcuugaaauuuguguaguauucguaguaguaguauaauauauugugguaagauagccuugaagauuuuucuuuuuuuuuggucccugccuucaccaauagaugucauuugugaaacugaacaagaauuacaagagcagucuguagaauuuuuaauaauaugguacuaaccugaaaagggaaaacacagaaauuuaauuuacccccauaucacuguacuuucagauaacauuuccuaagcuguuuacaacuggauuaaacaacauucaauaaauguuugcuuuuuuuuuuuuuuaacacaauucaggaauuuugauaguauugucauucucuagaaguggggauguaauguacagcauuucacacauuuacugucuaagaaacccuguuuuggaguaaugccuauagacaucugaaggaacacuaguguuaccuggaacucaguuugggagaugcugccuuaaggaauugacucuauuguuuguacucucaguuuuguuuuuuugaugcaccucacagagcagaauaggccaauuuaacagaaaagguauuauuccuaagacugauaaagauccucuacagguaaauaugagaagugguaaaauguaaaaaccuguuuuaaaauauuuuaugauugguuuguuuucuguaauugccuuuuugauuggauuguaagucagaaagguucaaaacuguggagugaauuuuaaaagaaaaauaucuugagaaguuguagaauuuaauauuuaccuaauuaacagaauguuaaccuuuuucuuuuagaguuuugugaaagagcaguuagaagaauguaggaaguccgaugcagagcaauaucucaaaaaucucuaugaucuguauacaagguaaauuuuuaaugauuagaaaauaauagauaacagauuuuuuaaauuuuuuugauaaaaacaaggaaguauucagguauuuuugaauaaguuugucaccaguuuaccuuuuagcauuaaaugcuuagcuguauagacuaguuauauuguacaagacuguauuguacaacauucuuaauacauuaacgucaggaauuggauguuaugcuuuauuuuuucucuaagcauuaguguaauuacauuuaucugcagucaaaacuuuagaaacugcaaaaggaagugauguaaucuuaacaaaugacaauuucagcucuaaaucuucuguaggaauuugucuugugcuuuuguaaaugucaguguuacucuuagagauugucucagaagcuucauauggagucuugugggguuuuuuuuuuccuugacuuuucccaacccuauuacucuucuucagugucuucauuuugggagaagguuuuuccaaaguuaccguaaugaggaaguccaucucaacaacaacacuguuaugacccuaucuucagcaaugggaaauagaaaauuagagggaaaguccacaaggacaaaacaaaagagggugaacagacaguagaucuuucaguacucuguuuugggucccaugugaugaauggcauuagacauacuugaggccaaucugccacugucgccauuucuggacuaguuaauugccucacaaguucuuuuccuaggaauuuauaacaguucucaaaaccguaaaguuguucguaauauuucacuguauuuauauguaacccuguagaguugaucucugcaucauaaguacucucccagaguuuaagaaaugguggcuuaacauaagucaugaaagucacguuguaaaaauuuguauuccuuaauauuguuacuauaccuaaaauguauauuaaucuuuuucucccccuuuuucaugaaaagaaccaccaaucuuuccagcaagcugauggaguuuaauuuagguacugauaaacagacuuucuugucuaagcuuaucaaauccauuuucauuuccuauuuggagaacuauauugagguggagacuggauauuugaaaagcagaagugcuaugauccuacagcgcuauuaugauucgaaaaaccaucaaaagagauccauuggcacaggagggugaguauuuuuguuaaauacuucuguuaaaacugaagacauuaauaacuucauuauauuugggcaaauuaucaaauguugacuaucauuagaauuuucugugaagaguucuuuuaauccagauuguuauauuauugaucaaaucuuguucuuaaaccacauguugaaaugaccuaacauaacaugauugaaauguaagccgggcgugguaacucacuccuguaaucgcagcacuuugggaggccgagaugggcugaucaccugaggucuggaguucgagaccagccuggccaacguggugaaaccccaucucuacuaaaaacacaaaaauuagcugggcgugguggcagacaccuguaaucccagccauuaaggaggcugaagcaggagaaucacuugaaccugggagacggagguugcagugagccaagauuacgccacugcacuccagccugggcgacacagcaagacuccgugucaaaaaaaaaaaaaaaaguaaaguagauauuugucaauuaaaaaauaauguuuuaaaacuaucgagcagaacacuaguaauauaaaaaguuccauaguuucuuucauuuuuuuuuuucucgauagaauaaguuccagguuauugaccaggaaacgcaucuuuuuuuuguuacuguugcaggugugaaaaaaauagaaaauaguuuguaguuuaaguaccuugaauugaugaguuuuguucagagacuuuagcauaaaaaacuauuaaauuaauaccuuaaugccuacaauuauuuacagacuagaagaaaauaacuugcuccaagaauaguuggcaucuuagcuaccaggcuuuaacugccuggaacccagauucuaaaaagagacagaaugacauugguggacucaaaguccagaauccccacauguauauaucgaaaccaguuuucuuauuucccauuuuguuguguauuaaauaaugauuagagagaguuaaaauuaguaguaagagguaauaccugaaagguaguagcaaggaagggaagaggaaaacuaaugaauaauaggaauuuguguguguguuuguguguguguguguguguguuuacgguagucucaaguuacauauccuaagagcaaaaaaaguuuaaccuuccaaagauaccccauauaaguguuucaggugacccucaguaauuaagaauagcuaaauuauguuuaauauaucuucuuuaauaucaugaauaaaugugcauaaucuuaaaaugacuauauuuuaaaauuguuaaacuuuuaaagguuucuuuuuaaacaggacuauuucguuauuuagaaugccaaccuauuuggaauagcucacuuucuaaggaaacccagcaaguuuuacuauugagucagaauuguaaggcugaauuguaaagcaacuucagaaauuagaaguccaaaucuacucauuuaucagaugaaaaucuuccguuuagauaucagggcuaacuuuauuucacaaaacuaguuauuggaauuagaaauuaggucucuuggcuauugguccauuuuuguuguugauauauacuaaguuuggaaguacucaaaguugaaaucuaaguaaaauguuuucuuuuuuucauuugucuuuaugauguacuaguauucaagauuugaaggaaagaauuagacagcguaccaacuuaccacuugggccaaguaucgauacucauggggagacuuuucuaucccaagaaguggugguuaaucuuuuacaagaaaccaaacaagccuuugaaagaugucauaggguaagagugauuguaaauguauuuuacauauacaguuguuccuugauaucuguggggaauugauuccagaaccuccgaggauaccaaaaucguggaugcucaagucugcuauauaaaguguguaguauuugcauauauucuaugcacauccucauuuauacuuuaauuagucuguagauuacuuauaauuauuuauauauauuauuacauuaccuagugcaacguaaaucucuguaaauaguuguaacuuuaguguuuaggggaugaugacaguacauauucaguacagaugcaaccauucucuuuuuuuuucuugaauauuuuuugaucuguggcugguugaaucugcugaugcagaacccacagauacagaacuuacaguuagagagaacugacuauguaguuguauuuuaagucuuaccuuguuuuacuaagauauaaauuuacucugauuaggaacaacuauuuuuuguaauaaaagauaggauuuuuauuuuggagaacagaauaauuuuaaaauuaggaauaaaugugaauauaacuuuaaauuaaaguugagcagaucaaauuuuuguuauguaggauuaaaugaagaugugaaagggacaguuagacuuuucucaugaagaaauggugcaucagggaaagaacaauguuuuaagagcaucaacaucaaagggaaagagugaagauuuggcuccauuaaaacuuagauuuuccucucuaauaaacacaguuuagcaaaauaaacagauaagucagagugauaaaguauuuguaaaugauacuacuagcaaaagauuguaugaaacaaauaauaguagcuaauaauuuuauaguacauaauauguuccagacacuccuuuuuuuuuuuuuuuuuuauacuuuaaguucugggauacgugugcagagcaugcagguuuguuacauagguauacacgugccauggugguuugcugcacccaucaacuccucaucuacauuagguauuucuccuaaugcuauuccucccuuagucccccacccccccaacaggccccacugugugauguuccccucccuguguccauguguucucauuguucaacucccacuuaaugagugagaacaugugguguuugauuuucucuuccugugcuaguuugcugagaauaaugguuucuagcuucaucugugucccugcaaaggacaugaacucauccuuuuugauggcugcauaguauuccauggcauauaugugccacauuuucuuuauccagucuaucauugaugggcauuuggguugguuccaagucuuugcuaucgugaauagugcugcaguaaacauacgugugcaugugucuuaauaguagaaugauuuguaauccuuuggguauauaccccaguaaugagauugcugggucaaaugguaauucugguucuagauccuugaggaaucaucacacugucuuccacaaugguuguacuaguuuacacucccaccagcaguguagaagcauuccuauuucuccacauccucuccagcauuuguuguuuccugacuguuuaaugauugccauucuaacuggcgugagaugguaucucauugugguuuugauuugcauuucucucaugaccagugaugaugagcuuuuuuucauguuuguuaacugcauaaaugucuucuuuugagaagugccacucuucuaagcauuuuaaguguguguguguguguguguguguauguauauauaucuuguuuguauguaguuuacauacguguguguguguguguguguguguguguguauauauauauguauguaaacuuauuucaucauauaaccacccugugagguuguuaguuugcaaauaaagaacugagauacuuggcuuuuagguaguggauugagaguugaggcagucuuaauuauuuauguugauguauauaaucuguauuuauauugagacaguaaauuauacaugugaauauaaaucaauagaaaacaagucaaagaauacgcauacgcaguuuacaaaaagaaaauguaaaucacuaguacaauacucagucucacuaauagggaaaugcaacuuauucauuagguugggauaaauuaagaagucugaugaccaaguguuguuaaggaaguggagcaauaagcaguugucacacaccgccaaugggagugaaauugguaccguuauuuugaggauuaauuuggcaguuucuuagagaaacucauagguucaugugauauguauaacaucauaacagcauuuuuuucauggugaaaaauuaaaagcaaacucucaguguccaugaaaaagagaauuguuaaacugguguuuuucauacaguagaaaacuauacaacaauuuaaaugagugaaguagaguuacaugugucaacaugaauaaaucugaaaaauacuuaguauugauaugacugaaucauaugguuuuuuuuuaggaagcugccaaacuaauaguguguagugauauuugauuauaguuuuaguuuucauuuuccuaaugcagugaugauucauguugagcaucuuuucaugugcuuauuugccgucaauauauacucucuggugaaguguuuguucagaucuuuugugcauuuuuaaaucaaucguguguuuuauuuuuggagcacucuauauuguuacaauuuaucagauaugauuugcacauuuuuuuucugccuguggcuuaucuuuuuauucucaucaguauuucuaaggauagcuguucuuaauuuugaugacauccaauuuaauaauacuuuucuguucuggauggugauuuuggugucauauauaagaagucuuugccuaaccaaagguuacaaaguuuuccuccuauguuuucuucuuuuauaguuugaggcuuuauguuaagauguauaaucaauuuugaguuaaguuauacaguauuguggaucaaaguucauaauuuuacaauuaggcauccaguuguuucaguuucauuuauugaaaagacuauccuuuccgcacugaauuacuguagaaccuuugucaaaaaucaauggaccauuuauaugugggucuguuucuggacucuuguguuccauuggucugucuuuaugccuguacuguacugucuugauugcuguaacuuuauaauaagucuugaaucggguaguguaaguccuaaguccucuaacauuuuuauauaaaucauuuuguauuaugucuuauaauagcuugucuguuucugaaaaagucugagauuuugauuggaauuacauugacucuguaguucuauuuggggagaauucacauauuuugaugccauuauaagcauauguaaauggucuuuuuaagauuuauauuuaauuucuaguuuaacuuacuuagucuauagaaauacaguugauuucuauauauugcucuuauauccugugagaacggaaaauaaaucucuggacccccaaaucacuaagccaaagggaaaacucaaguugggaaaugcaucaggcaaaccugccucccauuuuauuccuaaguaagauaggaauuccuugugggccucaagaucuuuccccuaaaacaguuuuauugaauuucaccuuggcaauguaaauugauaacuuaucuucacaguugcaggacaaaggagagaacucaagucaucccucagcucaccugagagaaaugcguaucugauugcuuccucuguccuauuguuuauguaaaaauguagauucaccgagccagauuaaggcacaagugauuauuccucuacccaccucugacaugcaaauuguauauucagugaaaggguggucaaagacucaaaagaauacgacuguuugucucuuaucugccuguaaccuggaagcaccuucucaccccuucaaguugucccgccuuuccggacagaaccacuguacauaacaccuauugauugaugucucaugucucccuaaaauguguaaaaccaagcugugccccuaccaacuuaggugggcauguguuggcgggaccuccugagacugugucauaggaauguccuuaaccuuagcaaaauaaacuuuccaaauugauugagacuugucucagauacuuuuggguucagaccugcaaccuaacuaaacucacuuauuaguucuauuugccuuuuuuuuuuuuuuguagauuccacuggcuuuucuguguagauuaucauauuaucagcccauaaauacaguuuuacuuauuuuuuccaauauagaugucuuuuauuuguuauuuugccuuauuguacuggccagacuucuaguacagugcugaauagaagugaugagagugaacacuuugcauuauuucugaucuuaagaauaaauuauuuaaucguucaccauuaaguaugauacuaauuggguuuuucauagauguucuuuuucagauugagaaaauuauuuuauccuacuuagcugagugguuuuaugaggauuagauguuagauguuaugcaaaacuuuguuauucuguuaauaugguaaauuauagugauugauuuucaaauguuggccuugcauuucuucuuugauaaacuccaguuggucaucaauugaccuuugaccuuuugucauauuuauauauuguuggauuaaguuugcuaaacuuuuguaaagaauuuuaacaucuguguucaugagggauauuggccuuuuuuuuuuggagacggagucucacucugacgcccaggcuggagugcaguggcacgaucucggcucacugcaaccuccuccucuucaguccaagcgauucuccugccucagccucccaaguagcugggacuacaggcgcccaccaccaugcccggcugaguuuuguauuuuuaguagagacaggguuucgccauguuggccaggguggucuugaaccucugaccucaggugauccgcccgccucggcuucccaaagugcugagauuacaggugugagccaccacgcccagcuuuuuuuccuuuuuaugucuuugucugguuuuaguaucaggguaauguuggccucauaggauguguugggaaauauuuccaccaccccucucaauuuucuggaagaguuugaguagaauugguauucuuucuuucuuucuuugguaaaagucacaagugaagucauuugggccugaauuuuuuugugugugaggauuuuaaacuacaaauucaacuucuuuaguagauacagaacaauucagguuauccacuucuuuuuaaguccacuuugguaguuuguauguuuuaagcauuuguguaguucacauaaguuguugaauuuguuggaauaaaauuauauucaugauauuuucuuauccuuuuaauagcuguagaaugcguacagugaugucaccacuuuccuaauauuaguaauuuguguuauuuuuuuuucugaucaaucuggcuagagauuuauucauuuuacugauuuauuuccccccgaagaaccagcuuuugguuucauuaauuuuucccuguuguuuuucuguuuuguauucaucaauuucuacucuuuauuacuucuguuauucugcuuacuuggguuuuauccccaccccucaccccaaacccccuguuuuuuuaguuuucuaagguggaagcugaggucauugauuugagaacuuucuucuuuccuaaucuaaugcggguguuuugucuuacaaauuucccuguaaauacuacuuuagcugcauccccagaauuuuuguauguuguguuuuauuuuuauucaguucaaauccuuuuaauguugcuuuugauuuguucuggcccaaacgugauuuagaaauauguuauuuaguuuccaaauauuuaggaauuuauuagaugucuuucuguuacugauuuuaaauuugauuccguuguggucagagaauuuacuuuguaugaugugaacccauuuuaaauuuauuaagacuugugguuuuuuuagcccagaauaugguccaucuuuuuuguaugcacuugaaaaaaauauauauccugauguuguuggauggaguauuguauaaugucaguuaggcuuaguugauuauguuguucaagucuucuauauccuuaccaauuuuccaucugccucuucugucuauuauucauggauguuuggauguaaauaggaggaauguaagaauagcuugugaagaagguaagagcauuuuuugagcaucagugauuagaggaggagggugaauauuggaguagagagacugaugagggagggguaaagguuggguaguauuaauaagaccaggaaggaagcugaguaauaccaaaucaguauuuauaaucagugggaauucaaaggggguuauagaauuccuaucaacuucuaauuuaauacaucagauaauaaguauuaaccccaagaggacacaugaauuaagacuacaaauagguuugacagaagcagaaaucaauguauaaauaauauagaaagcaauuauaagaagucaggaguaauuuuuugacuguuaaaaaaggauuuuauuuucccagcauaacuaauaauuuuacuaaauagcuaguuuaacagcaacagcagcgccaaaaugaauauuguaagcucacuaugugcaaauacugugcuaaaaacacuuuaugcuuauuuucguauuuauucuuaccucaaggcuagaauguaaguacuguuaauacuauucccaucuuacaaaugaagaaauugaggcauggugggguuaaauaacaucucaaagguucacuuaaucaggaaaugguaaaaccauuauuugaaccaguuauauuuuauggugcaucuguuauuaauuucuccaucuuuacuccccaguaaaacaaagaauucuuuuuguucugaguuuuacuagacuguucuuugcucagucaguggcucucaaaccucuuuggcccacaguaagaaaugcauuuuacauguuagcccuguguauguauguauguguguguguauguguguguguguauacauauauauauauauauauguguguguguguguauauauauauguguguguauauaauauauggggguauauauauauauauauggggguauacauuuuaugaaaguauacuuggauuucacuaauggauugcaauccaaguuugaaaaacauuacucuaagucaggagaguuguagauaaauauggagcauuguaauuguguguguguguauuugugcaugcacacgcaguauggggggagcugugaguuauuuucauaccugaaacacugacuacauccuauaaaaaauugauugcuuaaaaaaaauuggcauuuucaaaagguagacuugaggagugauauuguuugauuuuuguuuuuaagcucucugauccuucugacuuaccaaggaaugccuucagaauuuuuaccauucuuguggaauuuuuauguauugagcauauugauuaugcuuuggaaacaggacuugcugguaaguauauuuguguuacacuuguguuaaauucuuuugauucugcuugguuaaacuauaugcauaauguuguuuugcuuauaaucaucucugugucucaaauucaguucggugcaaugaaguuugagcuuuuauaaugcaaggauuugccaggugcugaaagcuauacugaaugguucucucauauuguuuacauauggcauaauagaauaauaagcuacuuaagucacuacaauguaugacacaaugucuuacaaugcuguaaguuagaaaaugucgaggagcaaaaugaaggcgaaaacaauucugauuggggaauugaguaauguaaaauuuagaaagagaaguauuaaaaacuaagucuggaaaaaaauagauucaaauuaaaauucuuauuuugcuuuuggucuuuuggucuuaguaguuaguauugguagcauaauaaugaccugagucccgucucauuaauucaguugucuacuucaccuguucaauggucaucucaaacuuaacauauccaaaaugaaacucuuuaucuucccucuaaaccuguuccuuucccauucuucccuugucauuaaaaggcguuaccaauaugcgugauuauuguaugucaguuuuuuaaaaggcauuaccauuucccacuugcucaauccccaacaaaacccaggaguuccucaauuccuccuuuucagaaaucaauccugauagccaauccaucagcaaauccugucaguauacuuccaggcauaagucaaauucauguacucuucuccaucuucacugaugccacccuaauuuaaacaccauuaucucugucuacuuguaacuggucucccuguguacauucuugccucuccacauuacugacuucauuuaacagccaguuuaauuauuuccuuauuuaaaacucuguggugguuuccuauuacucuuaaggggaaaacaacagcaaacuguagagaagcaugacuuuuuaucuggccugguauguauugaucaucucucauugcauuucuucucacugcucagucacucugacccuuauuguuuuuccuugcuuagucucuuugcacuugguguuucccuauccccaaaauccuuuugccucagcuuuucucauggcuggcuuuucaaucaucugaucucaacuaagauguuaucuucucagagaggcauugcugaucaucacccuagcuaaaguagcccucuucucccagcccaguuauccuuauuaucuucucauugcauuaaauuuuuuauagcacuuaucacaaugaaauuuuuaucuguuaaugucugccaccacucaucagaauucauucauuuaacacaugcuuauuaaaugccuacuccuguacuuguggaguuuauauucuuauggagaagauagacaaaugauuagaaagugcaaugaagaaaaguaaaacugaguaagggacuaaaaaauuaaaaaaaguguguauauauaauaauuuugauaugcccuuauuuuuauuuuuauuuuugagacagaaucucgcucugucacccaggccagagugcaguggcauagucauggcucauggcaacuuugaacuccugggcucaagcaauacuccuaccucagccuccugaguagcuauaacuacaggugcaugccacugcaccuagcuaauuuuuucuuuuuuuguagaguuggggucuuacuuuguugccuagacuguuuuugaacucuuggcuccaagcgauccucccuccucagccucccaagaauuuuuuguuuugauuuaagcuauuuuccuaaagguuucuuuucccaguaacuuaugccgcugcuggacuguuugugugugccaguuuuucuguaauuauugaauauucuuuaaaaauuuuaauuucgugguuaaaaacuuacacuguagcugaguucugaugccuauaaagaaaaaaaguacaucaauauugccuuaauuuuuaugucuuucauuaauaacaaugauucauauuuucuacauauguauugauuuuguuuuuuucucuuguaaaguucauuuguuauucaagccuucaauuuucuuaccaguugguaaucuugucuuuuacuugcgggggcagggggggcggagggaaacaccuuuguuuuccauuauuaagagaaaaaaaaaaucauuguucuaaaaagaacucuaugugucaagccuguauuuucucauuagcuaugcauauuuucuuuagucucuuaagucuuuuacuuuuagcuagaaacauaaacaucuaggaccuuagaguucaucuguuauucuuuacaaaaaggaggaaauggaaauccagagaggucagcugacauuuugaggucagaauauggaguggcuugauucccuuuuuauuuuauucugaauaaauuccagaauaaaaucaggaauguaaucuguagauaggacauuuugaguauuuuugaggagauaguguagagcacaguaagugaaaugugucaguuuagggauauuacuauggcagcaguaucuaggauaaaagguaaagagacuugaaugaggaagaccaaugagaaaauuauucgaacuguuaucagagauaaagaggccugguuauaagaaauauguggagguguauucauggcucacgugaaucaugaaggcuaaguagauggugaacauugggcauaaaaauaacuuuggaugaguuuuacuaguauaaguuuaagcuugauuuuccucuucuguccacagaagucauuauugauguauuaaaauagcggugucauuuauuuuauguuacagauuaaaaaaccacauucuuuuuuucuguugccaagaugaauuucuucaaggaugauucuaacauauguaugcuuucugguuuuaggaauucccucuucagauucuaggaaugcaaaucuuuauuuuuuggacguugugcaacaggccaauacuauuuuucaucuuuuugacaaacaguuuaaugaucaccuuaugccacuaauaagguuagucaaauuaucugauuuucauugauauuucagugacuauuauagcauucuacauaaucuauauauauuuucauuaaauuuaaaaaguacauuuucacaaaaaaugucaaacuggacaagugaaaugaaauaaaaauauaaaaguucuuaggaaauaaaacauuagauauuguuucuucuugcauuucuguuuucucuuuccacuauauuauuaauuuugguguauuucaaaagauuuaaucugucacaaaccuaaaacugaaaucucaugugaaagaggaccuccagcuuagugaaacucagcaaauuugacaucuuuuaaaagauccgauagacaaaguccauguacccacuuguuauaauguaaagauacauacaaaaaauuuugugagauuaaugggacagauuuuaaugaggcauuagaguaagguuugguuuauaucuucauaucaauuuaugugaacuuauaaagcauuugagaauuaaauaagaugguguauaugugaacaugcuuuacagaauuaucuguuuaacacuauuauguaagaggaaaaauacucauauaaaauuuuuugacauuuuguuguaaacauugauaugccgagacuaguccagaaacagucucaaagauaacagucacuuguaaucccugaaucauacuuugaaaggaaauuuacuuuuuaagagcuguuaugccacaaagcagagaauucacacaauuauuaggguugccuauuucuuaauauuuugaauguuuugacauucugauagcauucagaaggcaaauaugguugucugguuuuuaaaaguacaacuggauuggcuguuacccuccaaauuuuauaguaugauuuacuguauucuuaaaacucuggugaugauagucuauaacuuuucuugguauuacacuagauauuuguuuauaaagaaaaccaaauaauuccaaaauuuuaaagucacauuuauauucuugagagaugucuccucagagaucaaaauaacaaauuuaagugguccucuuccuucccuuuuaaucgguuguuuuuagucuauuauaaugaauugggcauagugaaugcuaaauaauuacuuugcuucuuauaugcuucuuggauuuguuaacaauauuaauguguauauauggauauauuuauaaauguauauaauguaauacacauagguguaugaaaaacuuuuagaaaauauuagacuauuaauaugauucuuuuuccauuuuaaauauacaauagcucuucuccuaaguuaucugaaugccuucagaagaaaaaagaaauaauugaacaaauggagaugaaauuggauacuggcauugauaggcaaguuguugguuuugucucuugcauuuuuuuaaauuauaaaaacaccauauuauagcagcaugaaaauacuuuguagagaagaaaaauauuuaucuuaauuccaccauauugcuacauuugauuuuauuuuuacauauugccuucauccuuauuagaguguuguuuuuauuggauccugaaguuuuuuacuuuggacuaucuuggcauuuaacaugccuuccucacuaagcuuaaucauuucuagcuuuugauuuaaagugagaaauaugugacguuuuucaguugaacacuuagaggccauuguaggauuauugauuguccuaauugcaauguuacuguguuucaaggaauagggaggcccacggagaggcagagagacagggaaacagccauuaucuggaguagucagaacacacacuacauuugucaauuagguucacugucuuauauggguaugguaccccaaaacaauuaaaauaguaacaucaaagaucacugaucacagaucaccauaacagauuuagcaguaaugaaaaaguuugaaauauuguaaggauuaccaaaaugugacacagaaacacaaagugaacacaugcuguuggaaaaguggcacggauagacuugcguugccauaagccugcaacuuguaaaaaaacaaaacaaaccacaguaucugugaaacacagucaaacaaagcagaauaaaacaagguaugccuggauauucagaaaugggguuguuggaucauauaguagcucuguuuuuaaguuuuugaggaauuucuguacuuuuccuuaauggcuguaccaauuuacauccccaucaacaguguacaaauguccucuuuuaccugcauucuugacaacgcuuguuaucuauugccuuuuugaaaagagccauccuaacgggugugaagugauaacugauugcguuuuccugaugacuagugauguugagcaccuuuucauauaccuguuagccaucuguaugucuucuuucaaaaauuuuuauucagguucuuugccuuuaaucauuggaucauuuauuuuuuugcuauugaguuguuugaguuccuuauauguuuggaguguuaaacaccucugagauguaugguuuacaaauauuuccuuccauuucauaggcuguugaugguuuucuuugcugugcggaagcucuuuaguuugaugcagucucauuugucuuuguuucuguugccugugcuuuugaggccauauccaaaaggucauugccaacaucaaugucaagaaacuuuuuucuuacguuuucuucuacuaguuuuauaguugugggucuuauauuaaauuuaauccauuuugaguuggguuuuuuuguguagaguauaagauaagggugucauuucauuuuccuguguguagauauccaguuuuccagaaccauuuauagaggagacuauccuuucccuauuguguguucuuggcacccuuguuaaagagcaguugaccauaaauggauggauuuauuucugggcucuguauccuguuccauugggcuguguaucuguuuuuaugccaguaccauacugcauuaauuacuguagcuguaugauauauuuucuaaccaagaaguacgaugcuuccaguuuuguucuuucucaaaauugcuguggcuauucaggauuuuuucugguuccauaagaauuuuaguguuuuuuuuuuuucuauuucugugaaaaaugccuuuggaauuuugauugggaaugcauugaauugcuuugaguaguauggacagguuaacaauauucuuucaagcucuaaacacgggauauguuuccauuuacuuguuucuuuuggcaauguucuaugguuuucaguguauaagucuuuuacuuccuugguuaauuccuaaauauuuuauucuuuuucaugcuauuguaaaugggauuuuuuuucuuucuuuuuuggauaguuugcugauaauguauaaaaacaacugauuuuuguaugaugauuuucugucuugcaacuuuacugaauuuguuuauuaguucuauuuuuugauggagucuuuagaguuuucucuaucuaagaucauaucaucugcaaagagacaguuuuacuucuuucuuuccaauuuagaugucuuuuauuucuuuuucuugccuaacugcucuggcuaggacauccacuacuguguugaauagaaguagugagaguggacauccuuguucuuguuccugauguuagaggaaaagcuuugagcuuuucacuuugagcuuuucacacuuugauauuaguugugggcuugucauauaugaucuuuauuaucuuuagguauauuccuucaaaccuaauuuguuuguaagucuuugucaugaaagaguguugaauuuuaccagaagcguuuuuuuuuucacaucaucagacaauuaugugauuuuuauccuucauucuguuaauguggucugucacauuuauagaucugcauaugcugaaccauccuugaaucucagggauaaacucuguuugguuaugguguaugauccuuucagugugcuauugaauucaguuugcuauuuuuuuuuuuuacaucuuuauucaucagggauauuggccuguaauuuucuuuccuauauuguccuucucuggcuuugguaucacuguaaugcugucuuuguaaaaugaguuugaaaguguaaucaguucuuccauuguuugaaaaaguuugagaacgauugguguuaauucuucuucuucuuuuuuuuuuuugagacggagucucccucuguugcccaggcuggaguccaguggcacgaucuuggcucacugcaaccuccaccucccugguucaagcagcuccccugccucacccucccaaauagcuggaauuacaggcacacaccaccacacccugcuaauuuuuuuguauuuuuaguagagacaugguuuuacuguguuagccagacuggucuugaacuccugaccucaggcaguccacccgccucagccuccaaaagugcugggcuuacagguaugagucacugcgcccagccgauucuucucuucauguuggguagaauucacuaguaaggccaucugguccugggauuuuucugacuucagcaggaccucugucucuuaaucucuucaucuuaugccaaucuauuauccuuuuccuagcuuuauuucuuuaguuauugugcuuauaucacuugguccaucuuuugaauuacuuucuugaaauacccuaaaguacauuuccuucaaucacaacugucuuacagacccuaaccucugauagaugcagucucuuuuauucccauaacugguugacuccucacuguuggagaauaucacauaacauguacguuauugguaccacugcaaaucuaugcucucauuucucaguuggaucuuuaguaccgcuuauccauccuucugauuguccuuguacugugagacucaguguugcuccuaccuguuuuucccaaccuuggccauucuucauaaguucccuaucuccaccggcagcauucuguacacauucagcaccccaauccaaaaauccgaaauaaaaaugcuucaaaauuugaaacuugaaauuuuuugagugcugacauuacccuacaaguggaaaauuuuacaccugaccucaugugacagggcacagucaaaauacagaugcacagcacacgguuuauuugaguauccacaagggaaaaaagacccacccaacccucuucagcugugauaaauauuuucugugcauguccaaaucccccccuacaacaagcaugccuacaaagaauaauaaaauggcauguguguaggcuggacaugccaaugguagguggcucacaaugccccacgugcagccaagaccugugugugugcuuuuuuuucuccuuauucugugcucugugguauaaagauguuguggaaucucaaaaaggccuacagauaccccugagguuaacagugauaagaacaagaggaaacuuuauguuuaucuuuuuguuuguuuuuguuuuuugagguggagucucacugucucccaggcuggagugcauuggugugaucuuggcucucuucaacccaugccuccuggguucaagugauucuccugccucagccucccgaguagcugggacuacaggugcgcaccaccaugcccagcuaauuuuuuguauguuuaguggagacaggguuuugccauguuggccaggcuggucucaaacuccuggccucaagugauccacccaccucagccucccaaagugcugggauuacaggcgugaacuacugcacucagccuguuuaucuuuaaaaaaaaauuuuuuuuguggccaggcacaguggcucagucucgaacugagaccacccuggccaacauggugaaaccccaucucuacuaaaaauacaaaaauuggucgggcaugguggcaggagccuguaaucccagcuacucgggaggcugaggcaggggaguugcuugaaccuggcagucagagguugcagugagccaagaucacgccacugcacuccagacuggguaacaggagcagaacugugucucaaaaaaauaaauaaauauauaaaaauaaaaaaaaauuuguuuagagauaugaucuugcucugucacccaggcuggugugcaguggcgcaaucauaguucacugcaacuuugaacuccuggguucacacaguccucccaccucagcuucuugaguagcuaggaccacagcugcacaccaccauacccagccauuuuuuuuuuauauguagagauagggucucauuauguugcccaggcuguucuugaauuccugggcucaagugauccuccacuucagccucacaaagugcugggauuacaggugugagucaccaugccuagcagcacuuacguuuaucaaagcugcuggacaaacaggauggcgguguaagugugaaaugucuuacagaagaguaugguauuggaaugaccaccauauauuaccugaagaaacagaaggagaaacucugugcugaaagugaugaacagaaguuaaugaaaaauauaaaaacacugcauaaaguuaaaagugaaggucuugauuauguaucgaaagaguggaucuaucagcauugcaaugaauacauugcuacuuaaugguauggugaucaugaaacaagcaaagaucuaucaugaugaauugaaaauggaagggaaucguggcuguucaaugggccguuugccaaaaguuaagaacagacacagcguuauguuuuuaaagguuuguugugauaaagcaucugcuggucaugaagcagcagagaaauuccuuaaugaguuugccaggguuguugcugaugaaaaucuggugugagaauaagucuauaauguugaugaaacaccacuauguuggcauuacugccccaagaagacacugacaauacaggugauaagauggcuccuacagaaauugaggaugccaaggacagaguaacugugcuagagugugcuaaugcagcaggcauguauaaguguaagcuugcuguaauaggcuaaagcuugcaucuucauuguuucaaaggagggaauuucuuguuggguccaccguuaugcuaacaaaaaggcauggauaaccagggaugucuuuucugauugguuuuacaaacauuuuguacuaguggcuuacacauacugcagggaagcuggacuggauaacaacuacaagauuuuguuauuccuugacaacuguucgugucauacucuuucccaaugugacuuuauucagucuucugaccaagguuucuuuagaucaaugaagaguaaauauagaaacacuuucuugggugggcaugguggcucaggccuauaaucccaacacuuugggaggcugaggcaggaggaucacuugagcccgggaguuugggaccagccugaggcaacauagugagacccugucucuacacacaaaaaauuuaagaauuagacagguguucuggcaugugccuguagucccagcuacucaggaggcugagguagguggaucacuugagccugguagguccaggcugcagugagcaaucaucacacugcauuccagccuggugauggagugagacccugucucagaacacuuuuuuuuuggagacagagucuugccccaggcuggagugcagugaugccaucucagcucacugcaacuucaucuucccgggucaagcaauucuucugccucagccuccugaguagcugggacuacuggcacccaccaccauggcuggcuaauuuuuguauuuuuaguagagacgggguuucaccauguuggccagucuggucucgaacuccugcccucaagugauccucccaccucggccucuuagaacacuuucuugaacagcauacuagcaacggugaacagaggcaggaguauggaagguuuucaaaaugagcugagcaugaaagaugcuguauaugcuguugccagugcuuggaacacaguaacuaaagacaguuaugcaugccuggcacaaccucuggccuucaacuauguucagugaagaggaugaacaagguggugacuuugaagauuuccauauuucaagugagaaaaaagugacgucugacuucuuacauauacaaaaaauaauacauuuagaguccaucaguaaguuggaugaagugaauaucaaaagaauuuuuuaacaucagugagacuccaguugcucauucauggacugguagugaaauagccaaaaugguuccaaaucaaggugauugugauaauagugacaaggugacguugcuaacacugcagaaaaaaugccuauagauuacauggugaaaaugugcaauggacuuauuaaagguacagcaguguacauucauaacagaacaauaagucauaucaguuuacaaaaucaaacagagacuucuaagacaaaaaccauuauuaaugaggcagauaauuccagaggaaacuuuuaagaagccauccagcagaauaucuccucauccaaagagguccugcuuucuggucucucaauugcuucuguuguuucuugucaccuaaaaaaauaaaauauaggauagaguaaccuuuucaugaaagcacagcaugguagguggagacugaaaaccugcuacauuguuguuguuuaacaggcaaacagguauugugguuauguuacugugcuguuugguuaccuuaaauaucuuauuuuuucucuguaugaaugacaugucaucuuuuuuacuguuaaguacuuaugugugagugaguauaagaaaaugauugcuuauugguagcauauaaauucagagucaggagugaugguaaugccagacagccacggauuguccacaugggugucugagauagugacaucuuugcuuucugauggcucaaugaacauaaacguuucauguacaaaacuauuaaaauauuuuauaaaauuaccgucagucuacauguauaagauauauaugaaacauagaugaauuuuguguuuagaaugggucccguccccaagauaucuuauuauguauguacaaauauuccaaaaucugaaaaauuucaaaauccaaaacacuucuggucccaagaauuuugagaaagggauacucaacuuguauaugguuuugccuuugaaaauccuuaguuguuaaggaauuaaauuaaugacagacuucugagaucuuugaaucuugaaguauugcacaaagaauuuuugcccucuguuuugagcagacagauaauaaaaccaagagcucuuucauauuaagaccuagagcugacuuuuucuaauaucuaaaguuuaccaauaguaaaagaguuucauggugauaggaaauuaaauaacugauuuaauuuagcauaaauaauauaauuaaacauaaacauagaguaaguuagauggguuaaagaauguuguauucucaauucucuaggacauuaaauuguaugauuggacagaugaagcauauuuuggcugcagaacagaagaaaacagauuuuaagccagaagaugaaaacaauguuuugauucaauauacuaaugugaguaaaaucauucaguuuguuaauacuuuguuaacauuuucauugguguauccuacugugcccuagauuuuuuucuuuuauacuuaaagauuaaugagaaacuguauuuccucuuuagcuaagcugguauacauuccuguguaaugaguguagaaaaacuuuuauaggccuguguaaaagucugugcuuacguaagaaaacaaguggagaagauuaaaaauuccauggaugggaagaauguggauacaguuuugauggaacuuggaguacguuuucaucgacuuaucuaugagcaucuucaacaauauuccuacaguuguauggguggcauguuggccauuugugauguagccgaauauaggaagugugccaaagacuucaagguauguguacacaaaaacaucaaacuugcaaauaggcccaggagcauaagucagauuauuaaaaaucacuauuuacuuauaauuagugaaagguuuauaacuuuuguugauauuguaugagauagauuaucacauucuaccugaaacaguguuguuccaauuauuauuuuuuuuuauuuuaaauuuuaaauuuuuauuuauuuuuuuuccaaagaguuucaugauguugcccaggcuggucucuuacuccugggcucaagugaucugcugccucagcuucccaaagugcuggguuuacaggaaugagccaccacaucuggcccauauauuuaauauuaaacccauuuuugcuuuaugguguauuuucaguuccacagucuuugacuuauugacauccaugacuaauguuauauaugucacacauuaggaaaaaaauguugucuucauuuaugucccccugaauauuucuguaacauuuaaauuaugaaaaaugcuguauguuaauaacuaguuuuaguccucugaaguauauaugauuguuacuauugaagagaauugacacaugaaucuuuuugaaauauuauagcaaguuuauuuaacuacugaaaucuuuaaguuuuaaugcauugugaucuuuaaaaaauucuaauauguugaacuucacccacacuaguaagucccaccugacaguauguaaaaaguuacaagcuaauuguaaaacuggaaauuguuuuguuucaauguuacuuuuuuucuucucucaauucagauuccaaugguauuacaucuuuuugauacucugcaugcucuuugcaaucuucugguaguugccccagauaauuuaaagcaagucugcucaggagaacaacuugcuaaucuggacaagaauauacuucacuccuucguacaacuucgugcugauuauagaucugcccgccuugcucgacacuucagcugagauugaauuuacaaaggaauucagugucaguuccuuuacagaggaaugucuuauacuucagcagcccucgguugauagaaagcacaggagauaccuuaugacacagccaacauuuugugaaacaaugacuggaacaaaacagcagccauacuuaccuuugagguuuuauuuaaaguuuggauaccacuagcuauauuuugcuuuuuuccccucacauugaauuuuaauuccauucuugaauguagaaauuucagauucucuaaaacuacaugucacuguuuuuauccuagaaaauguugcugucagaaggcaaaggaaauguuaccaguguuuucgguucuuguacuuuuaacauauuccauuuagaaauuuugccauucuguuuuccauuaauaauaggugaaauacaggaaaacuacauuuguuauuccucaguuuuuaaugaccuuuucagcaucaauuguuaaucagauuauuuuagguuuucguaaauaauuuuuuugccucuuucaaaagguuaacaauuaagcauacuuucugcaguugguugauuggauuuuuuucugagguacagcauuaauacuaguccaaaaaaugucauaaacugaacuaaaaugaugaacuauuuuauguagacauuaggaguggaucggaauacuucugcuuucuggguaaaacuuaaaaguuuacuauuucuuauuugguaaauagauuuuaagccaauucuaguaagaaauuaauaaaacuaccuuauuuuguauuucacuuaagguggaggaccuuaacuaaaggaccauauuuauucauuauuuuaauauuauaagggaaguaaaaaaaagugagguauagucuaaauggugcauauaggaaauacugacaguguuuagcaacaugcagcccuuugagauuucugucguaaugcuaaacuugaauaagauggaauggcugaacaugugguuagucuuuuauuuuaagaagaauugagaauugauagauuuggagaugagcuuugcaaaggcuguuugcuuuucaugucuauaggucugucauuguccuuuuucaaagcauuucugaaguuauuccuacuuggauauaguuaauggaauuggcuuaauuugaugacauaauaaaucacuuauaaaauuuuaaauaucaagugaaaauuuagaaaggccauuacuauucuauaaaccuuauaaacuugcucugggagaaugcauucuaaauuauauauaguguuucagcucccauugugguguucauagucuucuaggaacagauaaacuuaaguauucaauucacucuuggcauuuuuucuuuaauauaggcuuuuuagccuauuuuuggaaaacugcuuuucuucugagaaccuuauucugaaugucaucaacuuuaccaaaccuucuaaguccagagcuaacuuaguacuguuuaaguuacuauugacugaauuuucuucauuuucuguuuaguccaguguuaccaagguaagcuggggaaugaaguauaccaacuucuuucagagcauuuuaggacauuauggcagcuuuagaaggcugucuuguuucuagccaagggagagccagcgcagguuuuggauacuagagaaagucauuugcuuguacuauugccauuuuagaaagcucugaugugaauucaaauuuuaccucuguuacuuaaagccaacaauuuuaaggcaguaguuuuacuggccauuuaagcucuuuguacagugucaauuuguaaaaaagaaaaaacgaaaaaaaaucucaaauaaaacaugagauaacauuuuaagacuuccaaaucagagaagugcuucaaauuauuuuguuuggauuaauuuuuaaaauguaaagcauauacuuguugcuuaguuauuuuguuuauuauuuucauguuugaguucugugcaauauuuucuauuauguccguugauaggacagugacaaaauucguaagugaauacuuaauuuaaaaguguuaacauuaaugcucaauaaacaaauucccugcaguuguuuuuuuuauuucacucuuuuuauauuuuagagccauccauccugaauuuuauaaaugauuuuuuauuuaaaaauuugagauuuuuaaaauuuuucacagcacaggucuucucauuuucuuuuuuagcaaaaaauacuugacuauauaaacaagacuagaaauuuauccuaaacagauggucuuucucugagggaaaaaaaaaaaugugucaugugaggcaauaugcauucuuuguauucugauuuuuuaaguguuuucauauuuauagccaucacaaaauuuugcccaaaguguauggcucagaagagaugaucaauaacuaaaauguuuuucguuuugcacaugguaaaauuuuagguagagaguggagcuuuguauaauugguaacuuuaaccaacauuuacguaaguacggucuuugcaguauuacacaauaccgcaugagcuaauaugcaguauuuagguaaugcauugaaugaaguugaaaauaugcucuuaacacacugugcauuguuuuucuaaaauugagaaauaucugaaauacagaauacgaauuuaauaaaggaagccuaccuuauguaaauuaugauguugaaaaugacagucaaccagaguagaugaaguguccuuaugaagaauuauuaaauaguagcuggauggaucuuuagauggaugaccaccugaccauuccaggacaauuuuuggucccauuuugaggauugccauaguugcaaguccuuaggaucuuccuuguuuuaaaaaacuaucaaaguagguuaaauuaaaaucuaauuuaaauuagguuaauuuauauuacauuguagaucauucuuuuuuccccccucuuucacuucuaaauauuuugcuuucuaaauacuagccuucugguucacagugaaauaauuuaauuaucaaucaguagauugauuccaaguggagaauucacugcuucccuaaaaugcguuuuucuuaccuguaauggugaauauuuacaaggaucuggauaaagagauuuugauuuuugaaaugccacaaaaccccuuaaaguggucaaguaccuaagguaguggcuaaggcaugcuugaacuguguuugagagacagcaguucagucaguacauaauuuguuggugacuaacaaagcucacaucugggagauuaacuuuuuuuaacgcaaaaauauucugcacauuacccauauauuguugaauuuuacauacaaagcauuuugugcuuucauucaauuaguuuaacuauauucaguuucuguauuauuucucucugaucuauccuguaauuauucuauacuuuagaagaaaagaucaguucauauuguuagacugaauaauucuacaugaaguuaaaaguuagcaauuuaaaaaauuuugcugcauaauaaagauaauuauaguuacauguauugauuuaagucucacacacugugcuaauaaguccuuugcacauauuauuggauucuagagcaacccuaggauuuggguacuauuauuuccauuugacagaugaaaaaccuaaugcauagaaagauaaguagaccagucaaggucuacagcuaguaaaaugcucagauugaaaccuaaaucuuuucucacucacuuuuagguucuauaugcuauucuccuuacguaacguuaaauagauccuuuaguuugauagguucauuaguuuugcuuaaucguugcuuccaauaugauucuuauuguaguauuuauauuacaaaguuggcauacagggucaauaucuaauuuacuguuguguuuuucuuaauauguucaauguauggucauacuuuuuaaauuugauuuuuuaaauauuauaaguggucaugaaauuuuaauguuaaguuuguaccuaauagaaauaugucuaucacaaaucuuuauugguauuauuuuauauacuuuuccagcuugauaauuuucacaauagaaagagaccaaauauuuuguacuauauuuugugacauagaaguaaaugacaacucuaccuuggaagauaugaagaaaucaguguuuuuauguucaaaaacuauuuuaaaugucauaggcuugccaauuguguuaacuauuuaguacauugguaguuuuuaaaugacuaaugcuggagugaaaauguaaggcaaaauauuuaguauauuaacaguagauagucauuuucauguaaucagaauugcauguuaaggguuuuaaaagcugucauaacucuuaccuuuuauuucuaccagugaucaaucauuucucuuuacaaauuuagggaggaaacaacuguucaaauguauaggggacagaaaccugacauuuagagaacagaaauuuuaauugccaaauuaaagcagcuaggcugccccugggcuuaacaaaauuccuauuuuugaacuagacccgagguauuuuaucauuauuauuugauagguaccauuaaccuuuguuuugugauuaucgacuuuuggggggaaagaugaguaauuaaacacacucgcccauuuucuaagugguuuagaagguugcagucugccucaccauacaaagccaguuuaaauaggaauauaucacaucauacuucacauagcagucaaccucagaggaaagucauuuauucagaaggcauagauuuugcuagacagcagugaugcauuacaaauauauaauuauuugcacuaauauuugagcagguggaauggauuagaacauggucaacaucaugcugcugauaacauguauuuuucuauauuaauauguacugugcaacauguauuaaaauugucaauaauucauuuuagccaagauacuaauauuuauauuacuguguuuaagagacaguauccaacugagccacuuuuaauuuaaaagucugaaacuggaauuaaguuuacuuucaaaaaucacuuaaauuacuuuauaaucagugaaaggucaguaaaauguagaauuauaagugccuagugacuuaauaggaggaaauauggaggguuaaggaaggaaguaggaaccuggaauaagaaagcuaaguuucauuuauaguuccaaugagugacuuucuuuguuuucaccacugggaaucuuaaaugaagaaagugucguaucccuuccaguuaucuuuauguuaauaaacuaagugaaguuuggauagaacuaacaaaggaauuagucuccauugguggacuuccagaguuuugagauuaaacuuugagaggugagaagccuuccugaugccccuguaaucuuaaauuggcaggugccucuaagugaggccaucccucuuugccugccuaucauuuuaaucuuuauacuguaacugguuccuuucaacucuggccuuuuauuguagcacuuuuaucaagucugcagcuucccagcuacuugggaggcugaggugggaagaacacuugaagcuaggaguucaagaccacucugggcaacauagugagucccuguuuuuagaaaaauaaauaaccuuuagguuuuugcuauagaaaauauccaaauagagucuggacaaugcuggauguaaagaaaacugugaagcuaccucuaagcauauuguuugugaauacuguguaccauuuagaggauaacaugggggauucacaugaaguuaugugaaaauauuuuauaaggaauaauaccuaagugccucucuuaaguucuccaguagaauguauuuucaauuuuugccacaagggggagaaguuauuuuuauaguaauauguacauuuuuuuauuuuaaaaauagaauucacacaacuuuacagcaucuaugaacauuuugcuaucccaauuaugugugugugugcauguguguaaacaagauucugaaagucuugcaugagaaaaauuucaaaggaaauuaauaacaaaaccaaaacaguuuugaagaacaugugcacaguggacacaggaauugaacaaaguuuaccaugauuaacauuauguuuucuuaguuauauaucacauugaauuccuuuaucaacucuaauaagaaucuacugauuaguguucuacauucugcuuuuuaaagaaaaauuuuugaaacaaucagacuuaacagaaggguuguaaauacuguacaaauaaaauuuuucccuuuugagaauaa

SEQ ID NO: 192485 - RNA, 21929 nt, Homo sapiens
uaaaguuagcuaaauuaucuuuauuuuuuuuuagaaacagggucucacucuguugcccaggcuggagugcaguggcaugaucuuagaucacuaaagccucagacuccugggcucaagugauccucccagccucaaccuccuaaguagcugggaucacaggugcgugacacuaugcguggcucaaauucuuuuuacuuugaaggcccugcuagaaacuugcugcugcucuaauucacgacuuggagagacaaaacuaaaaaagcuguugcuggguucaggugcugugggagaacccgcaaaaaauggucugaacugaaaaucuccaucuccaucgccccgauuucgaacagguguauuauccaaaggaaacuuggaguuguuaccuagggcagaaaaaaaggaaaaacauaauuuuauucauuuguuaucuauauaaucuacuucagaggaaucaucaaauauauauauaugaauauauauuuuuucuccaauauuugucuuagaaaaaaacagacauauaaaaucuuuuaccccagguuaagaauuuuuuuaaaaaaacauugcaauaaacauucuagaaaaaauauaacugaaauauuggcauauaccaugacccaauaucaauuagcauaggcuuaagacaagcagauaauagaucugauuaaauuaacauuuaacuacuuccacugaacccuuccuuggcuuuuacagguuuuaaaggaccaaauaacuaaaggaaaaugcugacuauauauccuucaagcuaacaguggcagcaggacauaaaaagguuaacuguguacaaaaagaggaaugggaaagaacuggugaauaugaaaaaaauaagacaaauguggacagugacaaaaaaauaaguauaucuauaaugcccauuuacaguaacucugauugacuaaauuacauuauauaaguaaaacugaaaguuaagcagaaauuuagguuuuuauucuuauaucugauauuccucaucucaucaccucaaaccugccccccaccuuuuuuuuuuguagagacagggucucacuauauugcccaggcuggucucaaacuccugggcucaagugauucucccaccucaaucucccaaagugcugggccgcaccugaccaccucauacuuuuuauaagacaucagcuccuccccuauuaaaucuuuuuccucagccuauaguaaauauccaaaaaugaguauuaggaaaguccagcacaagaggcuucacuuuuuuguaugccaaaaacaauuuccauuaauagcauagcaaaaaucuauuagauuuuguugcauaaagaguaguauaaaggagagagcucaggaagauaugagauucauuccgucugcaaggcaccuaacaagcagaaaagagauggcaucauacuagauugugauuuaaagaaagaacccuauuuggauaaccuuuauauccucauuaguuaggaucauaccuaacaagcugguacauaaaacauauuugcuaaauauuugauaaauggaaaaaugauuagacaaaagaacaaaacaaccaaacugacaacuuaagaacuguacaaucaguauuggcaggugaaaaaaauugaaacauggccuucuuggaggauagcaaaugguuaagaguauaggcucugaaaacagguuagugauauugaccaaauuacuuaacuuucugugccucagcuuucucaucuguauaaaagaaggauaauaauacuuacuucauaagguuuuguaaauuauaugaauuuauauaaaacacaacagugccuagcacuuaggaaucaauaaaugacagcuaauauuauuauuacuacaacuacauagcuuuuaacuuaauguagcaaugugcaaacuuucauuuugcagagauuaacugcucaaauuaaagcuuuaauuuaaauguaagcaaauacaauagauaaaagcaaugauguacagguugaaacaugggugaagaauucagagccuaccacaacucaaugcuugucuuauccuuaucgucucgacugaaugcuuggaagugggcagagcaguauaaaaaaucauugauuuaaagaacagacacuugauacauguccuuucuuaccuaaugggaagccaagaacaccagacugugcaaucauggaugguucaagggugccuucaugguuagcaauagugauguuucguagccuaaggcuaucauagaggccuuggagcuuuugauacugacgauugcgcuccauaaguuucucagagaugucacugaacuuuuucuuguauucuucuaguacuuucuucauggagguaaccuccccuuucauagaggucaauucuacauccuugcuuuguauuugcugaguauauaucuucuccaucuguuucagauggcccucagccuugcugaaauuguauucuugauagagacguuccugauguaccugguuccaaaagaaaaaagauuuuuaagguauuggguacaaaguuauauauuguaaaauguuauacaaacacaaaaggaaaagaaagaugcuuauauagggauguuauuuuaucauuuagaacccaguuuaagaagcaaucaggauacacaaugaggcacagaaaacaauaaguuauguuacuaaaugcauagaaaaaaagucuggaagaauacucucaaaccacuaacuuuauaccaccaaaagaacugaguauuugucuuaacaagugacauguuuuccaaagguuuuuaagaaauauaaucccauuuuucaaguaauccagagcaugaagaauagacucuaagacaaccacaaauuaucgucuccugguacauacacccuuguguaacucccuauccccuugcacgugggcaggaccugugacuagaauacuacagaaaaugugacagguugucacuucauaaguauauuaccuaagacuauaaggucugucuuacuaggagacacacucccuugcuggcuuugaggaagcaagcagucaugucaggaaggcccaagagacaaguaacuaagaacagccucuggccaauagccagcaaaaaauugaggacccaaugaaucuagacagaucuuauacuuuucacaaaaauaaacucaaaaugguucacagacuuaaacauaaaaugcaaaacuaugaaacucccagaagauaacauaggguaaaauccagguggaucuuggauuuggcagugacuuuuaaaauacaccaaagguauaauccgugaaagagaaaauugauaagcaggacuucauuaaacuuaaaaaucucugcucugugaaagacccuguaagagaauaaaaagacaagccacagaucaggagaguauauuugcaaaagauagcucugauaaaggaucaaagaauacuucaaacucaacaguaaggauaaaaagaacacuuaaaacucaacaauaagaaaacaauuuaaaaauagaccaagaacucggccgggcgcgguggcucaugccuguaaucccagcacuuugggaggcagaggugggcggaucaugaggucaggagaucgagaccauccuggcuaacacggugaaaccccgccucuacuaaaaauacaaaaaauuagccgggcgugguggcgggcgccuguagucccagcuacucgggaggcugaggcaggagaauggcgugaacccgggaggcagagcuugcagugagcugagaucgcgccacugcacuccagccuggacaacaaagcgagacuccgucucaaaaaaaaaaaaaaaaaaagaccaagaacuucauauacaccucaccaaaaaaaaaaaaaaaaaaaaaaaaaaaaggcaaaaaagcauaugaaaagaugcuccacaucauaugucaucagagacaugcaaauuaaaaugagacaccacuauacaccuauuaaaauggccaagacccagaacauggacaauaccaacuucuggcaaagauguggagcaacaggaauucucauucauugcugcuggcaauauaaaaugguauagccacuuuggaagacaauuuggcaguugcuuacaaaaauaaacauacucucaccacauaagccagcaaaaacacuauuugguauuuaaccaaaggaguugaaaaauagaggagcauguaagagaaacaacuuacccagaaaaauauaauaaaaaguuacuugacagaugacaaacauccuuaagaaguauaaguguauauguaagauauaacaauacauucaaggacaugcuuaaagucauccacagggaggucuuucaaaggaaauacuaaaaguagaaaucauaaagggaaaaaguuaaggaugcguauuugauaagaaugcuuaucauagcauuuuaauaacuuggaaauaaauuaugauacaauauaaccauuaaaauaugauuauagaauaguuaacuaaaaaauauuuaacaagauauucauaccaagugaagcacaggcuacucaggaggcugaggcgggagaauggcuugaacccaggaguuagagacuagccugggcaacacaagaaaaccccgucucaaaaggaagaaaaauucauaccagauauaauauacugucaacucuuaacaauaaaaguguguguguuaucuuacuuuuauacagaagagagagagagugugugaguguguguguguguauacccaaaauauaaacaaugguuaucucugagugauggaauuaugagugcuuuaauuuucuuccuuuugauuuucaacaauaaacaguauugcuuuugaaaacaauuuaauaaaaagaguuucucauauacucauaaaaaauuaauaauaauacaaugaaggaaagacacuagaaguucccacaaaugccauaaaucacaugcucaagagaaacuagacuaagcacuaaccugauauguccagaaggccagcgcucgggagcuaauguccaacacgaucucuggucgcaguccugccaauaccauagcuuuauauuccucugauggacugaguucugugcggacaauaucuagcuuuccagaaaggguacuguugcaggcaggacagauagcuggugagcgacuaaacucaccacugccaugcugaucacagaagaugugagagcaggcagugacccaugcauagccagagaguuugaugcgacacuuucgauaauuacaaagcagcaugucuucacacaaagacauaauaggauagugaggucuccagaagcugaagagaggccuaagaagggguaaauaaaaaggccaaguaaguuaaauugcaaugaaaauaaaaguaaaaaagaaauauaacaugcacguuuuuaucauaaaauacugcacauuuuauuauauuccuuguauuuauuauaauugauauauugauuucaguuacucaauaauauuaauugugcucguuuguccgguuuucuaaaaacgcuuuaaggacaaagguaaagacaaaggugguuacagaucuugcuaacgucaaaaauaauauauacgugggccaggcucaguggcucaagcguacaaucccagcacuuugggaagccaaggcaggcggggucccuucaggucaggaguuccagaccagccuggccaacauggugaaacccagucucuauuaaaaauacaaaaauuagccaggcguggugauucaagccucuaaucccagcuacucgggaggcugaggcaggagaaucacuugaauccgggaggcagagguugcagugaagugagaucgcaucacugcacuccagccugggggacagagcaagaaucucucucauaacauguauauauauaggcugggcgcgguggcucaccccuguauaauuccagcaccuuaggaggccaaggcgggcggaucacgaggucaggaguucgagaccagccuaacauggugaaaucccaucucuacuaaaaauacaaaaaauuagcugggugugguggcgggcgccuguagucccagcuacucaggaggcugaggcaggagacucguuugaacccgggaggcggagcuugcagugagccgggaucgcgccauugcacuccagccggcgacggacuccgucccagaaggaaaaaaaaaaaaguugccuuggcccuccaggucgauagaaaagaacacucgcacaccuuuaucccaauagccccgcugagugaguuuccucagguaugucaccuggcagccacaguuaagauuaagaggccuauuuuacauccggcagaguagggggcagcgggaaagcagaggagcugggaagcuuuaaagcugagcccucucucacgcagcagaggcgcagcuaauuccgaaucuuccaccagcugggaguaagcgccaaucuaacuucuguacaagcugcgugaggggcaaguuuuagagaaacagacccacagaaauuacacucuggaauuuucagccagcuuuccacgcucaguagagaaaauaauaguaacaaaugauacuuaaucugaggcugaaagaaaaagcgcggaaaaacuccguugccuccacagcuccacaagcgaagauuccaggauucucugcgagcgagugcuucagggaacuacgccagagcgcgcaugcgugggguugccccgaagcauccugggaccugccaggcugagggaguugcgggccgcagcuccggcuaagaaucgggagaaauucccagaaacagagugacagcuguaauuggacagcuggcaccuccauguugagguaguccaccauuuuauuuuuuauccaccuuggaauagacaucuuuccacucucacacauccucuauacacauuuaaggaaauuauaauuuuccuugagucugcauuacaaacaugcauuacagcucuuuaaauuaagcgauagugggccgggcgcgguggcucacgccuguaaucccaacacuuugggaggcugaggcgggcaaaucaccugaggucaggaguucccgaccagcguggccaacacggugaaacccucucucuacuaaaauacaaaaauuagcugggcguggugguggacgccugcaaucccagcuacucgggaggcugaggcaggagaaucacuugaacccacgaggcaaagguugcagugagccgagaucgcaccauugcacuccagccacggcaacaagagcgacccuccgucuuuaaaaaaaaaaaaaaauuauuuaauuaauugauaguauugagggucagaacuuugaggugaccuaccugcgugcucuccuggaacugcuagcaguguuuaaaugauugcacugugccaguuuuacucuaaugcuguugccugucauuuucuuugcccuucugugcuuacccauagcagcugcuuuagguaauuauuuucugcuuaaucuauauggaucuguuagaauucagauuaaaaauuaaccugaagaggaaagcuagacggguccucaggauauaaaccuuaaugaagcuuuuuuuucuuuuccagauagggucucacucugucgcccaggcuggagugcugugacgcgaucucggcucacugcaaccuccgcuuuccggguucaaacgauucuccugccucagccucccgaguggcugggauuacaggcacaugccaccacaccccgcuaauuuuuguauuuuuaguagacaaagggucucgccauguuggccaagcugguuucaaacuauugaccuccagugauccacccaccucggccucccaacgugccgggauuacaggcgugcgccaccaugcccagccuuauaccgucuuuuguagccaucuuuccagauguugugaaccuauuaugaauuaguaacagaugcaauuagccacgcaguggacaucaaacccugcaaaccccugaguagugccaaaccauaauaucaaaucuuuuuccuucaaacaaaaaacugucaaaaacugugcaacuuccuacaagguuugucaucuguuucggaguaauuaggccuuuguacauuuccuaaaauaucuucugauaacuuuaaagugguaauuuaauuuugguauaaaccaguuccaaaaaaaggagaucuucaugugugaaccauauacucccuaacaucuguuuuuggcuguuugagccuucugugugaauucugguuuuaacuaugccaaauguagaaauauuaauacaaaaaauaguacaacucauuuaaaguugaaaaaugcaaaauauucuaauuugacuaguaccuaacuuugugauccuagccaauucccuuugcacugcaauaugaucacuuccuggagauguaucuaaguuaauaaauacuuaacauuaauucauuuuaacaacauguacugcaaauaugcuacaauuuauccauucuucuaauagacauugauugcggguuuuuacaauuaaaaacaauacugcaaugaacauucuguacaugucuccuugaguccacgugccaaaaauuccucuagaauauaacacccagagccuggguuaguauaucagcaacuucaaaucaacuaaauguugccaaaccacucuccaaaguaaaagcauaaauuucacugccaccagcaaaguauagaagagcccaaugcuauaaauucagcaacaugcacacaugucaaguuguuuuacuuuauuucauuguugucuaucugaugacagcgaaaugguaucucaguguuguuuuaauguacaacucuuucauuacucguaagagugagcauuuuuucaucugaaugacuacucagggauccucaucugugauuugccuguucauguccuuugaugacuuucuugauuuauauggagucauuuaacaguaauaugacaugcaaacauaaguuugaauuuuaguguacacaaauuuaucaacuuuuccuuuuuguacuuaugucuacuccaauaucauacucuuguuuucaauaauucuaaaguuuugcuuuucauauauacaacuuuaauucauucuucccaacauaaagagucugaauaacuuacaauaagaguugugaaggccaggccagagugaccacgacauucaagaaagcaaacauuccaacaacuucaguauuugauggagugguagucuagucuguaacauuccuagguuauauuuaccaugcaagggauacaauaugcaucaaaauauuagaaauguauuucauuugcuuuuagaaugauauuucaucauauuuauuggcuauaaaaaaacaaggcaaccaaccacaaagacaaaacuacucagaauaacaaaauuauauuccagcucuuugggaggccaaggcagguggaucaccugaggucaggaguuugaguccagccuggccaacaugaucaaaccccaucucuacaaaaaaacacaaaaauuagcuggaugugguggcaggcaccuguaaucccagcuacuugggaggcugaggcaggagaauagccugaacccgggaggcggagguugcagugagccaagaucacaccaccgcacuccagucugggcaacaaagccagacuccgucucaaaaaaaaaaaaaaaaaaauuauagauaugaaauacuuuccaugagaaucaggccaggcgcaauggcucacgccuauaaucccagcacuuuggggggucaagguggguggaucaccugaggucgggaguucgagaccagccugaccaacauggagaaaccccaucucuacuaaaaauacaaaaauuagcuggguaugguggugcaugccuguaaucccagcuacucaggaggcugaggcaggagaauagcuugaaccuggaaggcggguuugcagugagccgagaucacaccauugcacuccagccugggcagcaagagcaaacuccgucucaaaaaaaaaaaaagaaauacuuuccaugagaaucuauauagagaaaagcagucugaagauauuauaauuaaggagaaaaggcuuugaguuucaaguaguaguugugcuauauuugaacacauagaaguaacuuccuguuuauuuugauaccuuguuuuuauagccaaaaguugagauuugcaacagaaaagucugacugccugaagaccuaacauauuucuuguaauuuguaaaaugguuuaacucaguuguuuacuguuuuuagacaaacuacugaauauucaugaaauguauauuaucgaugaagcaauuucaagaaucuuuuuuuuuuuuugagacggagucuugcucugucacccaugcuggagugcaguggcacgaucucagcucaccgcaaccuccgccucccggguucaagcaauuccuugccucagccucccgcauagcugggacuacaggcacgcugccccacccagcuaauuuuuuuuguauuuuuaguagagacgggguuucaccaucuuggccaggcuggucuugaacuccuagaccucgugaucuacccugcucggccuucugaagugcugggaucaucggcgugaucaagaaucuuaauuuaaagaauacguuucauauucuggccaacacaaguuauuacaguugcauaccauuugugagauucugguauaagcacgaguauuaaaucucauuacaaaaacagugaaguauaccagacuuucaauauuuggauuuuuauuuuguaccccuugcauguuaaauauaccaucauggauguaaacacagcauauaggacaguauacuuuagucaaaacaauugagaauauuucaacaugaagcagaaaugaguuuuuaaccauaccugaaugguaugugcaauuuaacucaaugauaaauaucaaguaagauuguaaauaaaauauuaacaauaaaagauuuccuacuaaauaccaguaagguuuuauguaucuauuccucacauaaauagauugguuuuggcagucauucuuauaauaggcacugauuccagguuuuacaauuaaaaacaauaccacagugaauguucuauacaugucuccuugaguacauaugccaagaauuccuuuuggaaaccgcccugguuugucaaucagggcuucccccaccuuccccaccaccccacccugaacccucuauggcucccacacccagagacuagguuaguauauaagcaaguauuuuuuugguaucucuuuugggccaagccuuagggcaaaagaagguauccugcuuucauggaguuuacaaucuaccaaaggaucuaagaauaacagaagaaaaugaaaauauuauuuuauucuuuccuuugccaccucuuacauuuuugcaaauugauuccauaaagccauuucuggugaaaaaaguccaucuuuaacuugaagaauuaucuaccuucauacugcaaagaaaaguuuuauauauauauauauaauuuuuuuuuuuuuuuugagacggaguaucucacucugucacccaggcuggagugcaguggcacaaucgcggcuuacuacaaucuccaccucccggguucaagcgauucuguugccucagcuucccaaguagcugggacugcagguguacaccaccaugcccaacuaauuuuuauauuuuuaguagagacaggguuucaccauguuggccaggcuggucucgaacuccugaccucaggugauccgcccaccucagccuccuaaagugcugggauuauaggugugagccaccgcacccagccaaaaaguguauuuuuaaaacugcccugacgugugugagcaaccacucuaaaaaacugaguaaaccauuuaaaauuugaacaugaaugacuuuagaguauaauguuucaguaacucucagaaucaacuggcuuuauuucacagcaccagaugacagcuaucuaauuacuauaugcucguguuuugaaacuaggcugcuucuuuuauuuuuuuaaucacagguacauuuucuuaaucuggaaucaccacccguuuaguaauuguuugacuccgcaaaaaucagaaggcacuaacggacagccagcccauccucauggugcccugagugaagauaagccauuuuugauauaugauggaucaaaaucccacugccuaaggcuucaagcagugagaggaacagccaucaaaguuuaacuccaaccacauuaauuuaagaaacguuuauaaaaaauaaagacaucccaaccugggcaacauggcaaaaccccaucucuacaaaaaaauacaaaaaauuagccaggcaugguggccuguggucccagcuacuugggagccugaggugagagaaucacccgaggcugggaagccagggcugcagugagcccugauuaugccacugcacuccagccugggcaauggaaugagucccugucucaaaaaaaaaaaaaugaagacaucaagagacucuuauaagauaggaaucauuacaucuaaguaagaacuagaggccgggcgugguggcucacgccuauaaucccagcacuuugggaggccgaggcggguggaucaugaggucagaagaucgagaccacggugaaaccccgucucuacuaaaaauacaaaaaaaauuagccaggcgugguggcgggcgccuguauucccagcuacucaggaggcugaggcaggagaauggcgugaaccugggaggcggagcuugcagugagcccagaucgugccacugcacuccagccugggcgacagagcgagacuccgucucaaaaaaaaaaaaaaaaaaaaaaaguaagaacuagaagagaucauuaaggaucaacugauccagcaagggaaaaugaggaacuagauaacaaguuaguaccaaaaucaagauuaaccaacuaaagaaaauguuauuccaacaauuauauaaagauacacauuauagugccuaugacuaauucuagaacuuaauuaaguuuugaggggcggggugaagguaaugagggguagucuaauuaacagaaagauauaugagcaauaaaaacaaagaauuuccucuuuuuuucugagacgaagucuagcucugucacccaagcuggagugcaguggugcgaucucagcucaccacaaccucugccucccagauucaagcgauucuccugccucagccucccaaguagcugggauuacaggugcacgccaccacacccagcuaauuuuuguauuuuugguagaaacgagguuucaccauguuagccaggcuggucuugaacuccugaccuuaggugaucugcccaccucgccucccaaagugcuggguuuacaggcaugagccaccacgucaggccaaaacaaagaauuuucgucaaucuauuaugcagaugucaaaaauugccagguaguacagaaucuaagagaaauauacgcauggauucugaugacaaauaguuaacaucaaacugagcauuuaccguaugcuuuacccacacccuuacuaauuuaaucuucaaaauaaccacccugagucaaauacuauugccauccucuaaaauauaaaacuaagacauagauauuaggaaacuugccaaugcugcauaacuggugaagugauagagcaugcguuugaacucagucugacuccagaacccauauauauacuauacaaugcuacuucucaacaucuuuaauugacucuuuuuuuuggagacggaaucucccuaucacccaggcuggaguauaguugcgcucucucugcuuacuaaaacuuccaccuccuggguucaagccucagccuccugaguagcugggacuacaggcgcacaccaccaggcccagauaauuuuuuguauuuuuuuaguagagaugggguuuugccauguuggccagucuggucucaaacuccugagcucagacaauccacccaccucggccucccaaagugcuaggauuacaggugugagccaccacgccuggccucaacugacuuuuaaaaagugaaauuuagccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcaacuguagucccagcuacuugggaggcugaggcaggagaauggcgugaacccgggaggcggagcuugcagugagccgagaucccgccacugcacuccagccugggcgacagagcaagacuccgucucaaaaaaaaaaaaaaagugaaauuuauagcaccuuagcagcuggccaugaagucacaaaccugaauuuucaaagacucauauauauggcaaagcuucucaaucucaacguaagccuuaccauaaaagaaaaacgcaguacucaucuacaguauauccaggauuuacagcaccaaagagguccagacuggaacagcgaaacucagaucugguuucagucucuugaaauuuuacuccugcaaaagacaacaaaagcuaaaaaauuauuucaaguccugauguuacuuugaguuguuuguauuuccuguauuucacccuucuuucuaccuaauucucugcugaaaaugcaggcacggguaaagaauauaagcuuguccuaaguuaccuaaaauaacuuuuaaaauauuacaauacaugaauacaauaaaauuagaaaauagguuuauaauaauaaaagauuacuuguagaacccaauucuagagaaaauaacccccuaguauuuuaguauauauguccuuucaguuuucuuaagcaaacauaugcauauaaaaauauuuaagcagaaacauauugcucuauauaaucuguuuuucaugugucaugaauaccguucuauuucaauaaacauaaaacuguaucauaacuuuuaagugauucuauaguguuguaccguauagucuucacaaaauugauuuaaccaacucuguguuuccuuuaaucuacauguauagauugauaaaauaaugauuaguuuaaaacugccaggcuaaauugccuauagaauuauaccaguugccagugcuuuuucuguaguguuugaacuuuuagauuaaugauuccugacccuaguucuaacucacaaaagugauuuuuuggggauauagagauaucacaaaagaucaaagcacaacaaaacauuagucucaaauucauaauuuauuaagauuuaagaauuaccugggauuacagacuaaaucccaguaugaauuccaacaagcagaauucaauugcagguguuugccccuagcuuuagucugcucagagcauguguuuaaucaggcugaucagcugaaacacggacuuaacaugcauuucaucauggcaaacuguaaaugacugaggaagggcaaaccagcacuggcuccucaucccuaaacaggaaaauucuccuaagguuagaacuggggauuuuuuuuaauuaccaaauuccauccacuaauaacaccgagucccaagucuugcuaagugauuagaaauccaaaugagguaaaaacgaagauuuugcucuuacucuuaccucuggcaucacaugaauccagcuucuaucuagaaauccaguugaaccacaggaucuaucaauuaucuaggaucauuucuggaaaauuuaaaaaacauaaauaaauucacaaagguuaugauuacaugacaacucacaccagcauguucuauaccaagucacaagaaaauuuagaguaaccguucauccuuuauuuaacucuccauucauuaauauaaauuauugacucaucuauuuggagaaugucaccaaaugcccaagcucaauaucaaauagggcaggaucaggaguucaagguuacagugagcugugaucgugccacuguacuccagccuaggcaacagaguaagaccccgucucgaacaaaacaaaaaaaauuuaacaacaacaacaaaaaaaaaccgagcaggaccccuacacaagcuuaauuuuguauaaauuuacaagcuuggauaaaacugcacaauagucuaaccaacuucugaaaggcuauaaaggucaacaaccucacaguaagaaaacaguuaugcaagaggaaggagucaagaacuuuuaagauucagauaacugagaaaauaauccaaaauagucaguuuuuucaaagcauguuucaauuucauuugagccaaugccggauuguauuuaaccuuuacucuucguaauccuuugucaaaauaaucugaagaaaaucuucccuuuauauaggaaaauugaauuaguaacauuuguaacccaagucugccacaagauggcaguguaagaaagagucuugcuuuaauuuccucuuccagcauuugcgugucaucugaacuuucaggucaaauacauacuagauacgcaguucaucuuugcaggcaaccuucacacuauucccuacucuucaccuaauuacuagcuagaaaauuuuuuguauuuacuuguaaugaucaucuaaaacuuguuagcuaaaaauacugcaguuauacuuucaucauuauguucuuuuucaugcagcaguguggagauuuaaaaauccauaaccucagauacaaucuagccagaaagacaagacucacagaaauuaacauaccaccaaauaaguaguagaaagcaaguaagguuaagaaaagaaguaggauuggucaaggaaggcuucaugaagcaaaaagagugggucacaaguggaccuuaaaguugcauguccaauaaguaaccacuuaauuagaguuaaaaauuaaauuucucccauuacccuagucacauuuucauuacucaauagcuaaauuggcaguacaaacauagagcauuuccaucauaacagaaggcuccauuggacaucagugccuuuaagaaugggucuaaaauaagcugacagaaaagaaagcaguggcuaucauucuuuagaaauccuaucugucaagcuguauagaauuuguaucauuuaaauuuuacaacccccuauuuacaggaaaauugaggcucagaaaaauuacauaaauuuccuaaggucaccuaacuaguaagagcuaggauuuaaauucaauuccaucaaaacuccauacucuucaauucaccaugguacuuccuacaggaaauacacagagcuaaagguuugcuuuaaaauguaaugcagugacaugcuagcucaguagguuggaaagaaacugaagcauuuuaaauaucucagacagauaugaucaaaauguuauuuuacuccuuccuugcccuauacuuagcuuuaacuauguaaaauguuuucagaucagcaggaugcaagguuaacuaagagaauguagacaagaagcaagacauggugugaaagguuucuccaguuuuaacaaugucuaccuuaaaacuccuugaucucuccaaaccuaaaauaaauuuuuuuaaaaaggaaauuaaaaaaaaaacuacuugaucuaaguauucuuacaggauaauaauuauagguugaaaggaacaacuucucuauuaaucucaacucacaaacaaaacccagauugcaagaggccuggucuuuuuguuuugacacauagcacaaagccuggcacauaaauccugauguuaaauaugugauaccuuucccaaugugugaugcuucccugcaggauucuagucaugcaugcuucaacaagugucauuccaccauacaaaggacauuucguauuuacuaaguauugugcaaaugcuccauaaacaaucaaugaucccagcauuuuguugacugugggcaguaaucacuucaaaguacuaguguucauagccaaaagguacauuuuauaugugugaacagaugcuucaugaaggccuaauacaaacuacaaauugauacuaaaucagcagauacucguguuaagauuucaucaccauuccuuuugacucuauuccaauuuacucagugccaccuagcauuauaggauacaaugguaacucgaaucucuaagcuaggcuuuuuagauaggaaagacacacauacguguaaugaagagaacuuaaggcagcuuaucuugaucaaaauucaaguaccaggcuuuagguaccaucagccuuuaacccuuucuguugagaauauccaaauccaagcccauaugauuuucagggggucuacagaugggccaguucuggacuggcacacagggugcuggacuucccuccucaguggauuucaucuucaaccugaaacaaaaugaacacacaaaauuuuguucauaggaaguaaauacuagacuaauagcuugguauaguuuuccuuuagagauaguuauauaagguacugcuaucagaacagacuccaaguuuuauuucccacucacuaucaguuuccuuccuuuuuaaggcagaauaguauuccacuguacauauguauaauauuugcuuuauccauucauccguugauggacccuuaggucaauuccguaucuuggcuuuugugaauaaugaugcaaugaacaugggaguauagguaucucugacauacuaguuuuauuuccuuugaauauacccagaaaugggauuucuggauuauaugguaguucuauuuuuaauuuuuugagaaauuuccauacuguuuuccaucauagcugcacuaauuaauauucccuaaaauaauagauuuugaaaucauacuaaacuagauuuuaauccuggcucucucauguauuugcugugcccauggguaaguuaugcaacuucucuaaacuucagcuguccccucuguaaaaugaggacaaauacuacauaccucuuaaaacuuccgugaagacugagguaauaaauacauuuugcacuguagcuggcauggaguuaaauguuuaauauguuauuucuaugucuugcccaagcucaaccagcuagugaguagaaaggcaaauauucugccuaaaaauuucacacuuuuccacagccauaaaaaaaaaaaaaacaaaaaacauguccuuugcagcaacuggagcugcuggaugcugcugggggccauuauccuaaacgaauuuaugcaaaaacagaaaaccaaguauugcauguucucacuuauaagugggagcuaaaucuugcguugggagcuaaaucuugcguagggagcuaaauacuggguucacaggaacaaaaaguugggaacaauagacacuagguacuccaaaaggaggaaaagagagagaggggcaagagcugaaaaacuuccuauuggguacaauguuuacuaccuagauggcaggaucaauagaagcccaaaccucagcaucaugcaauauacccugaaacaaaccugcacauguaccccgugaaucuacaauaaaaacaaauuuaacaacaaaaagucacacuucucacaauaacccagaagccagaaaggucacucauauaguacucauaagggcccuuccaacuccaagauauuguguccuuuuuuuuuuucacucuuguugcccagacuggagugcaauggcgcgaucucggcucaccacaaccuccaccucccggguucaagcgauucuccugccucagccucccgaguagcugggauuacaggcaugcaccaacacgcccggcuaauuuuguauuuuuaguagagacgggguuucuccauguugaucagguuggucucgaacucccgaccucaggugauccacccuccucggccucccaaaguguugggguuacaggcgugagccaccgcgcccggccauauuguccuucaagcaaaaaagacacagguuugcuucccccuuccccucauuuccuacuuaacaaugaagacuccaauguauuaugaagucuuauuaacaaaagcaugcuuccauuggaaagaauguaauguuuucccaacucacaaaacuuccaccuaaaaaaccggaacuaagccucuuaagacuaaaacagcuuuggagaaauucccaaaggcuuccuuuuuuauuuugcauguuuacauccuaaaauacauuucagcuuuuccuaacuuaauacuaaaauaugcccucaacaccaugaguucaggggcauauccagcacacauuuucuaaguaaacacugaaagcaugcccuuucugccccugugaauacaaagaugacuugguuguucugggccacugcugucacuccuucccagcauuaaacacaugcucauaacaagauaaaccauccccacucaaaccaaagugggcaaagauauauucacauaaaagccaucaagaugauuuuccuuucgguagaaaauccuuuauugcucaaucaaguuuagaguauugauugguuucuaaucaccaccguguacaaaauaaauauaaauaggaagcacugcaaaauaucuagaguccuuuuaaacaagaauauaccaaaacccaauugaaaugccuuuaugccaacugacugauuuacaagguuauucauuugagggggaaauaucaagaucauaaacuaucugaauaccuacugauaaaagcuaaauaaauuauaguagguacauaaauuagaauacugaguuaccauuauacccugaaaaccuacugaaaaaauauauuuuuuaaaaaaaauaauuuuuaaagaauacuauguuaccauuaugaagaaugugaacacucuacucauggaacuuaaguggaaaaaguaagacacauaguagaguagguauaguaaaagggaaggauaccuacacauauuugcuuauaugcauaaaauaucuuaguaacacuguuaugagggagaggaauuggauggcuuagggaaggggauaagaaacuuugauaucuuuugaauuuugaaccaugugaauguauuaccuauucaaaaauauauauauauaugauguguauacauauauauauauauauauauauuuuuuuuuuuuuuuuuuuuuuuuugagacagaguuucgcucuuguugcccaggcuggagugcaauggcgcgaucucggcucaccgcaaccuccaccucccggguucaagcgauucuccugccucagccucccgaguagcugggauuacaggcaugcgccgccaugccccaaaaaauaaauuuuaacaaugcuugagaauuauaaaaauuaugggaggccuacaaauaccuauuacuacauucgauuaacugguuuauuauuugucuuucucacacuuucugccuauaagaauauccaacacaaacaucacauuaaaauuaacauguaccaaaagaaaggaauucagugaaaugacauugaaggucacuaagcaaacuuuuuaugagaaaacagauauccaaaauacuugcuguaaauaaauaaguacugcuuacuucuaaagguaccuaacauuuauuacacaccaacuagagccuaguuuuuauauauuuuaucugaucuuggaaagcuaagccucggaauggcucacugcuucucccaaggucaccagagcuguaaacuguggcgcuggaauuuaaaucuagaggcuugcccugaacuaaggucccuaaucuuuuuccauagcuuuuaaggacacaaucaccacaguggcaacauuaaaaauuaggagcuccuuuuaaggcuuaucugucuucagaguuugcugcccagguucaccaagaaagccgaaaugaucugagcgaaggccaggagaaagacaagguacgcugcagcuuccacaaacccaguaaggaccugggcccucuagacacucaccggagaauuaaacucuacugagcugaacgccuucucccgaaaucugaccucacccagggagauauaaaucaaaacagcauuaggaugauaauaucuuucccgccaagcaaaaugaagccggcguuuuccaagaacacacgcacugugcacaugaagcacagucuauuguuccugggucaccaggacucggagacggaaggcaaacccaguacugcagaggcccacguggaaacaagccaggaagagcauuucacugccuucucccaaccuccacacagccgaaauuaaucuccuugcgacucacacacacuccuaugccgacuugaaauaaaggccugccaccuggguauauaacucaaauggaagagaaauucaaaacaauuagagagcaaaauuaagcgcacacucaccagcccaccaaaacggagagggaaagaaaguggagagacaggaag

SEQ ID NO: 192486 - RNA, 14291 nt, Homo sapiens
ggguugaugacgucagcguucgaauuccauggcggcgcggcggcgacggagcaccggcggcggcagggcgagagguucggagcucaauaucgcgggacggcaugcggggggcgggcagucagaaaggaacgaugccaccuacugugacccccuuccccuuccagcucccuauaaccugcacuuggcuaccaaaccaguuggggugcuaaauuuuguaaauuucgguuuucagagcuuuggggauuacauaauugugcauaaagccuugcggagcuguaacaacuaaugugccaguacuguuguuaauaccuaaugucauccaauuuacaaaaaguaauuguaaggcacaccauuauuuuauacacaacaaaggauaagcacugaaaauggugaacugugauucacugcuuaugucauccauuguaagaugcaucccaguuccagagaguaaaaugcgagucuuagaccuauugagauacgguauuauguguauaauguucuuaaaugcauaggugcacccuauaaauuagguucuauuguacuucucuagaaguacaguauuguacaauauucuaauauuggaguaagugaaguaggaagagaucaaauacuucuccaaguuuccacagagaaaagcagcagagcuaggcucuaaauuaggcacagacccuugagcacuuaacuaaccuuuaucccauacggccucauguaugagguggguauuugggggacauugggacacaaguaaaacagauaagcaggccucaaucuaugagcuuacaagacuccugggacucccuuuuauuuuguuuuauuucauuuggcuagaauagcaauuuaggaagaauuacacagacuguuacacaaaaguagugugggacaguuguuauugccucuguaaacuuagaaaauuaucuuaaaccggcggggugagguggcucacgccuguaaucccuugggaggccgaggagggcagaucacuugaggucacgaguucgagaccagccuggccaacauggugaaacccugucucuacuaaaaauacaaaaauuaacugggcaugguggugcacgccuguaaucccagcuacucaggaggcugaggcacgagaaucacuugaacccaggaggcggagguugcagugagccaagaucgcaccacugcaguccagccugggcgagagagugagacuccaccucaaaacaaaaaaagagagaaaauuaucuuaaaccauuucuuuaaaagauuuuuuucaaucuuuaaaaucuacacguauucggguguguacucauucuuugcuaauuuccaaauucuguagcauuaaaugaaagcaaaagaguuaauaauggcaacacggcuccagaagacucuuccccugccaagaaaacucguagaugccagagacaggagucgaaaaagaugccuguggcuggaggaaaagcuaauaaggacaggacagaagacaagcaagaugguaugccaggaaggucaugggccagcaaaagggucucugguaggaguggaucuggggaugauaucuuguuauuucaacuccuauuucguccuucuuucagggaauaauuaauuucucuauccuuugggcauaccacagcacuaaucuacugccuugaaucuucauuuucauguauuugagauggauuggggucuaaggaaagaccaggauugguugggcgggcaaaguuaauccugacaaguuucuguuuuaccacaacagcuguuuuugauucccauaaaguaguaccuaucugucuuuccucagaaucugugaaggccuugcuguuaaagggcaaagcuccuguggacccagaguguacagccaagguggggaagguaagagacucuggaaccgaucuucaguccauggauaucucagagagcauccuuuguuauaaggacuccugucugggaugcuguuaguacucauuuuaggaauccucuccaaaauaugaugagugaguaguuuucucuaauggcaagagauaggagugguagggcuugggguuaauaaucaggguguuuuuuaacaugguguguuagaccauucuugcauugcuguaaagaaauaccugagacuagguauuuuauaagaaaagagguuccuagaggcuguacaggaagcauagcaguaucugcuccucaggagaccuuaggaaacuuuuacucauggcagaaggugaagcgggaauaggcacgucacauggcaaaagcaggggagagagagagagacagagagaaagggagagagagagauuggagaaggugucacagagagagaaagagagaauggggaggugucacacgcuuuuaaacuaccaaaucuugugugaauucacucacuaucaagaggacagcagcaagacaguggugcuaaaccauucaugagaaauccacuuccaugauugaaucacuucccaccaggccccaccuccaguacugaggauuacaauucagcaugagauuuggaaggagacaaauauacaaacuauaucacaugcguaccuuuugugguugccaucagccuucuacaccucauucucuuuuuaaaccagaaaaugguaucauuguuaagggaaaacuguuuucuuguucuaaugagaaacuguacccuggaauggcaugaguuacugaugaauggggaaaaaagaaggcuaccucuggaauaaguuuucuuuaacucaguuagaaucuuuuuuuuuuuuuuuuuuuuuuuugagauagagucucacucggucacccaggcuggagugcaguggugugaucucagcucacugcauccuccacuuccuagguucaaguaauucucuugccucagccucccaaguagcugugauuacaggugcccaccaccacgcccagccugggcuaauuuuuauauuuuuaguagagacggggcuucaccauguuggccaagcuggucucgaaugccugaccucaagugaucugcccaccuuagccucccgaaaugcugggauugcaggcaugagccaccaugcgcagccuaacucagaaucuuuuguauaguuaaaaaaaaggaagcauguuuucauuuauaguaagguuacacccagguuacugguagaacauagguuugcaauucuuuccuugggagaugaauguugauguugcuguagaaugaugacuugagccauaagaaaauuuagagccucauuuaggaugucagggcugaaccuauacuaauguugauuuuuucucucucucccuuucuaggcucauguguauugugaaggaaaugaugucuaugaugucaugcuaaaucagguaagaggcaagaagagguggcaccauuauauuuaugagaccaucuucuugauaauuauugaugauagcaucacaguguucagaucuuuaaagucccuuuuuuuuuuuuuuuuaaauuuuguuuuuucuuuuugaaauggagucucacuucaucucucaggcuggaauacaguggcacaaucucggcuuacuguaaccucugccucccagguucaagcaauucuccugccucagccucccaaguagcugggguuacaggcgugcaccaccacucccagcuaauuuuuuguauuuuuaguagagacaagguuucgccacguuagccagggucuggucucgaacucgugacuucaagugauccacccaccucagccucccaaaaugcugggauuaccagguguaagccaccacgccuugccuaaaguccuucauauguguguguguauauauauauauauauauauauauauauauauauauauauauuuuuuuuuuuuuuuuuuuuuuuuuuuuuuuuuuugagacagagucuugcucugucacccaggcuggaaugcaguggugcaaucucggcucacugcaaucucugccuccuggguucaagcaauucuccagccucagccucccaaguagcugggacuacaggugcagugucuggcuaauuuuuugguauuuuuaguagagaugggguuucaccauguuggccaggcuggucuugaaccccugaccucaggugauccacccaccucacccucccaaaguguugguauuacaggcaugagccacugcgcccggcaaguccuuuauauuaauauuagccauuagugguuaaacaccugaguacucagcccuagcacacucuuaucagauagcagaguccucugugagaagauuuuuuuuugcaaauuucauaucauuuauugaaauuguuaacucucuguucauauccuuuugcacauuuuuuuuuuuuuuuuaaacagacaggaucuuguucugucacccaggcuggagugcaguuuguacagucauagcccacugcaaccuugaacuucugggcuccagcaauccucccaccuaagcuuccugaguagcucggacuucaggcgcaugccacaaagccugacuaauuuuuaaauuuuuuauggagaugagaaucucgcuauguuggauagguggucuugaauucuuggccucaaaugauccuccugccuuguccucaugaggcacugggauuacagggaugagccacugggacaagcuguuuugcacauuuucuaaaguuauugguccuuuucuuacugguuucgaggaacuuuauauaauauggagaauagccuuuugucuguaauacaaaccacuuguguuuuccagauuugucauuuaccuuuugguuuuccuuauaguacacuuuuugcccauauugaaguuuuaaauuuuuucuguaguuaaauuuauuaauuuuuccuuuuuaaaaaauuuuggguuuuuuuuuuuuuaauuuuagagacagugucuugcuauguugcucaggcuggccuugaacuugugaccucgugugauccuccaaccucagccucccaaguagcugggacuacaggcaucugcccccaagcucagcuuucuuuuuaaucaaccuuuuucucuuguuuaccuuugugguuuugaguagauaauacauuugccucauuaauauauuuccuggauaugacuucauguuugaauuuauugauccaacauauauaauuuuaacaaccaauuaguauuuauuucuuacuauuucuucuacuuaaaauaccacgagcagauagaaaauaccuuaagguuagccaggugcaguggcucacgccuguaaucccagcacuuugggaggcugaggcgggcggaucaccugaggucgggaguucaagaccagccugaccaauguggagaaaucccaucucuacuaaaaauacaaaauuagccaggugugguggcauaugacuguaaucccagcuacucgggagguugaggcacgagaauugcuugaaccugggagacggaguuuguggugagccgagaucguaccauuguacuccagcccugggcaacaagagcaaaacuccuucucaaaaaaaaaaagaaaagaaggaaaauaccuuaaggcagccaggugugguggcucaugccugucauccuagcacuuucggaggccaaggcuggagaaucacuucaggugugaguucaagaucagccugggcaacauggugaaaccuugucucuacaaaaaaauacaaaaacaccgggcaugggccagcuacuuuggaggcugaggugggaggauugcuugagccugggagguugaggcuacagugagcugugauugagccauugcacuccagccugggugacagagggagacccuaucucaaaaaaauaaaaaauaaaaaccauaaaaacauuuacaaaaaaauuuuuuaaaggaaaagaaaauaucaagcugggcaugguggcuuaugccuaaaaucccagcacuuugggaggccaaggcgggcagaucacuugaguuagggguucaagaccagccuugccaacauguugaaacuccaugucuacuaaaaauacaaaaaaaaauuagucuggcaugguggcgugugccuguaaucccagcuacuagggaggcugaggcacaagaaauugcuugaaccuaggacacagagguggcaaugagcggagguugcaccacugcacuccagccugggcgacagagcaagacucugucucaaaaaaagaaaauaucuuaggcuccuuuuuguucuaacaucuaaugaccuuuuuuuuuucaccagugggcuaaggucguacaauggcuuuagaaugugagcaagcaggagauagagguaggaaggggcagcaugcuuaacaaaaaagaaugccuccauauccagggcucggccauacaacaccagcugcuaugccuuaucauggacuucucucucuucacucugagugauuuacuuacagauaccucuuuuuagauacuggccauauucucucucaguaucuccaagucaggucagguuagguaugggacggauguggcagugguuuugcguaucccuuguccccucccauuauugcccugcucucagcucauugucaaauuucugcagcugacaaacaaaagcugugaguagaacugucaaggaguaagucauuuaacaguugagcauaacagguuuagaccuuuggagcauccaaauuguuuucauuugggaaauaauuauugggaguggauugggagcuggaaaacacauauagcuuagaaaauaucuaaauagggagcugaggcaggaaaaaacuggaggagccauucaauguaggauauuugagguuggauagaggguuuuaggaagcuucuaggcucccacuuuaauuccuaagaauccaaaguuuaauguauaagcccuauuucuucuuuauaucuuuaaucuuacaggaaucuaauuuucuugccugaugcuauccuuuuccuuauggaaauaacuggcaccugugacgaaggaugagucauugguuuaugugauuuccauuugcaaaacuccuuuuuuuuguuuuuguuuucacucaacauagaccaaucuccaguucaacaacaacaaguacuaucugauucagcuauuagaagaugaugcccagaggaacuucaguguuuggaugagauggggccgagguaaugauuuuuauugagauuuuaugaguuggcauucagaaagucagaagcagcuuaguggguggccaaaggauucucuggguuuaaauugggucaguagaggcucugaagucugggagagccuuaggaaucaaguugagcaucuugaaauuggggaauggcaggcauccuccuuagaguucccacuggaaaaacuaagagcagcccauugagucugaaaacucuucuauaguugaacugcuaguagugcucauagacuauggcaguuagcaaguaacuuguaucaacaugauuaguucccuaaauccuuucaccuuucccuucucccuuuccugccuguuugucagauguuaagcagagagaucuuggagagcuggccuguuacucuuagggaacuaucuuauguguggcauuuccuuugcaguugggaaaaugggacagcacagccugguggcuuguucaggcaaucucaacaaggccaaggaaaucuuucagaagaagugagugcugaaaagugacuacaaaaaaauauacccuccucuucuuagauguauauucucuaaaaaauuuuuuuuuagacaguuucacucuuguugcccaggcuggagugcaauggcaugaucugagcucacugcaaccuccaccuccuggguuuaagugauucuccugccucagccucccuaguagcugggauuacaggcgcccaccaccacgcccagcuaauuuuuguauuuuuaauagagaugggguuucgccauguuggccaggcuggucucgaaccccugaccucaggugauccgccugccucagccucccaaagugcgggauuacaggcgugagccaccgugcccugccuucucuaagaauuuuauaaguguguggcuuauaaaaaacuuuucguuuuauaggugugauuuggccuaaauguuaaugucuuuucacccugacauucugugguugaaacaccaaacugcauccuuagugauuaaaucaaacuaauaccuugaaagucacuaaaaacagaagaaucuaauauauuuaacacaugacugacaaauuuaggaaauuugggauaaguggagacuauccugggauagauaauauucaacuaggggcugagcacggugaugccuguaaucccagcacuuugggagguugaggcaggaggauugcuugaagcuaggaguuugagaccagccugggcaacaaagcgagaccccugacucucccccaaaaaaaaggaaagaaaaaaagagaauauucaguuagaauuuuuaaaacuuuaugauauagaugaagaacuuucuggagaauuggagaacauguuucuuucagggaaagagauuagauggauaucuuuuguuugaaaucucaauggcuuuugugguguuugggaaggacaagcauuguuuuucccauuuuuuaaauuccauuugucuccagagcuuuuuuguccauuuaguguccucauuuagaauuagacuaauuuugauuuauggaaaguugauguguaaaggagcucagugcuggaaaauaaauucuuuggagauuuucugucuuguaaguccaucuucauaguagaccuuuauuuguaaaguuuucuuacaccuuggacucuacagauuccuugacaaaacgaaaaacaauugggaagaucgagaaaaguuugagaaggugccuggaaaauaugauaugcuacagauggacuaugccaccaauacucagguaacucucacuauacuuuucgaaagaaacacaucuucuuuuuuuauuuuauuuuuuagaggcaaaacugugcucuguugcccaggcuggguggcacaaucauggcucacugcagccucaagauccucaggcucaagugauccucccaccucagccuccucaguaucaggaacuacaggcacgugccacucugcccagcugauuuuuuuucuuuuuuuuuuguaaagaugagguuucacuauguugcccaggcuggucucgaauuccugggcucaagcaguccucuugucuuggccucccaaaguccugagauuacaagcaugaggcaccacaccuacuccuguuucuucuuacucaggguaaagcagaauagcuuagaucauuccuggacugggacaggccaggauaucuugaauccuuucuacuucucaccucaggggugcucucacugaucuuuguaaucccaaagggacaguaagaaugaggauagaaugugccuuucuagucuuggcucuguuauuuacuaagguucuuuuuuuuuuuuuugagcuggaguuugauucuuguugcccagguuggagugcaauggcucagucucagcucgcugcaaccuccagcucccggguucaagcgauucuucugccucagccucucagguagcugggauuacaggugcccgccacuaugcccagcuaauuuuuuuuguauuuuuaguagagacaggguuucaucauguuggccagucuggucuugaacucgugaccuugggugaucuacccgccucagcuucccaaagugcugggauuacaggcgugagccaucacgcccggccuacuaaguuucuuauaaaaucuuaggcccuauuuccagacguuuauuguuuuuuucguuuuuuuguuuuuguuuuuuuuugauacggagucucgcucugucgcccaggcuggagugcaguggcgcgaucucggcucacugcacgcuccgccucuggguucacgccauucuccugccucagccuccggaguagcugggacuacaggcgcccgccaccacgcccggcuaauuuuuuuuuguauuuuuaguagagacgggguuucaccauguuagccaggauggucucgaucuccugacaucaugauccgcccgucuuggccucccaaagugcugggauuacaagcgugagccacugcggcuggcaccagaaguuuauuguuauggaccaagagaggagugauaaaaaaucaaacugauuaaacaauuaacauuuaaauuuguuuucacuucuggauauauaccaccauaaaaaauuuaauuuagauaaacugagguauaccaggaugcugaaacuguccggaaacagucacauauccaaaaaaauggagaaguuuuagucuuuuuuaagaugggaagaucugagacauaauagcugucuuuacacacugacgucaugaggaaagccuuuuuuuucuagacuuauucugaguuguaaaaugugggaggcagaacuuggauggucaacccucuauauccauggauucaaugaacugagaaucaaaaauguuugaaaaauugcuucuguacugaaccuguacagccuuuuuuuccuugcuucucauuauucccuagacagugcaauauaaaaacuuuacaaagcauuuacauuguauaauauuggguguuauaaggaaucuagagaugauuucuuagauugucuuguguuuuguuuguuuuuugcuauaggaugaagaggaaacaaagaaagaggaaucucuuaaaucucccuugaagccagagucacagcuagaucuucggguacaggaguuaauaaaguugaucuguaauguucaggccauggaagaaaugaugauggaaaugaaguauaauaccaagaaagccccacuugguaggacuucacauuuucuucugcauucucuccuuauaauuccuagcuccuuuaauggauacuuuauuaucauuaugauuuaaagcuugcucauaguacugaaugaagaaaaugggauuuggggugacagguuguauggagggaagaggaacuauuuugaaaguugaggcugggugugaugggucaugccuauaaucccaacacuuugggaggccaaggcagguggauugcuugagcccaggaguuugaaaccagccugggcaacauggugagaccccaucucuacuaaaaauagaaaaauuagccaggcaugguggugugugccugugaucuagcuacuugcgaagcugaagugggaggaucaccggagcccaggagguugaacugcauuuagcuguguuugugccacggcacucagccugggcaacaggagugagaccccaucuuaaaaacaggaaaaaaaaaaguugaaagaugaaagucuuuuuuagggaaggauguuaaguacaguucacuagaugggauccuaguuuggagucugaucucugggugggccugcagggaagcugacaguggcacaaaucaaggcagguuaccagucucuuaagaagauugaggauuguauucgggcuggccagcauggacgagcucucauggaagcaugcaaugaauucuacaccaggauuccgcaugacuuuggguaaggccugugcuguuacuucacuuuguucuucuaccuauacauauccccuguauccaucagcagcagcuauaaucuuuuaaaucuuuuauuccuaagaaaaugaucgucuugaauagguacagaaacaaaaugauauauagguagccuauuuaaucagcuuacaaauaugggaugcaaucucccggcuugaccacagccauauucucugacaaaguggaaguuaccaacccaagagagaaugggucuagcuauccaaccacccaaguaaaacaccuucaggcauaucacccccuuuuccuauuugaguaacuaaaaccacacaaacaccauuucugugaacucaagugauauuagauagacaaaauaacauuuuacauuuguugauucuguuuucugguuuacauccgauuucuauuucuuuuauagcuuuauagagccccgugaccuagaaauaacccugaguggucaacaggucuaccugugcuucuagauagaacuguauccaacuguucccuguugauaucaauauaacuuauuuuuaaaugauuuuauaaaaaauaauuuuaacucuagucucaaaagucaaaauccacauaguucaucuuauaccgaguauauauuuaauauuauuuuauauauuuggaaguuaagaucucuuuacagaucucuuucucucucaaauggaaaaccuguuucucauaccuguuuucuaaaggaccuaucugucauuuucuauuuuuagucaugcgccuuuuagccacaugucagaaagcucauuauggguuauaucucuguucuuagacuccguacuccuccacuaauccggacacagaaggaacugucagaaaaaauacaauuacuagaggugagauauguaugauuugagaaguauuauaucccuuauaccaguguccucccacauugauucuauaucucaucuucucaggcuuugggagacauugaaauugcuauuaagcuggugaaaacagagcuacaaagcccagaacacccauuggaccaacacuauagaaaccuacauugugccuugcgcccccuugaccaugaaaguuaugaguucaaaguaagaaaaaugaucauuuauuuucauauucuugcacccuuaaccaccucccccaucccacuguucucuaacuacuucuugucaagagcaaauugucaauuagggcagacuuuuuauguacuagggauuugggaaggccaagcuuuuccuagcugccuuguaagacuguuugggagcagaaaggucugccaaguuauaucagaauccccaaauucuucaguucagcucagucucuuguagagucuacaucagccuuuuugucuuauuuuucacaggugauuucccaguaccuacaaucuacccaugcucccacacacagcgacuauaccaugaccuugcuggauuuguuugaaguggagaaggauggugagaaagaagccuucagagaggaccuucauaacaggucugagucuagcuuugcguuuggaaagacacuccuugcccgaaaguacagcuguagaacuuauaagagggagucagaggaagguguuggcuuuuuuaugcuuauggccuaucugugcagaacaacagaguacaauaauauuggcuuuuccuuaggaugcuucuauggcaugguuccaggaugaguaacugggugggaaucuugagccaugggcuucgaauugccccaccugaagcucccaucacagguuacauggugagugaaauugaacucugggaggagcacaggggaaagggauacaguaauguucucagugcuuuuuuuccuagauuaggauuagaugguuccccuccccaagaguuaagccagcucacugauaaccuugucaucucuuacugugucccucuuucuuuaaauuccuaaagauaccucaccuuucccucagaaggcggaaauucacaggggcuucuacccucucuagaacagaauugugaggggaaauggagaagggucuauauuguguuuaagggaauggaaaaacagggucagugguaugcaccuucucucuaacacaguggguuagaagcugaccuugguauucauguauauauuucaguuugggaaaggaaucuacuuugcugacaugucuuccaagagugccaauuacugcuuugccucucgccuaaagaauacaggacugcugcucuuaucagaggugagacaggaguaugucugugaucucuaguuuauuaauuccaguuuuuuuccgaugagaaaaguuugaccccagaaccaagagguuuaccugggauagcuugagagaggaccaaguacaauuucuaguacauuggauuccucugcuggaguaggggaaaaaaguacugaugggauuuucuguuuggcuuuggagccaucuaauucuuaguaggauaugggaauucaaagguuuuuugcuuugcagguagcucuaggucaguguaaugaacuacuagaggccaauccuaaggccgaaggauugcuucaagguaaacauagcaccaaggggcugggcaagauggcucccaguucugcccacuucgucacccuguaaguacucagaaccaggaggacuagaagacuccuuuuggccagauaagacuacguucucuauugcagcuucugaaccagagacugauguugacacacuuuuuuuccauuuggcaggaaugggaguacagugccauuaggaccagcaagugacacaggaauucugaauccagaugguuauacccucaacuacaaugaauauauuguauauaaccccaaccagguccguaugcgguaccuuuuaaagguucaguuuaauuuccuucagcuguggugaauguugauauuaaauaaaccagagaucugaucuucaagcaagaaaauaagcaguguuguacuugugaauuuugugauauuuuauguaauaaaaacuguacaggucua

SEQ ID NO: 192487 - RNA, 8061 nt, Homo sapiens
agccucgccucccuccucuaauucucuaggacacuuagguccccaacccucccucgggcuguuuaucguugugccagaugcacagcacauugugugacacugacuuaagauucuaacuaugugcaagagggaaaaaaacaguggagaaggcugggcuggaccacgggaaagagauaggaaaacggauacgaauguaaggcacagaguuggcucggcgucccuggcaguuaggaagacaggucccuggaggggccuuggcgggucuccgcucgcgggaguuccgcggugucuuucccagugcuaucugcaggcuggccagcuuccucugcgcuccggaaagcugcggcccagcgcggacuagugaggaccuccacagcuccugacauugccaggaguccugucggcguuuucucccagccuccgccaugccggcggugcuggguuuugaaggcagcgccaauaagauuggcgugggcguggugcgggauggcaaggugcuggcgaacccgcggcggacuuacgucacgccuccuggcacagguuggugaguaggggacuuaagaguuuuccgcgcacuuccccgcacagaaucagccuuccaucuuccuaaauacuagugaggugcagcuuucgauccgagucucauugaaauuaugugacauuauuaacgucacaaggcugaugacuagaagaguuacaggcacuuggacguggaucugaugaguucauuuaccuuuuacugagcgcauuuuaugugcuaaguauucagaaauagauguuauacugcuguggagucagacauauaaauagauguuuauacuacagcaugauaaacaguauaauagagauggacucgaaauauucuguuuaaaaaacgcuuagcaggaguauagauuccaguugcccugaauauacacucccuuuuuaaaaaaaaauuauuuuuugaaauauucuaggaugaguagagagaugagaguggaaagacucccggcuuacaugucagacagaacuggcuggcuuugcuauauucauauuaaauauuuuuguuuuggacauuuggucuuuauuuuuuauuuuauuuuauuuuuuugagacagagucuugcucugucgcccaggcuggaaugcaguggcacgaucucggcucacugcaaucucugccuuccagguucaagcgauucuucuaccccagccucccaaguagcuaggacuauaggugugcgccaccacauccagcuaaauuuuguauuuuuaguagagucgggguuuccaccaggccaagcuggucucgaacuccugaccucagaugauccgcccaccccagccucccaaaguguggaaauuacaggcaugagccaccgcucgggccuggucuuuguuuuuaaaaugggaauaauaccuguaucauuaggucuugaagauuagaugaaaguaccaaacacggcugggcgugguggcucacgccuguaaucccagcacuuugggaggccaaggcaggcagaucaccugaggucgggguucgagaccagccugaccaacauggagaaaccauguuuccacuaaaaaauacaaaaaauuaacugggcgugguggcgcaugccuguaaacccagcuacuugggaggcugaggcaggagaauugcgugaacccgggagacagagguugcagugagccgagauggugccauugcacuccagccugggcaucaagagugaaacucugucucaaaaaaaaaaaaaguacaaaacacauuacaacuuuuaauugauauuuuaaauaagcuauuauaucuugcuacucuccccucaaacacuugcauacauaggagagggcagcugacuugcauguaucugaaaagccucccugaacaggugauguugugacagauacucacuagaaauauauauguauguuuagcauucacuccucugggcacuugggcacugggaauacaaagauaaauaaaauacucaaugcuuugagauauucaugauuaagcugagcaaaccacagaaaauuauaaugcuguaauuguuauguuaaauaaaugacaucaucaugcauagaguucuguagggucacagagaaagaagaucaccaaaggccaggcacgguggcucaggccuguaaucccagcacuuugggaggccgaggcagacggaucacgaggucaggaguucgagaccagccuggccaauauggugaaaccccgucucuacuaaaaauacaaaaguuagcugagcgugguggugucgccuguagucccagcuacucaggaggcugaggcagaagaaucucuugaacucaggagguggagguugcagugagccgagaucgugccacugcacuccagccugggugacagagcugagacugucucaaaagaaaaaaaaaaaaaaaagaucacgaaaggguaugagguagauacuacuugcauugagaccugaaggcugaguaggguaagaagaagagcauuucugaaaguugaauagccuauauagaagccggaaagaguagaugugaaaauguggaagauaggaugcuuggggaaagugaaaggacucuuacuacaucacuaaaacuccuguugcuuucuuuaacuuccuaccuaccuuugcuacagaaaaucccugugaucucugaccuauguucauuuucuaggauuccuuccaggugauacagccaggcaucaccgagcuguuauccuagaccugcugcaggaggcacuaacagagucuggauuaaccucccaggauaucgacugcauugcauacaccaaggguauggcugggagaguggucaacgauggaggaauauaccugcaaccuggcuaggucaaaauagccaacaccuuaccucugccaccaucacuaccccuaccccaccucacaucccuuaugucccccacuauuguuuuuuuccaaucucuaggauuauaacuuccauuucuaucucccuaggcccuggcaugggugccccacugguuucuguggcuguuguggcccguacuguggcccaacuguggaauaagccauuggugggugugaaccacuguauaggccacauugagaugggccgccucaucacuggagccaccagcccaaccguguuguaugugaguggaggaaauacgcagguauuuagagggcucuacccacuccaucucaauuucugaggcacugaaccaguauuuucuuuguucuaucugagucaugggaaugucaggaacaaagauggacuuaucugaaccuaaaauacuguagaccagaaaacccccaacagaguuuguaacauugcaaauuuuggcagcaugaucagaacauuagauggcuuaucauuaucagacuuuauaucugauuauaaagauuaggaauuucuacuucaggaaaggaaugaaugggauugaaaaggauugaaaucuucaaaauaaugaauaucugaaagcucuugcauuauuuugaagcuuauuuuuucuauaaaucuuagcaauugaaacuaacaguugcuggguauggcaacucaugccuguaauuccagcacuuugggaggucgaggcggguggaucaucugaggucaggaguuugagcccagccuggccaacguggcaaaaccccaucuguacuaaaaauaacaaaaauuaauuugaugugguggcaggugccuguaauccuagcaacuccggaggcugggcaggagaaucacuugaacccaggaggcggaaguugcggugaaccgagaucgcaccauugcauuccagccugggcaacaagagcaaaacuccgucucaaacaaacaaacaaacaaaaaacaaaaaaaaacaacuaaaggacacuaccugauuuauuauuuuggggcaaguacauguuuuguuuuuauauuacugggaaugauuauguagacuuuguuauucuaagaguuuagaaauauaaauaacuuuaaaaaauacuuuguaaauuauagaagguauuuuauuuuaucuuauuuauuuauuuauuuauuugagauggaguuucgcucuuauuguccagguuggagugcaaugaugcaaccuuggcucauugcaaccucugccucccggguccaaacuauucuucucuacucccgaguagcugggauuacaggcacccgccaccauaccuggcuaauuuuuuguguuuuuaguagagacgggauuucacccuguuggucaggcuggucuugaacuccugaccucaggugauccaccugccucggccucccuaagugcugggauuacaggcgugagccaccaugcccggccagaagguauuuuaaauuuauaggugaagcuaaaguuguuuggguuaccuuauaugaccuuuuuaagguugggauuggauucuuuuccaacagaacacuugauuaucauuagaaauaguucagcauuguccccagcucaugaaaggguugugucgagaagaugaggcacauguuucccaugaaaaugaugcagaaacuucagcagguagagggcaaguaguugguugaggccugaaggaugacauacaaggucagagacuuggguuguggaaaguauaauggaggcuacaagaguugaugaaaggagcagugacgguuuugucuuccucuucucuuuuaauguuugcuuagguguaagaaacagggagggugauuagguggagaggaguggauagcagaagcagaaaggcaggauuuuuccuucgccuuuguuacugucuuuuugacagcagauuaagaucuguaucagaaagggaagaaaucccuaacagcacugggaagggaaagggacuucuuaagguucguaggaagcccucgguguuauaagucugcagaauaugugucaguaagggacagauauucucugugcuaaaaguuggucacauaugaagaacggccuuaauacaaaaaagugguggugggugccuguaauuccagcugcuugggaggcugaggcaggagaauugcuugaaccugggaggcagagguugcagugagcugagaucacgccauugcacuccagccuaggcgacagaacaagacucugucucagaaaaaaaaaaaaaagaaaagaaaaauggccuuaagugaauugccauugcugacuuggcugggccauuagucugacuccauaugagauuuuugaguucuucagcucugcuucuugguucuaaauaccacugcccagcugcauacggugguucacaccuauaaucccagcacuuugagaggcugaggcagguagauugcuugagaccaggaguuugagaccaggcugggcaacauagugagacccccaucucuacaaaaauauaaaaauaagccacacaugguagcccagcuacucaggaagcugaggugggaggauccuuugagccuaggagguggaggcuacagugagcuaugaucacaccacuccacuccagccugggagacagagcgagacccugucucaaaaaaaaauuaccacugccacugugucauaauuuagaaggauucauguucucugccuccaagcagaaaagccgguuaccuacuaucaagacugcauuuaagggauauauuaggaacuucuaagccggaaaaccaauguauuugaaaugacaauuuauuucugccugaaccuacacugucuaggaaucuguuccuggaauccucaggguauacagauuucuucucaaaucagagcuguaaaaacuacccauucaccauuugggaaacaccuuucuuccacuucuuauuggaagcccugguggucauguugauccucugcuauguuuuucucccaaagccaaauaauccucuuuacagacuugggguuucauggacuuccucaucacccuuaggugauugcauacucggaacaucguuaccguaucuuuggggaaaccaucgauauugcaguggguaauugucuggaucguuuugcucgagugcugaagguaagccaguggggcugcagagaacauaaaaugugggugaauuuuugggaagccauggagguggagggaggaaauaguaaaugagcuucuuaugcuuccugcauaucugauuucauccucuuccauucccuccuuccuuauuuuuuucuucugcuagauuucuaacgacccaaguccaggauacaacauugaacagauggcaaagcgguaaggggacauaagguggaagcaggcuggcugcuggggcuucagggauuuccccauauacgguauauauuaacaaaauuugggacgggcuuuggagggugagaagccagcugacuguaggcuuagugccucguacgcuuauucccacauagaggcaagaagcuaguugagcugccauacacuguaaaggggauggacgucucauucucagggauccugucuuucauugaggugagugugagaggugaugagacgggcacuuucaugcuuuuuaaaugaagcauaucuguuuuacuuacgauuauauuucguauagcucaguauauucauguagcacaguacugguccauaucaugugcuggguaaauucauuuagaagguauucauugaauaucucugugugccacaugcuguucuagauaguagagaugcagcauggagcaaaacaaaaaucccugucuacauggagcuuagauucuaaauggggggcgggggagauaagaaagaggaaaauaaugaagugccagaugaugaugaguacaggugaaaaauuaagcaggauaaguaaggggugagagaugucaggacaaguauucaaaaaguaaugauugcaucuuaaaugaaagcugcucauucuaugccaugaugccagugaagggaaugugguacaggaugugcugguaacuugaauuguggugaaacaugaugacccuccgaaugcauuaauuuuugcucucguguaaucccaaaaccaugauuuguugauucuuuuguuuuucccuuuaauuguaggauguagcccaucggaugcuggccacaggcgaguguacuccugaggaucuguguuucucccugcagguaaugcaguaaaaaacugggacagaaaguuggggcugaagguuuuauauuguagagcagaacuaaucugggaugccccucuaauauuuucuccuuaucugucccugacaggaaacuguguuugcaaugcugguagagaucacagagcgagccauggcacauuguggcucccaggaggcccucauugugggaggagugggguguauguauuauugaaaaguguuccucuuuccuauucuuaacacuaugcgucuuccuccugguacucuaaaucauuaagcguuuggaguaggcuucccaauccuugccccuaauccccuaugucauuguucuaagugagugcacaugacguguucugcuggaccaugaagagauggcuaaaacuaagcuaauccuguucccugccucuuuguagguaaugugaggcuacaggagaugauggcaacaaugugccaggaacguggagcccggcuuuuugcuacagaugagagguaaagacacuuucccuuugguuucuuuuuuacuucuccuguuauagugauuuuccacccuuagaucccaauuuucaucucucuugcaucccagauucuguauugacaauggagcgaugauagcccaggcuggcugggagauguuucgggcuggacacaggaccccacucagugauucugggguuacacagaggugagugauucaccucuuggugaggguagauuauugggacauagacaaaaacagcagggaagaguccaggaacaugagggcagagaagaaugaaggauguuaagggcucgcucuccaccauguuucuucuguuuuuccacagguaucggacagaugaaguagaggugaccuggagggacuaauaagaucaacagaaucagaguagauaguuccuuaaucggaacccaaaggaccccgugccucaaucucuauccugaugucaugggaguccuagcaaagcuauagacuccaagcaaggcuugggguccuuuauggaaccccaggaugacucagcaauaaaauauuuuugguuuuuugguuuuguauguugguga

SEQ ID NO: 192488 - RNA, 8628 nt, Homo sapiens
auaagccagagccuagaccagugagccaacugugcgaaccagacccggcagccuugcucaguucagcauagcggagcggauccgaucggaucggagcggaucggagcacaccggagcaggcucaucgagaaggcgucugcgagaccauggagaacgggugaggagggcaccaggcccgcaggacccuuggggaggggcaggugcugugacccgggaaccuggcacacugggcccagagggagcuggcggagggagcgagcgcccaggggaugcagagaggccuggcacugagccuagugucgggagcaaggcggcagagucaugcggcagccagcgcgggcagggacgcacgcgggaaucgagcugggguggcgccaccggagcaggaaggggacaggucggugcggucuaagcuacuccguaaaagcagccguugugugucuccguguguguguuaggggaacaaguggagagugaguauauguauauaucccucacuccauaccaggaggaggucuccucacccccugcgcucuucauaaauucccaugcuagggucuggguaaagcugcgagguacuuuuggugcucaaauucggaguuccuccuuuagaggcaagauuacucaccuccuuugccaguugcacuccucccuuccuuccagacuggcaguaugauuaacucggugggaagugacugcuaaguggagacggaaaucagucaccgaacugagcaacaguccugugcucacuucccccaccccacgccuuugaaaacucuucucucggcuuggguccuggauaucccaguccaagugaccugcauuaggcaucacaguugcuuuuggaugcccagggagccaggguguucuugaggggacugauagccaaugaggaagugcugugagauguggcuagacaugccauguggcggcagcuucacacauucauuuccuuugcaccuuuuggggaugccauuugauuaacauuuuaccagcuuaauugcuucucuccauuguccuguggcuccguugaccagcccccaaccuaccugauccaacugcuucccugaggguagccugguguauugugcaaucaugucugguuucccgggcucugcuuuccaaguaaaaaauuuccugugaaagcuugguuaguuguguucagcucugucacaccucauugccaccucugaaagcaacguuuggucuucccagauggaugugagagaacuggacuuggaacugggagaaaaguaacacggguugauucuugcuaguguagggguucuggguaagugcccugagguuucugaagagcaaagauccucgguggagagaaaggaaacugggaggaggcagggagggggaaggacaggaagaagaccacaggcagguggaaagcaggagaaagauucaaauacuuuguguaacagagccauaggucuuuggaaguuguuagcaaguauucaauucauuuucagauugagccuauaagauagauggggccaauuuacaucccuuguuuauaccugagaaaauaauuuaaagcacaaauuacaugccuaaaaagacaauauugggacuagaaucuaggucgaauucugcuucccuccagaccagcaauuccuaaaccugguuuuauuuuauuuuauuuuuauuuauuuauuuuggagucggagucucgcucugucucccaggcuggaguucaguggagcgaucuuggcucacugcaaccucugccucccggguucacaccauucuacugccucagccucccguguagcuaggacuacaggggcccgccaccacgcccggcuaauuuuuuuuuuuuuuuuuuuuuuuuuguauuuuuaguagagacgggguuucaacauguuagccaggauggucucgaucuccugaccucgugauccgcccaccucggccucccaaagugcugggguuacaggcaugagccaccgcgcccagccccuaaaccugguuuuaaaaucaaaauuacaugggcuucagaaucuguuuuuuguggggguuuuguguguguguguguguguguuuuuuauagggucucacucugucaccaggcuggagugccagaaucuguuuuucuaacaagcuucugcugagaauuuguguagucaguccugguuuaaccuuugacaaccaguacuguggacugggucugcuuuuuuguacagcaguuuaucuaguuuuuugucuggaauuaacccccuugugauccagggagcuaagaauggcacguagaccucuaccagggguggucccauuguguuuuauugguuaaaacaaaaaagaaauguagcccuuaagucuuuggcugaggaaggaacuggaggaaugaggguucaaaaggaaauuugaguuuaucucugccuucauaguaguuggucuuaauuacauuuugaaugucuuuggggaacagguaagguaauaagggggauuuuacuaggugggcaccacccucaggaagggcuuaaucccauuuugaguacucuucuugggcucccuccuggccaagcccuuuuacccucccuaauuugauuauuuccuugcacuuccccguacacucuggccccuuccucucuaaaccuuugucauaaggauaaguaugcagcuugccaguguucaguggauccaacacuggaguugggccuguuaguagaaacaggcuuuauuaacuuuugccaggcucuagaauggagguaguuucauaucagacuuguagugggcuugauucagaaagaaggguggcugaguagauggaagagcauaguauggccuuucccucugugccagcuucuccgucccugcugccucaguauaccugccagccuuuuugcaccgaaggucauuugucugugaugcccuuggaaugggagcagaauucaccuugauauuuuuucucccccagauacaccuaugaagauuauaagaacacugcagaauggcuucugucucacacuaagcaccgaccucaaguugcaauaaucugugguucuggauuaggaggucugacugauaaauuaacucaggcccagaucuuugacuacggugaaauccccaacuuuccccgaaguacagguacuggcaagggaaaguggggaaugggacugagggauguucuuggaauucuguggaacacaaccaaggaggccaauguuucuacuccuugaccuagcauuucacugaagacaaauguuguaagagaggagaaaagcccaccaugagucagagugacuuuaggagaugccucuagcagacaucccauaagagacaggacaugugugugucaguggacugaggcuaagacucagaagagggccaggugacaggggccaaguaaagggcaaggguuguuuauuugguuuacguaauuucucaaauaacuaacuucuguugguuuauuuauuaauuuuuaagauuucuaucuucuuuucccuggagaguuaagaauuuuuuuuuaagaccugucagcaggaaaagaccuuuaauagcuauuuuuuuaaacucuuuaacacaagacuggaagagcagagggagaaggugagggaaauauuaacagagggugugugaagggcauacuucucuaagggagauaguagugacgcuggcuccacuggccacuccuacccccagugagaagggcacugcauuaaaugauaaguggguuaguuuuuuuaagcuuaucaacauguuuauuuuuuauacuccacuuggguuuccuuugucaacuuuauuacuguuuuuguuuuguuuuuuugcauaagcuccucuaucuuugagaauuucucagcucuuccucuugguucuagucccucucccauucccuaagggauagguuggccgucuauuagaagugacugccagauaaaagaaaugguaauaauggcuguuaugucuguggggaguuaucuuugcacucccacgcaccccuccgugggcauguguucccauaggacuguuccgugggucauaaggaaagagacacuugcaugcguucaaauucuuucccccuuguucaguagccucuucuuuaagaagccagaguaaguauacuaugagcuugcuugcuggacugaggaggcagguaauuaaguuagggcaauagauaagaauacauguuuugagaacuuugaaaaauuugaagaggucuauaauuacugcauucacuguacucacuuuauuuugaaacagagucucgcucugucacccaggcucgaguguaguguugugaucucggcucacugcaaccuccaccucccaaguucaagagauucucccaccucagccucccgaguagcugggauuacaggcaugugccaccacaccuggcuaauuuuuguauuuuuaguagagaugagguuucaccauguuggccaggguggucuugaacuccuggccuguugauccgccugucuugggcucccgaagugcugggacuacaggugugagacaccgcaccuggccuauuuuuaauuuuaauuuuuauagauuuacagggguacaaugcaguuuuguuauauggauauacugcgugguggugacgucugugcuuuaguguaaccaucaccugagcagugaacauuguacuuauuagguaauuucucaucccucauccccaucccacuuucucaccuuuccgaguccccagugucuauuauuucacucuguagguccauauguacacauuugguucccacuuauaagugagaacauguaguauuuaaucuuccauuucugaguaucuacuuuuuuugcucacuuuuuacucucuggcaguauggcuuguauuaucuugaaauuucuuuaaaaagcccuuccuucuuuguguguucaugcugaacaugcugaacgcaccccauaucucuaaucuuggguuguauuuguauaauuauuaguaaugccuggcucucucaccagacuuaaacuuucugaaagcagagauaauaaugagucuuuuacuuaauuacaaccuaacauuuugagcagagcgaguaacucacaguaggugcuuaauggauauguguugcaugaaaauauaaucccauucauuucucuuucuguuuuguauacagugccaggucaugcuggccgacugguguuuggguuccugaauggcagggccugugugaugaugcagggcagguuccacauguaugaaggguacccacucuggaagguaagucagagggauagguccgguuggaucuggaagaggcaggagagaacuaucuagccucuuucacuaccuagcuaucugggcuagguggauuuuugguccucuccuuccuuuucuuucacgauguaugucaugcauuucaguguagcugaauuaaugaaauuuuguaaauuuuuuucggauuguuugcuucgaaggugacauucccagugaggguuuuccaccuucuggguguggacacccugguagucaccaaugcagcaggagggcugaaccccaaguuugagguuggagauaucaugcugauccgugaccauaucaaccuaccugguuucaguggucagaacccucucagagggcccaaugaugaaagguauguauguuacuccguuuuuuuuagguggguaggauuuaaagacuucucuaggagcugugggagaauuuuuaaaauuccguuuaugugagauaauucaaccuguguccuagguuuggagaucguuucccugccaugucugaugccuacgaccggacuaugaggcagagggcucucaguaccuggaaacaaaugggggagcaacgugagcuacaggaaggcaccuaugugaugguggcaggccccagcuuugagacuguggcagaaugucgugugcugcagaagcugggagcagacgcuguuggugagaaggggaauuuggcuggaagcuugaagagggagggguuuagcaaaaugggaaggggaaggaguaggaaauaacaggccucauuggacugagaggaucugauuucagggaagggugaauuaaacugacuuauugaaauacaaacuggugagauuugguguagcaucaaaucucccuacgaagcaccaagggguuaacagcugcagugcuaaugaaugaucuauccaugauuugaugacuguuuuuugagacggaaugucgcuguguugcccaggcuggagugcaguggcaugaucucggcucacugcaaccuccgccucccggguucaagcaauucucaugccucagccuuccgaguagcugggauuacagacgugugccaccacgcccgguuaauuuuuguauuuuuaguagagacaagguuucaccauguuggccaggcugguccuugaacucgcgaccucagguaauccgcccaucuuggccuccuaaagugcuggcauuacaggcgcgacgcacugugccuggccaaugugaugacuguuucuaagaauucuaaaaaauucacuauagccaccuucuguaccucuagcuggaagauggaacucuaucauuaggauugaguucaaaauugccacaaauauagaaaugaaggauuguauugguaauuuuaagaaauguguauuuauuuuaggcaauacagaagauaauuuagcugcuucuuuggauuuguuuuagguggggccuugcucuguugccaagguuggagugcaguggcaccaucucuagcucacuacaguucugacugccugggcucaaacaauccucccaccucagccuccugaguaacggggaccacaggcguacacuaccacaccuggcuaauuuuauuuauuuuuugagccgaggucucuuuauguugcccaggcuggucucaaacucccgggcucaagacauccuccugccuuggccucccaauguacugggauuacaggugugaaccacugcacccggccaucuuuggauguuuuuugagauuuuuaauucuuguugaaagcgaggcuaaagggcaaggaaaagaguuauuugaggauccugacaguugguuuccaucuuucucacuaucaggcaugaguacaguaccagaaguuaucguugcacggcacuguggacuucgagucuuuggcuucucacucaucacuaacaaggucaucauggauuaugaaagccuggagaaggccaaccaugaagaagucuuagcagcuggcaaacaagcugcacagaaauuggaacaguuugucuccauucuuauggccagcauuccacucccugacaaagccaguugaccugccuuggagucgucuggcaucucccacacaagacccaaguagcugcuaccuucuuuggccccuugcuggagucaugugccucuguccuuagguuguagcagaaaggaaaagauuccuguccuucaccuuucccacuuucuucuaccagacccuucuggugccagauccucuucucaaagcugggauuacaggugugagcauagugagaccuuggcgcuacaaaauaaagcuguucucauuccuguucuuucuuacacaagagcuggagcccgugcccuaccacacaucuguggagaugcccaggauuugacucgggccuuagaacuuugcauagcagcugcuacuagcucuuugagauaauacauuccgaggggcucaguucugccuuaucuaaaucaccagagaccaaacaaggacuaauccaauaccucuuggauuuuauuuaaugucauaauguugucagaauaaagagaaagaugaaauaauuucauuuuuuuguguaacuugguauggggcuggggcacagaccaagauugacaugaaaggaugugagaucgcaugucuugugugacuaucugcuucucagacaagcaguuaggaacugagaugagauaguaugugagggcagcaaaggaugaagaagggcaaaaugaugaaaggugagguggaaagagguuaugagaugguaaagaaaaguuaacuucuggcacuugauugccacuucugucaggcugguccugccucucucccuugccuucugauuguuucauuuccuguuuauuugaucauaucugaauuaguucacugguuagccucuuccuuaguucccacuuccuuaccaaagcccuaauuauauuuccucuuguuugccuuuucucuccuacucuucucuaacaucugcagccacacucuccauucacuccaugcugacaaggcaguggcaaacacuuuucucugcugccagccacuccacuguugacuggauugcugccagccccaggcaaaccugugaaguuguuucauacucugcuucucuuugagugccuccuucucuccuuccucuuccuuucugggcuccagucuuucucuucacuugugcuugucagaaccucccugugauacugccuccaggcauuucccccauguuggcucaccgcacuauuaucuuugcuuaucaacuugcauucagcuggcuggcauguuucaaaaccacacugcccucccaggccugugugccuuuugagaaagaccagugcuggaugagccucuaguaaugacaacauuuuaguuguuagugguauaauacggaagagauauuuugcacaggcugcuuuggagaacuuucaaauuauccuuuguuugguaacugaccuacuuaacugcccaauacaaagaaaaagca

SEQ ID NO: 192489 - RNA, 8628 nt, Homo sapiens
ugcuuuuucuuuguauugggcaguuaaguaggucaguuaccaaacaaaggauaauuugaaaguucuccaaagcagccugugcaaaauaucucuuccguauuauaccacuaacaacuaaaauguugucauuacuagaggcucauccagcacuggucuuucucaaaaggcacacaggccugggagggcagugugguuuugaaacaugccagccagcugaaugcaaguugauaagcaaagauaauagugcggugagccaacaugggggaaaugccuggaggcaguaucacagggagguucugacaagcacaagugaagagaaagacuggagcccagaaaggaagaggaaggagagaaggaggcacucaaagagaagcagaguaugaaacaacuucacagguuugccuggggcuggcagcaauccagucaacaguggaguggcuggcagcagagaaaaguguuugccacugccuugucagcauggagugaauggagaguguggcugcagauguuagagaagaguaggagagaaaaggcaaacaagaggaaauauaauuagggcuuugguaaggaagugggaacuaaggaagaggcuaaccagugaacuaauucagauaugaucaaauaaacaggaaaugaaacaaucagaaggcaagggagagaggcaggaccagccugacagaaguggcaaucaagugccagaaguuaacuuuucuuuaccaucucauaaccucuuuccaccucaccuuucaucauuuugcccuucuucauccuuugcugcccucacauacuaucucaucucaguuccuaacugcuugucugagaagcagauagucacacaagacaugcgaucucacauccuuucaugucaaucuuggucugugccccagccccauaccaaguuacacaaaaaaaugaaauuauuucaucuuucucuuuauucugacaacauuaugacauuaaauaaaauccaagagguauuggauuaguccuuguuuggucucuggugauuuagauaaggcagaacugagccccucggaauguauuaucucaaagagcuaguagcagcugcuaugcaaaguucuaaggcccgagucaaauccugggcaucuccacagaugugugguagggcacgggcuccagcucuuguguaagaaagaacaggaaugagaacagcuuuauuuuguagcgccaaggucucacuaugcucacaccuguaaucccagcuuugagaagaggaucuggcaccagaagggucugguagaagaaagugggaaaggugaaggacaggaaucuuuuccuuucugcuacaaccuaaggacagaggcacaugacuccagcaaggggccaaagaagguagcagcuacuugggucuugugugggagaugccagacgacuccaaggcaggucaacuggcuuugucagggaguggaaugcuggccauaagaauggagacaaacuguuccaauuucugugcagcuuguuugccagcugcuaagacuucuucaugguuggccuucuccaggcuuucauaauccaugaugaccuuguuagugaugagugagaagccaaagacucgaaguccacagugccgugcaacgauaacuucugguacuguacucaugccugauagugagaaagauggaaaccaacugucaggauccucaaauaacucuuuuccuugcccuuuagccucgcuuucaacaagaauuaaaaaucucaaaaaacauccaaagauggccgggugcagugguucacaccuguaaucccaguacauugggaggccaaggcaggaggaugucuugagcccgggaguuugagaccagccugggcaacauaaagagaccucggcucaaaaaauaaauaaaauuagccaggugugguaguguacgccugugguccccguuacucaggaggcugaggugggaggauuguuugagcccaggcagucagaacuguagugagcuagagauggugccacugcacuccaaccuuggcaacagagcaaggccccaccuaaaacaaauccaaagaagcagcuaaauuaucuucuguauugccuaaaauaaauacacauuucuuaaaauuaccaauacaauccuucauuucuauauuuguggcaauuuugaacucaauccuaaugauagaguuccaucuuccagcuagagguacagaagguggcuauagugaauuuuuuagaauucuuagaaacagucaucacauuggccaggcacagugcgucgcgccuguaaugccagcacuuuaggaggccaagaugggcggauuaccugaggucgcgaguucaaggaccagccuggccaacauggugaaaccuugucucuacuaaaaauacaaaaauuaaccgggcgugguggcacacgucuguaaucccagcuacucggaaggcugaggcaugagaauugcuugaacccgggaggcggagguugcagugagccgagaucaugccacugcacuccagccugggcaacacagcgacauuccgucucaaaaaacagucaucaaaucauggauagaucauucauuagcacugcagcuguuaaccccuuggugcuucguagggagauuugaugcuacaccaaaucucaccaguuuguauuucaauaagucaguuuaauucacccuucccugaaaucagauccucucaguccaaugaggccuguuauuuccuacuccuuccccuucccauuuugcuaaaccccucccucuucaagcuuccagccaaauuccccuucucaccaacagcgucugcucccagcuucugcagcacacgacauucugccacagucucaaagcuggggccugccaccaucacauaggugccuuccuguagcucacguugcucccccauuuguuuccagguacugagagcccucugccucauaguccggucguaggcaucagacauggcagggaaacgaucuccaaaccuaggacacagguugaauuaucucacauaaacggaauuuuaaaaauucucccacagcuccuagagaagucuuuaaauccuacccaccuaaaaaaaacggaguaacauacauaccuuucaucauugggcccucugagaggguucugaccacugaaaccagguagguugauauggucacggaucagcaugauaucuccaaccucaaacuugggguucagcccuccugcugcauuggugacuaccaggguguccacacccagaagguggaaaacccucacugggaaugucaccuucgaagcaaacaauccgaaaaaaauuuacaaaauuucauuaauucagcuacacugaaaugcaugacauacaucgugaaagaaaaggaaggagaggaccaaaaauccaccuagcccagauagcuagguagugaaagaggcuagauaguucucuccugccucuuccagauccaaccggaccuaucccucugacuuaccuuccagaguggguacccuucauacauguggaaccugcccugcaucaucacacaggcccugccauucaggaacccaaacaccagucggccagcaugaccuggcacuguauacaaaacagaaagagaaaugaaugggauuauauuuucaugcaacacauauccauuaagcaccuacugugaguuacucgcucugcucaaaauguuagguuguaauuaaguaaaagacucauuauuaucucugcuuucagaaaguuuaagucuggugagagagccaggcauuacuaauaauuauacaaauacaacccaagauuagagauauggggugcguucagcauguucagcaugaacacacaaagaaggaagggcuuuuuaaagaaauuucaagauaauacaagccauacugccagagaguaaaaagugagcaaaaaaaguagauacucagaaauggaagauuaaauacuacauguucucacuuauaagugggaaccaaauguguacauauggaccuacagagugaaauaauagacacuggggacucggaaaggugagaaagugggauggggaugagggaugagaaauuaccuaauaaguacaauguucacugcucaggugaugguuacacuaaagcacagacgucaccaccacgcaguauauccauauaacaaaacugcauuguaccccuguaaaucuauaaaaauuaaaauuaaaaauaggccaggugcggugucucacaccuguagucccagcacuucgggagcccaagacaggcggaucaacaggccaggaguucaagaccacccuggccaacauggugaaaccucaucucuacuaaaaauacaaaaauuagccaggugugguggcacaugccuguaaucccagcuacucgggaggcugaggugggagaaucucuugaacuugggagguggagguugcagugagccgagaucacaacacuacacucgagccugggugacagagcgagacucuguuucaaaauaaagugaguacagugaaugcaguaauuauagaccucuucaaauuuuucaaaguucucaaaacauguauucuuaucuauugcccuaacuuaauuaccugccuccucaguccagcaagcaagcucauaguauacuuacucuggcuucuuaaagaagaggcuacugaacaagggggaaagaauuugaacgcaugcaagugucucuuuccuuaugacccacggaacaguccuaugggaacacaugcccacggaggggugcgugggagugcaaagauaacuccccacagacauaacagccauuauuaccauuucuuuuaucuggcagucacuucuaauagacggccaaccuaucccuuagggaaugggagagggacuagaaccaagaggaagagcugagaaauucucaaagauagaggagcuuaugcaaaaaaacaaaacaaaaacaguaauaaaguugacaaaggaaacccaaguggaguauaaaaaauaaacauguugauaagcuuaaaaaaacuaacccacuuaucauuuaaugcagugcccuucucacuggggguaggaguggccaguggagccagcgucacuacuaucucccuuagagaaguaugcccuucacacacccucuguuaauauuucccucaccuucucccucugcucuuccagucuuguguuaaagaguuuaaaaaaauagcuauuaaaggucuuuuccugcugacaggucuuaaaaaaaaauucuuaacucuccagggaaaagaagauagaaaucuuaaaaauuaauaaauaaaccaacagaaguuaguuauuugagaaauuacguaaaccaaauaaacaacccuugcccuuuacuuggccccugucaccuggcccucuucugagucuuagccucaguccacugacacacacauguccugucucuuaugggaugucugcuagaggcaucuccuaaagucacucugacucauggugggcuuuucuccucucuuacaacauuugucuucagugaaaugcuaggucaaggaguagaaacauuggccuccuugguuguguuccacagaauuccaagaacaucccucagucccauuccccacuuucccuugccaguaccuguacuucggggaaaguuggggauuucaccguagucaaagaucugggccugaguuaauuuaucagucagaccuccuaauccagaaccacagauuauugcaacuugaggucggugcuuagugugagacagaagccauucugcaguguucuuauaaucuucauagguguaucugggggagaaaaaauaucaaggugaauucugcucccauuccaagggcaucacagacaaaugaccuucggugcaaaaaggcuggcagguauacugaggcagcagggacggagaagcuggcacagagggaaaggccauacuaugcucuuccaucuacucagccacccuucuuucugaaucaagcccacuacaagucugauaugaaacuaccuccauucuagagccuggcaaaaguuaauaaagccuguuucuacuaacaggcccaacuccaguguuggauccacugaacacuggcaagcugcauacuuauccuuaugacaaagguuuagagaggaaggggccagaguguacggggaagugcaaggaaauaaucaaauuagggaggguaaaagggcuuggccaggagggagcccaagaagaguacucaaaaugggauuaagcccuuccugaggguggugcccaccuaguaaaaucccccuuauuaccuuaccuguuccccaaagacauucaaaauguaauuaagaccaacuacuaugaaggcagagauaaacucaaauuuccuuuugaacccucauuccuccaguuccuuccucagccaaagacuuaagggcuacauuucuuuuuuguuuuaaccaauaaaacacaaugggaccaccccugguagaggucuacgugccauucuuagcucccuggaucacaaggggguuaauuccagacaaaaaacuagauaaacugcuguacaaaaaagcagacccaguccacaguacugguugucaaagguuaaaccaggacugacuacacaaauucucagcagaagcuuguuagaaaaacagauucuggcacuccagccuggugacagagugagacccuauaaaaaacacacacacacacacacacaaaacccccacaaaaaacagauucugaagcccauguaauuuugauuuuaaaaccagguuuaggggcugggcgcgguggcucaugccuguaaccccagcacuuugggaggccgaggugggcggaucacgaggucaggagaucgagaccauccuggcuaacauguugaaaccccgucucuacuaaaaauacaaaaaaaaaaaaaaaaaaaaaaaaauuagccgggcgugguggcgggccccuguaguccuagcuacacgggaggcugaggcaguagaauggugugaacccgggaggcagagguugcagugagccaagaucgcuccacugaacuccagccugggagacagagcgagacuccgacuccaaaauaaauaaauaaaaauaaaauaaaauaaaaccagguuuaggaauugcuggucuggagggaagcagaauucgaccuagauucuagucccaauauugucuuuuuaggcauguaauuugugcuuuaaauuauuuucucagguauaaacaagggauguaaauuggccccaucuaucuuauaggcucaaucugaaaaugaauugaauacuugcuaacaacuuccaaagaccuauggcucuguuacacaaaguauuugaaucuuucuccugcuuuccaccugccuguggucuucuuccuguccuucccccucccugccuccucccaguuuccuuucucuccaccgaggaucuuugcucuucagaaaccucagggcacuuacccagaaccccuacacuagcaagaaucaacccguguuacuuuucucccaguuccaaguccaguucucucacauccaucugggaagaccaaacguugcuuucagagguggcaaugaggugugacagagcugaacacaacuaaccaagcuuucacaggaaauuuuuuacuuggaaagcagagcccgggaaaccagacaugauugcacaauacaccaggcuacccucagggaagcaguuggaucagguagguugggggcuggucaacggagccacaggacaauggagagaagcaauuaagcugguaaaauguuaaucaaauggcauccccaaaaggugcaaaggaaaugaaugugugaagcugccgccacauggcaugucuagccacaucucacagcacuuccucauuggcuaucaguccccucaagaacacccuggcucccugggcauccaaaagcaacugugaugccuaaugcaggucacuuggacugggauauccaggacccaagccgagagaagaguuuucaaaggcguggggugggggaagugagcacaggacuguugcucaguucggugacugauuuccgucuccacuuagcagucacuucccaccgaguuaaucauacugccagucuggaaggaagggaggagugcaacuggcaaaggaggugaguaaucuugccucuaaaggaggaacuccgaauuugagcaccaaaaguaccucgcagcuuuacccagacccuagcaugggaauuuaugaagagcgcagggggugaggagaccuccuccugguauggagugagggauauauacauauacucacucuccacuuguuccccuaacacacacacggagacacacaacggcugcuuuuacggaguagcuuagaccgcaccgaccuguccccuuccugcuccgguggcgccaccccagcucgauucccgcgugcgucccugcccgcgcuggcugccgcaugacucugccgccuugcucccgacacuaggcucagugccaggccucucugcauccccugggcgcucgcucccuccgccagcucccucugggcccagugugccagguucccgggucacagcaccugccccuccccaaggguccugcgggccuggugcccuccucacccguucuccauggucucgcagacgccuucucgaugagccugcuccggugugcuccgauccgcuccgauccgaucggauccgcuccgcuaugcugaacugagcaaggcugccgggucugguucgcacaguuggcucacuggucuaggcucuggcuuau

SEQ ID NO: 192490 - RNA, 16387 nt, Homo sapiens
gcagauggugcugucgaccagugucaagaccaaguuucauggguuccuggacgcucagccagggguagucucugaagggccgccuggcaauugggagcagaagccaguuucccgccaucugcucuccguggaggcagugcucucgcggcugcugcccguugggguccagcugaggaaggagcgcggaucccaggcucguucuuugccugggcugccccugcggccccuggggcgggugcugcugcggcgccagcuccaagggcggauccaggcgggaggggccuccucggagaagcggggcgcggucccaacuacgcagaggcuggcacgccgacccuccacaccucaccacgcccccaucuccguccguguacacacacucacacaaggacgccaaccccaccuagaugcaaagcaggauucaaaagaacaucuuugcguuuucuaccggcuccccaucaucguacuagggaggaagaagcgggugagaaacaaaacuucuuuccauuguccugcccguuucugcggacuuguucugaggccgagguagguucacacuccugcuccuccuccuccucucugguagcuucauaaggggcguuuaggccggggaguccuuuccuaguagaggcagcuugggacuccuuggggaggaguuugcgggacggggcuggagagggaggaauggggagggacgugaaagucccguauuuguaugaguuaacgacuuuacauucccacucagguuuacuuugcgcagcugggcacagaugccagcuucuauugauuaguaggcuuggagggggaccacagaaucgccgaaccuaagggaagcccuaggaggccugcacuugcccacaacuaagaaagcuuugcuaguuauucaggcuaaucaccagcuuuuugaagcaggccuuaguuuuuugcaagcguaacuaacauuuggggaucgguguuuucuguuuacucuccucugccuccucacccuuaacccacccucagccaguguugugcaauucuuagagacacuugccaacagccucuucucuaagccuuccuacuggaagguugggauccuccguuuucucgcucugagacagcacgucaaaugcuaauagcagcacaugaguaaagcgcaacaucuuuauuaaaacaauuucagcaccacucagggggcuagggaaaucucagaugagccaagacccucccucgugacaguaaaaaucuuauaaucaagucauaauguaaucaguagaaacccaagggacaucauuaucuguggcacaggaccaccuucccagaagcagccucagguauucaagacuuacuuaaccacagagccacuaacaaguuuugcaagaggauagguuuauuacauacgcuucaauucaagcaauucuuuuacugaugacaagcagaguaaaauaauuuuugaauuuaugguaauagucaauguagguuuccuucgaacagcaacuuucaguggccccuuuaaaguuagcucugauugucuagaaaguacuaguauggaauauaaaaguugugugggcccggcacgguggcucaugccuguaaucccagcacuuugggaggccgaggugggugcaucacaagaucaggaguucgagaccagccuggccaagauggugaaaccucgucucuacuaaaaauacaaaaauuagccgggcacgguggugagcaccuguaaccccagcuacucgggaggcugagacaggagacucucuugaaccugggaggcggagguuacagugaacagagauugcgucacugcacucuagccugggugacagagcaagacuccgucuuaaaaaaaaaaaaaaaaaaaauuguguggugcauuggaaagcuuccaggccggcgaaugcaaugaguuccuugggcaauacaugucucuuucucuguuccucaguuggcucuucuuuaauaugagggguggacagagucucagaggccccucccacucuuguucuaugacuccauggagugguacgauguuaguaacaggacaugaggcacucuaguaauguggagaugaacuaucguuuggcagagaggauggaaaaaaucauuccaggaaaagaggaauggcuuuagcuauuguugaaaacagauaaucagguuauaagcaggcaagaguaagagguuugucaaguuauuguuggaagcauuggucacugugacucaaauuaaaguagcuggauaaaaaaguggaccaaugaaggucagugaaaccuuucuuuaggaguuuuuauugaaucuguauuuaagcagauucucuguaauucucuguaaacaguuauucccggaagaaugccaugaaauacuugggaaagagggaaugggaacaaagagugagugggcacaaagcccagaguugguugaaaagcaaauguuuaauuuuugucuuuguuuggaaauacaggcaugucagcaggacuuuguccccacuguccuucaaucaguaguguugccucuuccuggagacgugguucuucuugccacgugugcuuuuccuucuuuaccuguuacuuccguuauugaauaaguucaugcuuauagaccuaaaguguuagaauaauaaagaaauauagaaauuauuuaguccauucuucccaucaucuaauuuuauaauuaguccuaagacagaaugauacauauauacucuguaugaaggaggaaagugcucuaacacuaggguccuuggaaacaggacccgugcaucccgugucugugugcagggacauuauuggcuugagggagagagagaaaaaaaucuccaggaaaggggaaugacuuucaaguuaaagcugucugaacauuuaaaaaauauaugagguuuuuugcaauuggcgauuccuucauuuguauuaaaauuacugacaaagaugugauguuccuuaaucauagaauauaauuccuuguuguauuuuaaacacaaaugacuaagugcuuagaugcauucuaaugaaauaguaauuuuucccccaaacccuacuuuucauuucaacaaaacuuccuugugccaaguuuaaaagaaaaacauaaaacugucuuuuugcauugugggcagauuguguauccuccaaagguuguccagugaaggcccagaggcagagaagggaccuaacuauauucagaggcugcugguugccccaccucagcacuacugcagaacucuaaaaucagaggcugcucuguuugugugagucggugcuugaauuggugcuucaggccauggggcugugugugugcaggcgcauauggguuguaugcuguggcaggguaccgcuuuucgggacucagaggugguguugcuugagcuaagccuggaaagacaggucaguuuucuccuugcuuaugaaggguucaaagucugacuccaccauucaucugcuguuuguucuuggaguuuccucaugagcagagcauauuuacauaaugccuaccucacacaguccugguguugguugaauguagucauguaugugagagcuucacaaaaugaaagauugcacugaauauuauaauuauugugauuucaagugcauuuguuuuacuagcaggcagccugucuuuucuugacaccuucucaagugcagccagacugaauacuuggcagcuaggugggugacaacagaggauugaggauuuuuaaaaagauaacacuguccuagauccaacaccacugugggcaaaugcugggggucugugaaacaguugguacccugcugcugucugauauuggaaacuaugagaucuauaaggugauccuggugaccuuuggcccacuguuuuuacgcaagcaauggaucuacagcccugcuuugaugauggagauaagcaauuuugcaacuacauuacaaggaucagaagauugaauguucaggguuagucucuuguggacagguaaagauggaagaaggagaaacccaggaaacauggcaagccugcuucuggggguuagaagcugagaaguugaguguagggggaggggcaguguacuaauagcugucacacaaccuucucuggaagugcuuuccuggcuguaugaaaucgauggaauaacgugcuuagcauccguucaugaaaccaaaugaugugauacgauaaauaggaugugauaugauaaaugauaaauaguacaguggaaaagcauccuacuggaagaccauaucuuacucugugacaucuuccaaggcaguucuuggaguuggcccagggagaucagagaugcuaucuuauggauccagacuauuaugugugaauagggaaaccucaguccugccaugaacaagaguaagcaccacagacagcagaaaagggcaacuuuuggacagaaggccauguuucucaaacuuugucuuccagaacaaaucucuaauccauucagguggguuaauaucuaacccaaucaugcccagcgaaaaggugaaugacccuccucguuuguucaagagcaguguccuugguuuucaugucccugccaggacugggacacuauauauuaggaacacuauauaaucagaaccuggagaggccuccagguucacacaacuggaacccaucuccaggaacaaacagcuggaacccaucucccguugaagggaaacugccagauuuuuguaagauucuuccuccuggguaaacuauuguucaauuuguuuuauauauuauuucuagccauccauccauuuuaaugaaaccauuuuccucccuuuaaagccuccaggcucaagcucaugaauuaaaaagaaaauggaucagauucuaaaguuuaaaaugaaaacagguuucuuuugggauggccuauguguggauaaagagaaauuagugagacugggaggaaguggaaguuuaggagggauuucuaaauugugauaaaauccccaaaggccugggggagccauuugcugaaggccaucgggaguccucccccgucguccaccccuguuacaggcauuacacguggcuuaacaaggaaagaaacaguauguuuuuagcauuguuuccuucuaaccuucccugcuaauuucucuucuuagaaaaguuuuggaugcucuuucaaacaaaguggaacacaucccaagaucaaaagaaggcucacuggcagguugaagggaagaaggaaggaaaagcaauaaagggaugaauaugccuuggguguuaggcucuuacuuugggggauuuugcccuaggauguauaaaagugugaagccacauugaugaaaaugauaacuauaguuacucaucauaaacugucaaguuaacucccugguguguaaaauuugaugaaucuuuugaauacugaacauugccuguggggagagggagagaauaauucuugugaauacuaacagauucauuugauacagaagauaaaguuacucuaaagaacaguuggggccaggugugguggcucacaccuguaauccccgcacuuugggaagccgagguagccggaucaacugaggucaggaguucgagaccagccuggccgacauggcgaaaccccgucucuaccaaauacacaaaauuagccaagcguggugguggccgccuguaaucccagcuacuugggaggcugaggcaggagaauugccugaaccugggagguggagguugcagugagccaagauagcaccacugcgaucuagccugggcgauagaacaagacucugucucaaaaaaaaaaaaaaaacaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaggcggagcuugcagugagccgagauugcgccacugcaguccgcaguccggccugggcgacagagcgagacuccgucucaaaaaaaaaaaaaaaaaaaaaaaaaaagaaaagaaaagaaaaaaaggacagagaacagcugggacuaauuccacugacaaaaagcugacagacaguuacguguuuggguacagaaggauauaucuauaggacuuuugccaccagaugugaggcuuugcacccuuggcuuaggcagauucacuuuuacaccacaaacgaucugucucuuacugguuuucucccaauuccauuuuaccuugcuuuuugaggaauuuagaguugaauauauugagaaaguuuugagugagggagcagauguuagauauuggugguuuugguguacgcuugcugagauuugguuccuggaugucuuagggaaucaagauuacaggcccccaacuaaacuuauacaaaauuugucucuguaacugagggucacuggaccuuugcuauugaaacuagcaaagccucuauuauguuuaaugagaaccaugaaacuucagauuuuuagagcuagcaacucuuuuauuuucuugaugaacaaaccuaggccuggagagaaaaaugaagucaauuacuuaaaaaauauuaaggguuauaauaaggcaagcauguugauucaaggugaauaauaugaguucuguggaauauacaccaguaagaaacacuaacaaguaaauacuucauuguucauccacgaucacguggguaauggcauguuuggaaauggcacccgugaaaccugacaacaggucggucuuuauuuugugauauccuuauggguagauucugaacuuuguggcuuuuacuuuggcacuuauaucuaaugagguguccuuggucuuaauaucuaaugcagagcgaguuuggacagagauucuaaacagguucaccagcucauacucccuucugugaacagcaauauccccacaaguuauacagcauuggcaccuccugcaaguacgguauuuccuagagaagacauuaguaacauuccuauccaccacugccaccuaacgacucuuuuagguacuagcagcucugguuccguuuccugauuucugauuucugggauucuggcaccaggcagaagaauguugacuguguaaggcagaccuuugacauuagaagucaguauuuguucauuacagagcaagagacuuaauugauuacaaaucaauaaaacuuuaauaagaucuuccaaaaaacuagaaacaggaaacacacccaggagacugaaaagcaugauguaaaugugaagaacguggcaaguggguggcuuggcagcccagcagcuauacuggagcagcugcaugagugaauacuuguuacuccuuuagggcuggcucuccauucuacaaucauguaccucuuucuugauaaacucccaagaacacacuuucagcauggaauuucagacuuuuagagauagcaacucucucaaguauggacaaaugucggugcggacaaauuugaugcacugcugaagaauaccaaauaauaugcuaaggaauuuuuucauuccacaauaauggaguaaauagcagcuggaaauguuugcauuaaguucauagauuauaauuuguaauggaaucaacaccaaaugcaaauuagaaagagagcccacuuugcucacccagucacgucuucccauguaaccauagaacauugggguccugugucuuucuagauccacagucuugcucucagaacaggcuagccacaccacaggccuagugccaggacccauggccuuuuuuuaagcucagacucccuucugugaacagcaauauccccacaacuuguacaacauuggugcuuccugcaagggcuacagaacuauuugauacgaaaauguucauugacuuacacacaagagaagcacaaaauaaaaaauuaauaauuaauuuaaugucuuugaaaauguaccauuuauuuuuacauuuggggucauaagaauuguauuacacuuaagaaugcaauacaauuugaagaucagauuuuucucccuuugugagaauuucucaguaugugugaugacuaccaagaaaucauagccagucauaaauucagugaguuacucauaaacgaacaagaaccaccuacuucuuggggagguaggucugcuucccuucaacucaggauacaacugcuuucaacugcuuucuucacauuagcugacuaauuagcuagaagccugucguaaacaauuuuaugguugacuccuucccugggcucaggguucccuagaacagagguccccaaaucccggucuguggccuguccgccuaagcucugccuccugccagaucagcaggcagcauuagauucucauaggagcuggacgccuauugugaacugcgcaugugcgggauccagauugugcacucuuuaugagaaucuaacuaaugcuugaugaucuaucugaaccagaacaauuucauccugaaaccaucccccaccaauccauagaaauacugucuuccacaaaaaugaucccuggugccaaaaauguuagagaccacuccccuaaaacucucuucuuagcucucaccuccuguauuacuaucucaucucaguacauugaagcccccaucuuuuccccauggaugccucauuuccuauuagggaggcauuuuuuuauuuuuuguuuuuauuuuuuuccgagacggagucucgcucugucgccaaggcuggagugcaguggcgcgaucucggcucacugcaagcuccgccucccggguucacgccauucuccugccucagccucccgaguagcugggacuacaggcgcccgccacuacgcccggcuaauuuuuuguauuuuuaguagagacgggguuucaccgugguagccaggauggucucgaucuccugaccucgugauccgcccgccuuggccucccaaagugcugggauuacaggcgugagccaccgcgcccggccgucauuugguaugucuuaaugugccucaggaccuagcacagucccugguacccaguagagaccuauguaauguucauuauucaauuaauaaauacaugaauuaaagagugagaguggauuuuguaauguuacgacugauagagaaauacucagugauucuaagggauggggaagaacgguuggagcuagagguugugcucaggaaacuauuaaauagacguuccgcaggaagggauugacgaagugugagguuaaugaggaagggaaaauagaauauaaaauuuggugguggaaaagaucugauucaugaugccgugucagagagcaaagcuccuguccuuuuggccuaauuuggugaugcuguucuugggucuaccacaccuccuuuugcccuccgcaggagccuguguuggaagagauggugaugggccugggcguuuuguuguuggucuucgugcugggucugggucugaccccaccgacccuggcucaggauaacuccagguacacacacuuccugacccagcacuaugaugccaaaccacagggccgggaugacagauacugugaaagcaucaugaggagacggggccugaccucacccugcaaagacaucaacacauuuauucauggcaacaagcgcagcaucaaggccaucugugaaaacaagaauggaaacccucacagagaaaaccuaagaauaagcaagucuucuuuccaggucaccacuugcaagcuacauggagguucccccuggccuccaugccaguaccgagccacagcgggguucagaaacguuguuguugcuugugaaaauggcuuaccuguccacuuggaucagucaauuuuccgucguccguaaccagcgggccccuggucaagugcuggcucugcuguccuugccuuccauuuccccucugcacccagaacagugguggcaacauucauugccaagggcccaaagaaagagcuaccuggaccuuuuguuuucuguuugacaacauguuuaauaaauaaaaaugucuugauaucaguaagaaucagagucuucucacugauucugggcauauugaucuuucccccauuuucucuacuuggcugcucccugagaggacugcauaggauagaaaugccuuuuucuuuucuuuucguuuuuuuuuuuuuuuuuuuugagauggagucucacucugucgcccaggcuuaagugcaauggcacaaucucggcucacugcaaccucucucuccuggguucaagugauucuccugccucagccucccaaauagcugagauuacaggcaugcaccaccacaccuggcuaauuuuuguguuuuuaguagagacaggguuucaccguuuuggccagguuggucuugaacuccugaccucgggagauccgcccaccuuggccucucaaagugcugggauuacaggcaugagccacugagccgggccacuuuuuccuuaucagucaguuuuuacaagucauuagggagguagacuuuaccucucugugaaggaaaguaugguauguugaucuacagagagagauggaaaaauuccagggcucguagcuacuaagcagaauuuccaagauaggcaaauuguuuuuucugucaaauaauaagcuaauauuacuucuacaaauaugagaccuuggagagaaguuuccaaggaccaaguaccaacauaccaacagauuauuauaguuucucucacucuuacacacacacacacacauauacacauauguaauccagcaugaauaccaaaauucauucaggguagccaccuuuugucuuaagcgagagauaauuuugauguuugaauggaaugcucccaggauauucucuugucaugguuauuuuauauaaaauucaaaaaccaauuacauuauuuccucuguaaucuuuuacuuuaucaacuaaugucuggcaagugugauguuuuggggaaguuauagaagauuccggccaggcgcuguggcucacgccuguaauccagcacuuugggaagcugaggcggacagaucacgaggucaagagaucaagaccauccuggacaacauggugaaaccuugucucuacuaaaaaugugaaaauuagcugggcgugguggcacacaccuauagucccagcuacucgggaggcugaggcaggagaaucgcuugaaccuaggaggcggagguugcacugagccgagaucacgccacugcacuccagccugggcgacagagcgagacuccaucucaaaaaaaaaaaaaaaagaaagaucccaguuuaucccaguuuaucccuuauucuuccucaauucucaagauuuguuuuuaaguuaacauaacuuagguuaacacacucuuuguaaaauacacuguucaaucuacagacucagugguuagcuuccuguuaacuaauuucuguugacagguacuuggauauuuuauuuagaaagugguugccaauaaauuaguuauaagucgccaguuucacugccuugugaacacauaauuauuguggucucaguauucccuaugguggcuucuccugcuccugguauugcccugaaaugggccaaaagccguggcuccccaauacucagguuauagaacauuguccagguaccaccuaggagagcccagccucacugaaaguauucaaauuuaggaauggguuugagaaguagguagcugguaugugcuuagcacaagaaucucucuuccuuggguuagucuguuucaaaacugaaaacacugucauuccuuaagaaaauaggaaaaaguauuccaaaccucugucacuagaaaauuugccauauuaccaaaucucaaaaaccucucaggaaaugagaaagucccaguuucugguaaacuauuugggcccuuuucucaaguucuccaaccagugcuauuuccuugaggugaggcaaaguuacucaagaucaucgcugccacucaaggccuugauagggcaagugaaaggcauggaccauuauuauauugaucacagcauaagcugugaaaacccacaucuucuccaaacaucugcuuggagcauuaucaucgcauaguuugcucugguguucagggaaaucgcuguuucauaggaaaucacauggcagugggaugggaguguuuccugaccugccgaugguacuggcaccugagcaagcauuccuaguccuuuuuggucugggccucuuguucuaucacaaccacaagcuguuuaaaauaaaacgucaagucacaggcaggucauuuuauccugcgugaaucaauugaagaauugaaguccuggucagcugugauuguuggcuuugcaaggaaaaagaaggaacacuccaaaaugcuaaaugcuuugaagaauagugacaugcaaggaagaaaauuccaugcaauuuggagaagaaacauuuuucuaggaaucuaguagcugagauauuuuauaguuuaaaaacagacuuccaauaucuugagaauacaguuagcucuacgaaauaaagaggagucaauaauauaugcaacucuguagucauucauuauuuuauccagauugacagaagcagaggaaaccaagaaaaauggaagugguaaaaaaaaaaaaaugcaguaauugccaauauuuacugagcauuuacccugugcuaggccuuguuauaggcgcuuagauugauuuucuuuucauaacaucccuaagagguagguauuacaugcucauuuugcuuaugaggaaaucugcugagagagauuaaguaauuuucucauggucacagccucagucuuuuagaccacggugucaaaagaaguucuuacugugagucaggguggugcaguggagaaagcguuuggggaaaauccugacccaaaagugugcguugggaugauguggagaucauucaauuuucucuuguagcuacagcuuugagaugcacccauugguauccacacuggccugcuguccucaaauauuucucuaugucuuguuuacuugaguagugcagaaaagcugacguccugggucugcucucgcaugcauaggugagguuuucucuguagcuagucaucuugcuaaaccauauuuuuggucacaaagaaucaggaugagagaaaguagauaaaaccauggaaacucgaggugccaccggaagagcaaaccaaaguauauugaucugcugaagcuauaauccaaguacuaaguauaccuucagaaguuguaugcauuguucuuggggcaaaaaggaaaucaaacaucugcccuuccucccacaaccucuuuacuucccucucuuccuaacacuguaucucacaucuacagcugcaggcacacagauaugacauacagcuugauaucuuuaugugcaaaggcaaaagauggcuauggauauaggagguggcauuuaaaagaacaauauccauguuugauacugcuuucauuaucaauaaugaaaagguagccuuucagcagaacaaaguaagguacaggucguuuggaagccauuucagucauucacacagugugauccaccauuacgaagcagaauuugaaaucaaaagacaauaguacccauauacaucaaacuaggaguucaacuggggucaguccuuggacugcacauacagaguugggcugccugacucucaaaacauugcccuugcuaauuugcguugcucacuuccuauugaaucagggaugauuuuucuuugcuguagugaaucagcccugcuacacugcaagaaucaagccgauucacaauucacaucaauuccaggagugacggccagauggcagcaucuggcuagucaguuggugagugaguccaccuccagucuugauuaaacucugcugcugggaaguagcaauucugagcauaaaugucuuugauauccugaauauuuugggugugggaugagagaggcaguagauaguggaaagagcacaggguguagacuaagauaggccuggauuccuuucuuuaaucugucaaugaaagcaaugaauguucugaaacuacauggcaaugcuuuuuuuguugccacucuggcuuuuuuuuuuaaugcuauaaaauauaugccuauuuuucacugccaagaggugacaacacaaugaugcugcaaccagagaagacagacagcuaccaacaacuauugacaagacagaaggaacaucaagaauagaugcaagacaaagcaauguaucuccauggccuagauuuuuuagguuaugcauagaaacagcaaggagaagaagacacaauccaaguuuucuuuugagaauauugugcuguuuaaauuuauuuuuuaaacauuucuuagcuuuucuuauuagucaauuucauaagccugggaaacaucuuuacucuauccauuuaauugcauuuguucauuagcuuacucauuucacuuauuaguucauucaaacaguagcuauuaucaacugucuucuaagaacuguaacuggguauucugguuuugcuuuuuuuuaaaaaauagaauuaaaaggauuuccaaaaggaccugauuuuacauuagaauuagaauaauacauuuuaaauuaauguauaacauauauuauucuagaauuagaauagauuuuaaaucacauuagaauaauagccacaugacaaaaaagaaaagaaaaauaauaaaauuaaugacaaagaaaaacaauagucaugugagaggaaaggcaaagccuaaauauuccucuguccucuuccuccaccuagauucccagauguaagguauuaaaaguaguuuguaaacuuucugugacguaugcugagucuauccaaacugucgggaauuggagccucccgggaaccaaacacuccccaaagaucauacaccuacggaguucccccaagagacacacaacugcaguuucauguagguucaccuuuucucucuuuuuauacucuguccacacaaaccuggcagccacgcagucagucccugcccugugucauuguacuggccacagcaacuucucucuguaaaugagaaaggucuugcuuucagaaaagaucauguuugcaaacuacucacucuugaggaagaagggugggaaaaguagcagagaugaguggggagauggugcauauaagaaggaggaaagaggagacuauggagucaggaugccggcuugcuauucucaacaccuuuuuccagugcccaguucuuaccuuauuucuccugccccuugcuuucuuuucuaggcaccucuaagauacugauggcucugcagaggacccauucauugcuucugcuuuugcugcugacccugcuggggcuggggcugguccagcccuccuauggccaggauggcauguaccagcgauuccugcggcaacacgugcacccugaggagacagguggcagugaucgcuacugcaacuugaugaugcaaagacggaagaugacuuuguaucacugcaagcgcuucaacaccuucauccaugaagauaucuggaacauucguaguaucugcagcaccaccaauauccaaugcaagaacggcaagaugaacugccaugaggguguagugaaggucacagauugcagggacacaggaaguuccagggcacccaacugcagauaucgggccauagcgagcacuagacguguugucauugccugugaggguaacccacaggugccugugcacuuugacgguuagaugccaccauguagggauuaucgcgagugguugaccuuacacuuacuccuuaaauagcagugaguaaugcauuugagcugucccaggcucugucuccucagcucauuuccuacucuuuuucucuauauaacucauucuauuaaauacauugcaccaaagagauauggagacauaaaccuguaaugaaugaggcugggcuuuucuguaauaagcuuccuuuuauaauacuggucagcuuagcucucucagauccuauccuguggaauuuaguuauuauguguauuuauguaguauuucaaacauuucaaaaugcuuucaucuauguuuaucacauuuuaauaccacagcacuuauaaugaugucacuacauauagaagcucaaaguuaagggauuugcugaagacuguaaaguuaauggaagaauugagacaaaaauccaguguagcuggccacuuauccagggcuuuuucuacuucaucacaaggaauguuuugaaagugucugcuuuuuuuauccuuaaaauucaccugucagggaggcauuaaaaauuuggaaauguaugccagcaaaaugugagcucuguauuuuuuggcauucuuauguuuggguuuaauaagauuaagaaaaugauacugggaauuuucuuuuuccugaaacuuugaaucacccuaguaagucaaaguacuaaaaaauguacuagaucauuaagacuuaugugcucuuacugauugaaagauuuuuuauguuuuccuuguaauaaaggaccuaaaccgaagguaccuga

SEQ ID NO: 192491 - RNA, 42676 nt, Homo sapiens
uuaggaacauaaacuuuuauugucauccagcaccugugauaguuucaugucucucuaaaggagacaggaaauuggagcauugugggcccuuuuaaaagaaaagaggaguagguaggcacacccaggugcuucuaaaacaaccaagcccaaaccugacaugcuccuccccacagucaccuucauuguccccuuuaaaagucuggaacaguauguagcaaaacaaauaaauuacuuuucauuucaaaaaguaaguucaaagguugaagcugccuaggccaggcuucuggacaggugccuccaaagaagugagcuuuccuuuucaacuuccuuagcucuagccaguagaccagaaaccccugcuuuccacaucaggauuccagaugguguuuaguuagauuugggaucccguugcuugggcaucucuccuccaucuuccaaauccauuucugcagcaacugacauacacaggaccuggagguaccuuguggcagacccuacaaagagaacuuugaguuggaauugagaagaggucagcugggcugaguucaagugucacugaauggaacucagugugaggggagugauuccacuaagccgaaggguucauaagaaggggcuaaggcaaagaugucuuuggaggcuggauuuacagaaaaaggcaaaaaccaagcucugcaauagcugagcggacuuaaggaugcacggcuuacccacgauccuucggagguaaagcggucgcuuauguucuggcacucugaugaugaggaaguaaaagggcaggccugagagggcaauggcaaugccgaugagggaguugauaguaucacuguaaaguggaacagccaccaggaagauggugcagaggcagaagacaaucgggaagaaaacgcugagcuaagggcacaggaaacauaacuggaguggacaacucaggauucuuaacagcuaaaauaaccccaccucccauaaggauuagcgcacugagccuucuuuccauaccuuuaauuucaacacauuacuaacgaccaagucccaggcaaagguuucuaaauaaagugcuuugucauagucccuuguagcaacaacuccagcuguuucagguggagcagagguaggauggaguugccuuaccuugaggggacgaggucgaucaggcuccuuccagcgcagauaaagcugacccacaauagaaagccccacaaagaaccaguagcugaagcuguaguaguuaaugagcuggaagaugucuuccacgcacaaguagaucaaugccaugauacccuguaagcgugagccuaagucagcucuucucagggccuuuguuaauccaaaggcuuuucacucccuuuauaccccagaaauccauccccugucaauccucaaagucuccugguccucuucugguuuuaaucccuuuaacacccuaguuucaguaccuuauccccucucuuauaagucaguagucucaacuggcuuuucaacccauucuucaaguuaacccuguauaaagcaagcucgaaacaaucccucaaaagucuugcauaggacccuuuccauaauggcuccaaccuacaauaacccgcucuuaucuccuccuacauguugaguaucccuguucugaaaauccaaaaugcuccaaugagcauuuccuuugagugucaagucagcacucaaaaaguuucagauuuuuagagcauuucagauuuuggauauucagauuagggauacucaaccuguauuaaaacccauacugcuuuaucacaggauuuucugaugcuauuucuccuaccuaaagcccaucucuaccauuugcaacccuagccaucaagaugcacuuuuuuuuucugagaacacuuugguggauuuuaagacacacacacacacuucuagauguaauucuucacccucuacucccauggaagugaucguuucuucucuuaaacaccguaucacucacuaucugucauggcaaucaaucauuacaguguauuccauguacuuuuugccuuaucuuagagcagagguguaccauuccuuagagcauuuggauuuccccuguagcgguuagcauagugccuugcccguggugaacauucugauccaccaauaguuuuucuauuggaaucuuucagagcuuucaggaagcuagaacagucgcuucugcuguuacuaaaguuucccccgcaaucuggcuuucagucucauccuugaguucacuuacauugaagagcagagaaggcacuggugugaaccgcucaacauggaucaugcagauggcaucagggagauggccuucucuugagcccacaaagaaaagccuauguuagguaagauaggagaagcugagaaaauugguggacacggugcagccugguucaccugccacauggcccucccucucugccaucccuuccuucaaaaguauuuggauaauauggacuggagcucaguauuaagauuaaugacaacugcaggcuucugcuagaaacaagaagaaagagguugugguaucgguuggagaacacaaguaaucaaaggcuggguccuguaaguucuguccacugcauagcccuuugaugauacaccccucacaaaaguugccacucuuaccuagaagcagccacaauggaggcauugaggccaccaaaacaggauaaugcaacugacaguggaauuauccaguuaaauauuccaaauaucugaucugcaaaagucuaagggaaaagaauggaagagucauuagcaggaucuaaaagggaugaaagacauggaugggcaugcccccagauuccccuuauuagguauuccaaccuuucuuccacagugggguuaacaggaccuucuugcaagcccgguauucuaaaugaacuccuuucaaggcugucuacccccuuuccaggacuuucaagagccagaauauacccaguaccccacaagacacccucaaccuucugcuagugaaaauccuuuaccacagcaacagcaucacuggccaagaugucucucaugucuagcacaguauaauaggccacauuggucaagauauagaugauggugacaaugggcauggagaugccaauggagaggggcagguuccuacagccaaauagaauaaaaugcacauuagucccacagucauaucccuaucucuccuuuaauccuuagacucucccugccacaccggucuuuccagggauggagacuguugcuacauuuccucaaugcauuugucuuugacggugcccuggauaguggcugaagcucugaacacuuaagaacuaaagaacauuaggggaaaggaauaucauauuaggagacaggacugugcagcugggagcaguggcucaugccuguaguacuaacacuuugggaggcugaggcagggagauggcucgagucuaggaguuggagaccagccugggcaacauggcaaaacccugucucuacaaaaaacuagccaagcagcugggcgugguggcucacgccuguaaucccagcacuuugggaggccgagccggguggaucaccugaggucaggaguucaagaccagccuggccaacauggcaaaacccuguuccuacuaaaaauauaaauaauuagccaggcaugguggcaugcaccuguagucccagcuacucaggaggcugagguacgagaaucacuugaacucgagaggcggagguugugguaagccaaaauugugccacugcacuccagcaugggcgacagagcgagacucugucuccaaaaacaaaccaaaaaaaaaaaaauuagccaagcgugguggugcaugccuguaaucccagcuauuugggaggcugaggugggaggaucacuugagccuggggaggucaaggcugcagugaaccaugacugggccacugcacuccagccugggcaaggcagccagacccugucuaaaaaaaaaaaaaaaaaaaaaaaagcagggcgggggggauuaacaaagacuguccccagcaucauaacgcacaggaaaaugggagguuguuuuguuuuauaccccaaagaucuuuuggugucaggauuccaucucuaagauuaucaacauuggcaauuuugccucaagguugagaaauauaaaaagaaauuauggaggcaaauugugaaauuuaacaucuucagagaauaagauaggccuucaguaggaagagaaguguauguaucugacuagcagccuggaagauaugucugcccaccccuuccucaguuugagaaccucaggagccauccuaacuggugggcaaaagaaagaugcaaagagcucucaaggucccuguagcccaauaaagccaugaucuuuauaagcauccuuaacaguaaggcugccaaaaaaaaagcacaaaguggggcaaauacucugcaaauagagucaugcaguuucuguccgguagguggaaguaccacccaggccuugauccugcuucuguuaucucuguucccauagcguuaccacuaguuguguaccaagagugcucuucuguuucucaagccaaaaggaguuuauugguauaagaauugugauucuuuucacuuaagcauuuacagaaagcugggcacaguggcucaugccuguaaucccagcacuuugggaggcuaaggcgggcggaucaccugaggucaggaguucgagaccagccuggccaacauggugaaacccaugucucuacuaaaaauacaaaaauuagccaggcgugguggcaggcaccuguaauucuagcuauuugggaggcugaagcaggagaaucacuugaaccugggaggcagagguugcaaugagccaagaucacgccauugcacuccagccugggaaauacagcaagacucucuccaaaaaacaaaaaacauuuuaccgaaacuccacucccuggcaaaucuuaguucccagaaucauagaauuuuagagccaggaaaggccauggagaucacagaauuuaacccccucaauuacagauaaggaaacaggcaaagagauggccgggcaacucccucaagguuagccaacaagucaguggaaagaucaacucuagguccuugacuuccuguccaguucucuuuucacucuauauauagacuacagagcaauaaugguagggugacuuaauugaaugacugaaacuauaccacaaugucaguaugaauuuaggaaacaaggaagguaucagagggaaacacaggaagguuucuggaagucuauaucccaaagcuauguauguggggauaaggguggauaaaauaucuaucaaggaaaaucuguuuuaaaaacauacauaagcauauaauacaaccugcuuuaauuaaugcagaaauuaaugaacaaauguaaaaaugccuuuaaaaauuuacaaagcauacaugaguaaguucauauuuuagcccuguuacugugaucauagacaaguuacuucucugagccucaggccucccaucuauuaaaaugaggcugguaaaauuaaccucauagugguugugguaugcugucuggcacguaguaggagcucauuaaaugauggcuaucacugcuauggaaaguugguggugcaguaccuaccucucaggauucuugaucucuucagugacauaguugagggugucccagccugaguaggagaacagagcugaguacagugccagggcaaugucacccacugcaaaugaugaacccucaaaggaauucucaaaaugaguagaggcuccuggaacccaagaacauuggaaggcaggggauuaguggcucauucucccacuucaagauggucaaguaaaggacugacagaauaugguaauauaauagcagguaaguggccuacaacaccuuuggcagcaagaguaccaguaagggaacaggaaacagaagagagacgucuauagagauagaccagaaugcccugcauccuaaugacauagauggggaucuugacaggaaggguccaggguagcuuucuaggauaagaaaccaccauagagcagaaaagcuggagaauagaaacaaugcaguucuguucugcucugcaggcugccugauuccugccuccuaucacaaucugccaaaggcagcucccagggcauggcugucaacccuuugccaagaucagccuccucugggaggcagcgugcauggaaguuaaaggacagacuuuugggucaguuguccuggauacaaauuucaacuccucuacuuaccgguagcaacuugggcaagauauuuaauucuuuuuuuuuuuugggggggggacagagucucgcucugucgcccaggcuggagugcaguggcgugaucucagcucacugcaaccaccgccuccuggauucaagcgauucuccugccucagccucccgaguagcugggauuacaggcgccugccaccaugcccggcuaauuuuuguauuuuuagucgagaugggguuucaccaucuuggccaggcugaucuugaacuccugaccucauggauccacccgcgauggccucccaaagugcugggauuacaagcacgagccacugcgcccggcccaagguacuuaauucugcaggcuguuuccucauccauaaaaugagaauaauaauagugcccaccgaauaagguuauaguaagaaaugagauaaugcacaaagagcacuuagaggagugcggcucacagaaaaugcuuaaaaaagauuaguugcuacuaauauuauuucuuacccuggccaagucuaacaaugccugcaacgaugaccgcgaucagugccaauacuuuagcauaggugaaaauaucuuguaccaggguuccccauuugacauaggcacaguuaaugaagguuaagagaccugaaagaaaaauaauacugauuggugacuuacccuuaccacccuagggccuuagacucccaagcaauuuuuccaguaccagucaccaagauauauauacccuucagccaaagacagacccucugaccugcucugcacuggaacccucggggccccagaauguccucaccauuaucauacaaaggccucuauacuccccacccccagcaccuuauaugggagacacaaaacaaagugacugcagaucugcuuacauaaaaaauacauccaaauguccaaucacagcagugggaggcaacugggaacuguacaggauuagugauuguuccggcucuuggcucugaaaagucauggucucucccuccuaccucccauuccccaugggcuccaggacacagcacucugacucugugguauuacuguuaaccuugaggaguucugcugugacuuauccaaugcugagccagcaggucaggcuguguggccaaggauuaggaugaaggccagacuuccugcccacugccuggcagcucagcugccugcuuuugugcuuggaaagauucuugcagcuaagagugguuccuguagaauggggacagggcauuuuuccugaugggacaauagagaaguaagagccacacacauucccccaguccuucuacucagaaguacagguuuuaaaaguaccuuuuaucaggguucuuaacuagggccuccaugaggcucgaaauucucuuucaaaguguuauguccauaugaauacagacauaccuaagaaaaaguuucauaucuuuucuuagaaagggaucauagcuuuuaucagaaucucaaguccauuaucccucccccaacaaaaaaguuacaaucuacgacuugaauuugaauuacuugaagaaguucaacaagggaggcucacgcaugcugugagguugaccaguagccccagaauguggccgagaagaaaguuggaaaaaaaaauacagaucuucccacugguagcauagcgaaucgcuucauugcucccuccuucccagcucagcaacuggaacacuauaaggagggcuuaacuuuaaagcccuucucccaagggcuccaagggcaaggucaacaucacccugccuuaccagucaagagaaugaggccuaguacaguucuugccuacuucaggccaccaacacagucagaaacacccucugaguucuccuggcagugguguggccuuggugucgcuaguccuccuauuuugugguguccuggccucaccacauucuggcuacuucauccugagaagcagggaagucuggccucucagaacagcugccccaucuucucucucucacccucccuuccaccaccacccucauucuacugacugcccaaguuccuuucugcucuuccugagaaggcacauuccuguccuauauaaaugcuugccuuucugccuaauaaacaacaaaccuuaucacagggcugggcaaaaauguacccacagcuccaggccaccccagugcuaaguuaauaauuuaagacacaagugugcagcaccccacaaaaugaccaaaguggcuguaucuugcccuccacaaaucuuucaaaucugucacuccuccucagccagucacccauccuuuacuccccacuggacuccagccuccagccacucaacagcuuagugccccuucuccccagcuuguaaccucugcccuuauccuaggcucugcggcuggcucauaaccacaacauagccagguuuccaaguagaaacaccagacacaaaggaugcugccacauugucaggaaaaugggauccccaaauacaaauuuaugauucccugcaggguaaccaugagucauaacaccaaacuggaauaagcuuacaggacuagcucuaguucagacucagagucugagcugugugccacaagguucuucucaguucuguccagggauguaggcagggaaaaggagggauaagcaaccaauucaccaccugcuaccacagcagauucugaaauggaaauacauggcuuguuuauauuuuauuuuauuuauuuuucuuuuucuuuuugagacagaguuucacccuuguugcccaggcuggagugcaauggcguggucucggcucauggcaacaucugccucccggguucaagccauucuccugccucaaccucccaaguagcugggauuacaggugugcgccacuaugcccagcuaauuuuuauauuuuuaguagagaugagguuucaccauguuggccaggcuugucgcaaacuccugaccugaggugauccacccaccucagccucccaaagugcugggauuacaagcaugagccaccgcgcccggccuauauuuuauuauuuuuuuuuauuuacuuauuuauugacuuauuuauuuauuuauuuauuuauuuuauuuauuuuuugagacacagucuugcucugucacccaggcugaagugcaauggcaugaucuuggcucacugcaacccccacuucccagguucaagcaauucuccugccucagccucccgaguagcugggacuacaggugugugccaccaugccuggcuaauuuuuguauuuuuaguagagaugggguuucaccauacuggccaggcuaaucucgaacuccugagcucaggugauccgcccaccucggccucccaaaaugcugagauuacaggcgugagccaccacacccgucccuuuuuguuuuuuuuuuggagauggggaucucacucuuucacccaagccagaguacaguggagaaaucauagcucacugcagcaucgaacuccugagcucaagggauccucccagcucagccacccuaguagcugggaucaaaggugugcaccaccaugcccagcuaauuuguuuuaauuuuuuuuuuuuuugagauggagucuugcugucacccagccuggagugcaguggugcgaucucagcucacugcaaccucugccuccaggguucaagcaguucuccugccucagccucuugaguagcuaggacuacaagugcccaccaccacaccuggcuaauuuuuguauuuuuaguagagacaggguuucaccauguuggucaggcuggucucgaacuccugaccuugugaucugcccuccucagccucccaaagugcugggauuacaggugugagccaccgugccuggcuguuuuaauuuuuuuagagacggggucuugcuauguggcccaggcuggucucgaacuccuggccucaggcaauccuuccaccucagcuaucugaggaguaacugggauuauagggaagagccauggcaccuggguggcuuguuuacauuuuaaucccuauugcuucucuacuucuuuuuuuuuuuuuuucgagacagucuugcuccgucccccaggcuggaguacaguggugcgaucucagcucacugcaaccuccgccuccuggguucaagcgguucuccugccucagccucccgaguagcuagaauuacagacauucaacaccaugcccagcuaauuuuuguauuuuuaguagagacaggguuucgccauguuagccagacuagucucaaacuccugaccucaggugauccgccugccucagccucccaaagugcugggauuacaggugugagucaccggcguggcgugcccagucucuucucuacuucucuauccauccauuuguaucccucucuuuguccaccaguaucccaccucccccacuccugagccugauuucucugacccaccuucuagcccugaucugcucucuguacugagcacagaaggcucaguuugaaugaggaagggaauccuacagaaagaaaccagggagcagagggaacugccugaagagagcuagcccuccucuuccucaaagccuagcuuccuccagggccucuugacugugggagcaggaaauggguauggcaggcagcagugcugacagggcuuuuuguccccaccucagcggauacagcugaccacuggccccagagcccagcuaagugcacugcucuugaaguggagcccaaccuccugcuucagggccaaggacaggaggggaccaugggguuaggauaauauggaggcaacugcaaguuaaccucaagggcagagaugcccuccccuucuaccucuaggggcaauucaauccccacccaacacugggccaagucuauaagaggauaaccugaaaucaccuuugacccuugacucggugcagcagcacuccugcuuugaccccagggggagaaaaaaagaaucugcaaagaagucacucguggccgggugcaguggcucacgccuguaaucccagcacuuugggaggccgagguggacagaucacgaggucaagagaucgagaccauccuggccaacauggugaaacccugucucuacuaaaaauacaaaaauuagcugggcaugguggugugugccuguagucccaucuacuugggaggcugaggcaggagaaucacuugaacccaggaggcggaggaugcagugagccaagaucacaccacugcacuccagccuggugacagagcaagacuccaucucaaaaaaaaaaaagagaagucacuccuauaaccaucuaaaaagauguuccugaauggaucaucaaacccagccuacauacgguccccgggaguaggagacuaguucuagugguaaggcccagcaucagcgcuagaacuaaaagccagaaagcaccagaccagguggauccagaacagaacaaagcuugcaggcccacucuggaucagaugcucagguuuaguuuagacaccuaaaugaaacauuuccugaaaaagaacauuaaacccacaauucuguaagcacuauuaccuuuaaauacacacaauguaacacacaaaacuuaugauuacaggcgugaaccaccaugcccggcgucauuccauuuuaaaagugaucuauagagccaggcgcggugguucgcgccuguaaucccagcaccuugagagacugaggcgggcagaucacuugaggccaggaguuugagaccagucuggccaccauggcgaaaccccgucucuacuaaaaauauaaauauuagcugagugugguggcgcaugccuguaaucccagcuacuuggaggcagagguaggagaaucauuugaacccgggaggcagaaauugcagugagccaagaucacgccacugcacuccagccugggugacacagugagacuccaucucaaaaaauaaaauaaaauaaagugaucuauagcucuuccuuuuacuaagccaacagcgucuuccucccagcuucuaccaguagugccagaccccuccucugucuccacacagaaugaagcuaaauccucuuccacccaauggcccuucuuaacauuaaagaugaauaucacggccaggcgcuggcucacgccuguaaucccagcacuuugggaggccaaggcgggcagaucaucugagguugggaguucgagaccagccugaccaacauggagaaacuccgucucuacuaaaaauacaaaaauuggccaggcgugguggcacaugccuguaaucccagcuagucgggaagcugaggcagaagaaucacuugaacucgggagguggagguugcggugaacugagaucucgccauugcaccagccuaggcaacaaaagcaaaacuccaucucaaaaaaaaaaaaaaaagccaggcgcgguggcucacgcuguaaucccagcacuuugggaagcugaggcaggcggaucaugaggucaggagaucaagaccauccuggcuaacacggugaaaccccaucucuacuaaaaauacaaaaaauuagccgggugugguggcaggcgccuauagucccagacacucaggaggcugaggcaggagaaugacgugaacccgggaggcggagcuugcagugaaccgagauugcgccacugcacuccagccugggccacagagcgagacucugucucaaaaaaaaaaaaaaaaaagccaggugcaguggcucacgccuguaaucucagcacuuugaaaggccaaggcggguggaucacgaggucaggaaauugagaccagccugcccaacauggugaaaaccugucucuacuaaaauacaaaaauuagccaggcaugguggcacaagccuguagucccagcuacucgggaggcugaggcaggggaauugcuugaacccgggaggcagagguugcagugggccgagaucacggcacugcacuccagccuggccacagagcaagacuccaucuaaaaacaaacaaaaaggaugaacauccuguccccuugagucuuuacuccuucaggcuaaaacccagauuuuacaaccccuuguggagcaaauguggcuuccagaccccucaccaucccaggacugucauuuauuucacuuugucauuuacugcauauacuucacugugucaguauuuccccagaaaugcaagaccccacacagaaaacuccagaccguguugccgacuacggagucucaaccugaaaucauuguuuacuacaacuccuuucuuucccaccucaaagugaugagaucuuuccuccccucuuucuggaccuauaaaaaugauuuuuuuagcugggugcgauggcucaugccuauaaucccagcauuuugggaggccgagguuggaggaucgcuugaguccaggaguucaagaccagccugggcaacauugugagaacacaucuccacaaaacauuuuuuuuaguuagccagacaugguggcacacaccuguggucccagcuacuugggagguugaggcagggggaucgcuugagcccaaguggucaaggcugcagggagcugugaucgcaccacugcacugcagccugggcaacacaguaagauccuuucuccaaaacaaaaaaagugauuuuuuccccccagauacaggacuucauauuuagucuuagugacuuuccucugaguuuuuaugcauuauucuuauaugauaugggauuuuuccuucuucauuuuauuaguucaaaucccuucuuuaauuuugugaaaucugcaaauuugaucagcauaccuccugagucuucacugaagucacccuaaaaauguugacuagggccgggcgcaguggcucacgccuguaauaccaguacuuugggagaccgaggagggaggaucaccugaggucaggaguuugagaccagguuggccaacauagugaaaccccgucucuacuaaaagaacaaaaauuauccgggugugguggugggcaccuguagucccagcuacucgggaggcugaggcaggagaaucgcuugaacccaggaggcggagguugcagugagccaagauuacaccacuacacuccagccugggcgacagagugagacuccgucucaaaauaaauaaauaaauaaauaaauguugacaugggcuggcagcaguggcucacgccuguaaucccaacacuuugggaggcugaggcaggcagaucacuugaggccaggaguucgagaccagccuggcaauauggcaaaaccccaucucuacuaaaaggaaaaugcaaaaauuagcagggugugauggcacacgccuguggucccagcuacucaggaggcugagacaugggaauuguuugagccuaggaggcagagguugcacugagccaagauugugccacugcacuccagccuaggugacagagcaacacucugucucaaaaaaaauuuuuuuaauaaaaaaauuaaaauguuaggccgggcacgguggcucacgccuguaaucccagcacuuugggaggccgaggcaggcagaucacaaggucaggagaucgagaccauccuggcuaacacaaugaaaccccaucucuacuaaaaauacaaaaaguuagccgggcgugguggcgggugccuguagucccagcuacucgggaggcugaggcaggagaauggcgugaacccgggaggcggcgguugcagugagccgagaucgcgccaccgcacuccagccugggugacagagcgagaguucgucucaaaaaaaaaaaaauuaaaauguugacuaagaucaacagagcuguauagucuaucacuguagaccuuucuguauuugucauuauuccacaauguuauucagccaacuaagaaucuaccaaacuuuauuuuuaucuagucuaccuugucaacaagaauaucaugagaauuugccacgaaccucuccgaaaucugcauacacaugccucugcucuaacaaucuaaugaugcuaucaaacaauucaaaucaaauuaguauauauuuauguagaauauucauaguuacacccuugcaguagucaaaaacuagaaacaacccaaaugcccagcaacaguagauugaauaaauacuaaacagcacuaagaauaaacaaucuguaauccuagcacguugggaggccaaggcgggcagaucacaaagucaggaguuugagaucagccuggccaacauggugaaacccccgucucuacuaaaaauacaaaaauuagcugggcgugguggcgggcaccugucaucccagcuacucaggaggcugaggcaggagaaucgcuugaacccgggagguggagguugcagugagccaagauccuaccacugcacuccagcccgggcgacagagugagacucugucugggaaaaaaaaaaaaaaaaagugaacaaucuacgacuacagacaaaaauacagaagaaucucaaacauaauaagcaagccagaugcaaaaguguacauauagauuauauccauuuacauaaaaucagagaaaacuaaucaaugcuacuagaagucagaauagugauuucccuuugugugggguggagaggcagggacugggaagagcauaagaagggcucaagggugcuaguuacacaugugcucaacuagugacaauucauuaagccauaaacuuaugagauugcacuguuccuucuguauauuauauuugaauaaaaaaauuaaaauugaaccaaaaagugagguuagcagaguauggcuuguucuuagugaauucauacacguuacuaaugauuucccacccuucugcucguacuucacuaaccagauuuaacuuacaagccuagaauuugggcaagaauccaccuuaaguuaucacuucagagugcugcucauccaccuccgguggaaagcugggcuaucacuugugguagguagacuaauggccccccaaagauguccacccccuaaucccuggaaccugugagccauguuauauugcauggcaagggagaauuaaaguugcagauagaggccaggcgcaguggcucaugccuguaaucccagcacuuuaggaggccaaggcgggcagaucaccugaggucaggaauucuaaccaacaugagucagccuaaccaacacggugaaaccccgucucuacuaaaaauacaaaaaauagcugggugugguggugggugccuauaaucccagcuacucaggaggcugaggcaggagaauugcuugaacccaggaggcggagguugcagugagccaagaucacaccacugcacuucagccugggcaacagagcaagacucuggcucaaaaaaaaaaaaaaaaaagaaaaaaguugcagacagaaugaagauugcuaaucaagugacaaaacagggaaaucauucuguauucucugggugggcccaauguaaucacaaaaguucuuaaagaugaaagagggaggcagaaaggucaaugucagaguaguacaauaugagaaagacucucccaguuacugcugacuuugaaaauggaaggguccaugagacucuagaagcugggaaaggcaagaagauggauccucuccuuaagccuccagaaagaaacacagugcuacuucauauuagcccagugagacccauuucagacuucugaccuccagaauuaugagaugauaaauuuguguuguuuucagccacucaauuggugguaacuuguuagagaagcaauagaaaacucauauguuggcugggcacaguggcucgcuccuguaauuccagcacuuugggaggccagggugggcugaucccuugagcucaggaguuugaaaccagccugggcaacauagagaaacccugauucuacaaaaaauacaaaaauuagcugggccugguggcgugcaccuguagucucaacuacucaggaggcuaaggugggagaauugcuugagccuggggaggucaaggcugcagugauccuugauugcaccacugcauuccagccugggugacagagcaagacugucucaaaaaaaaaaaaaaaaaaaaaaaaaaaaccuaacugcaggcagaaaacuggaaguagcacugggugguacuauucauuacauuuguugaaaaauggagaaaggggaagugaaacccuugacagcucacuggaucuugguguacugaaauuucccucucacugcaaucaaaagaaucuaaaugugaccuuaugcaaagaaggcaggcaucccuuaugauagcagauccucaaacaaguauguaccucucucuuuaauguacuacaugaaucccagcucuucuagcaaaucaucauuuuugaacaaaguauacucuuucauuaucauauucuaaucaaauaucgcugaugccuaugaaauuguuuccuccuuucaguaaaaggucaaauacgggccgggcacaguggcucaugccuguaaucccagcacuuugggaggcggaggcagacgaaucacgaguucaagagauugagaccauccuggccaacauggugaaaccccgucucuacuaaaaauacaaaaauuagcugggugugguggugugcgccuguagucccagcuacuggggaggcugaggcaggagaaucacuugagcccaggaggcggagguugcagugagcuaagaucgcgccacugcacuccagccuggugacagagcgagacuccgucucacaaaaaaaaaaaaaaaaggucaaauacguuuauuagccuuacuuguaauauuuguagauaagaguucaaaagcaucauuucugaucuuccaucccauuuucuccaaaugcguuacugagcaacuccucucugccuuuauucucugcuauguagucuccaaaauacccagauuuauacuuuuaucuaggcauuuuucuccuugccucuaaaauuuccauucuaaagccuuauuauacacaucucucccaaucccuauaaaccuccucuaucccuuaccaggaguuuaucuuucugguaucuuagaaucuuagaauuuacgguuaggaacucuguucuguguucuuuuuucuuucacauacacagccuucagcugacaaagagacgaaaauuccaccugccacucaguuugcuacuuuaaacuucacgucaccagugagacaucucagcuaucuucugacuggugacaucauucaucccacagcaauuagcagaaggauagcagucccuaggcuuaauuggugugagcaagcucuuggucacauguugcucagaaaaacugcacauuucuagguuaggcugggucuguguauagucagaugcacacuauuccugggggaaggccaaaccccacaacuggcauacucaggccugcuaauacccuggugucuccaaaauacucuaccacugcuguuuccucagaagguccagauauaagcucucuggaaacgccucauaucuguuaccuaaacccagagauuucaagucucuucuuccuuuucuuugcugcauccccauuuguuuugucuaauguugguuugggaaaaucucuacaccuuuuuuuuuuuuuuuuuaauugagauggagucucgcucugucgcccaggcuggagugcaguggcgccaucucggcucacugcaagcuccgccuccuggguucacgccauucuccugccucagccucccgaguagcugggacuacgggcguccgccaccacguccggcuaauuuuuuuguacucuuaguacagacgggguuucaccauguuagccaggauggucucaauuuccugaccccgugauccacccgccuuggccucccaaagugcugggauuacaggcuugagccaccgcgcccggccuggaaacucucuacaccuugaaaucacaauuucacccuggcuucuuugauacauuauuucuuccacucucccuaggugcuguuauuucucucagauagcagauggccuucaaauuauuuuaccuuucagacuacagaaaccuuuuacuccaggugcaguggcucaugccuauaaucccagcacuuuggaaggccaagacgugaggaucacuugaggccaggaguuggagaccagccugggcagcauagcaagacccuuucucuacaaaaaaauuacaaauuagcuggacuugguggugcacacugaugguccuagcuacuuggaaggcugaggugggaaggucacuugagugcaggauugagcccauaaccaugcuacugcacaccagccugggcaacaaagcaagacuucgucucagaaaauaaaauaacauuuuugaccaggcguggugguggcucacaccuguaaucccagcauuuugggaagccgaagugggcggaucaccugaggucaagcguucaugaccagccugaccaacauggcaaaaccccgucucuacuaaaaauacaaaaauuagccagccgugguggcgcacgccuguaauccuagcuaccugggagucugagagaggagaaucauuuugaacccaggaggcggagguugcagugagccgagauugcaccacugcacuccagccuggaugauagugugaggccccgucucaaagaaagaaagagagagagagagagagagagagagagaaaggaaaagaaaagaaaaauaucuuuuuuuuuuuuuuaaagacagagucucgcucugucgcccaggcuggagugcaguggugcgaucuuggcucacugcaaccuccgccucccggguucaugccguucuccugccucagccucccaaguagcugagacuacaggcgcccgccaccaagcccagcuaauuuuuuguauucuuuaguagagacaggguuucaccguguuagccaggauggucucgaucuccugaccucguaauccgcccgccucggcuucccaaagugcugggauuacaggcguaaaccaccacgcccagccaauuaaaauaaaaauuuuaaagaaacaaccaauucgcuuacucaggugucaugggugagagccucuguaauugcaaaauuuugacugagacagugaaagagaucuaacuuaacugacuccaucuugcuucuaaccuccaagcugccuuuauucauucccaggcauaggcugaacuaacuuugggagaaacuuaguuuauaauuuagacaaagaggauaacagcccuuucccaaagcagaccuccuucuugccuggggacuagauugccuuuguaggacuaacauuagccacaagauuagaaauuaugguuuagggcugggcacgguggcucaugccuguaaucccagcacuuugggagccauaggagggcggaucaccugaggucaggaguucaagaccagccugggcaacauggugaaaaccugucucuacuaaaaauaaaaaauaaaauuagcugggugugguggcgugcaccuguaaccccagcuacuagggaggcugaggcaggagaauuacuucaacucgggagguggagguggcagugagccaauaucacaccacugcacuccagccugggugacagagcaagacuccaucucgaaaaaaaaaaagaaauuaugguuuaggagucacgcagcuggaagcuacaagauucugaccuucccuaaacugcuccuaagaucagugcuugagguauuuuguagacccugcucuugguggaucagcuggcccccacccagaucaauaaacuggcuuagcugaucuuguggcccccacccaggaacugacugagagcaagaagacagcucugauucccugugauuucaucucuaacuaaucagcacuccuggcucacuggcuuccccugacccaccaaguuauccuuaaaaacucugcucccagaauguucggggagacugauuugaguaauaauaaaacuccggucucccgcacagccggcucugugugaauuacucauuauugcaauaucccugucuugaagaauuggcucugucuaggcagugggcaaggugaaccccuugggcaguuacaccucuggcaagaagacacaccaaaugcaaucccugugggucacuggaucagaguccucccgcucuccuuccuggaacucagucagcacuuuggucccuguggcucugaccacucugagggagcaagcaggcaguuuguaccaggagggucuuauaguaacaaccccgugagucccuucuccaagccguguaaauccaauccuuauugguuugcuuagcuaggggucaguucaaguccucagguaccagaucucaagccugagugagcaucaguaccaccugaggaauuugucgacccacaacuucagggccccacaccccagagguucugaugcaggagaccugagacaguuucgcaggcuaaucugaggaucugcuucucuggguguguuuccuuagguaaucaccuacggaaauaaccacacacagagcagcuguaucagaacagucgcaacccuuugcuaacucaaggcuccucuauccuggcugcaaacuagcaucacuugacgagcuuuaacaguccagugcucaggccccacccagaccaaugaagucagaaauucugggguggaacccaggcaucggcauguuuuuaaaacuccccaggugacucugaagcauggugacaauugagaacggcuuuucccaccucuagugacacaagacccucaucaauucuccucaaaagcaauuuuucugcuuccuuaauucucguucuccaagccaauucucaucucauucuucuccccagugguucagauuuauguagucagggagugggagugaugaguauuguuuucuuucuuucuuuuuuuuuuuuuuuuuuuuuugagacagcgucucacucuguugcccaugcuggaaugcaguggcacaaucuuggcucacugcagcuuggaccaaaugggcuuaaacaauccucccaccucagccaccugaguagcugggacuacaggcaugcaccaccaugcccaauuaauuuuuuuuuuuuuuuuuuguagagaccaaguucuccagacuggucuccugagcuuaagccauccuccuaccucagucucccaaaaugcuaggauuacaggugugagccaccgugcccaaucugaguauugcuugcuugcuuucuuucuuucuuucuuucuuucuuucuuucuuucuuucuuucuuucuuucuuucuuuucuauucuuuucuuuucuuuucuuuucuuuucuuuucuuuuuuaauugagacagagucucacucugucgcccaggcuggagugcaguggugcaaucucggcucacugcaagcuccgccucccggguucacaccauucuccugccucagccucccgaguagcugggaccacaggcgccugccaccacacccagcuaauuuuuuguauuuuuaguagagacggguuucaccauguuagccaggauggucucaaucuccugaccuugugaucugcccgccucggccucccaaagugcugggauuacaggcgugagccaccgugcccggccuuguuuucuuaauucuccagaugauuccaauccacagccagaguuaggacccacugcugcccagcaucuuccgcaaccuccucuaggcuaccugcccagcuucuucugaggcagagagaaaaagaaaggaacauagaaacauagaacauagaaaggaagagagcaaggaugagcccccaaagggacuugaugaucaaagcagcauaaaggucuaccccuucacugcuggucaagaguuuguuccaaaguucacaacaaacccacacuagaacccaaggcucugaugaaagccuauuucuugaggugaauaugggccagaaaagguaaguuucuucaccuccacccucagauggcucuugggaaaagcccucugaaaaaggcaacuagcuuccaaguagaagguucaaagggcaaaaguccguuggggggcccagcaucugacuguuccaccucauuagccacaaguacaugagaucagucauucugguaccaggagaagcugcacgaggacaccuggccaaagcucucagacacacagagauccaaaguccuucacagcccacagcggcucuggcagacucaggguaagcugucugcccccuucccacagcaacccucagcccccaccagcacccugaaaggcaaaagcacgaaauacccuucucagccaaguugaaccuggaaucauaucuucuguucauucauccagccaacauuuauugaagaacccacuacaugcaauucacuguggccacauguguaugacacgaagaaucuuugccugaucccugaagaacaguacucuguaaacaaagagcccugaacugccagguacugcugacucacugguacaggggacauacugaaggcauagaugguaaaaauguccugguaguguccugaauggcaaaacaacuaggucucagugugggcaaguguagguaaggcaagaacagucauguccaccugugaacagugggccaaaacaccuuggcucugaggaaaggacagucggguggagcuggacuucuggacaccuauccucuugcugagaggaaaguuccaccucucuugcaaaacagaaagaaaaggcucagcccuccuuucugaucccugagcuauugugaaguaaaauguaaacugcuuuuaagucauccaaagacagcaugcggaagguaaagcuuuuagaaaucaauaagaugcauaugauaugaauauaacuugcaguaauagauacuauuuuuaacugacaacugugugccaggucacuauguacuuacaccuaucuucuaauuuaaucugacagagaguaaguuuuauuaucuuuauuuuacacuugagaaaacugaggucaggcagugacuagcuccaaagccuacauccauuccaccacaccacauaccucccuaacuguaugcaagaaugugagacggggagugggauuaucucccccugugguaauggagaugccuagaacuucagagcacuggggcaguccacgaauuucuccaagaagucagaauaagcagcuucaggaggugccaucugcacaccucucuguuugggaaaagcaaccauuucuacuacccuagacaggacagugaggcuccuucaaaacucagaauuccuucacucacucacucauucauucauucauuaagcuuauauugaguacccacuguguuccaggcccugugcaggcucugagauuaagauccagucuccagccuucacucaaaaguggacauugacaauuacaagaaucaguugcuaugaaagucacugagaggcaaccuaucuacccacacgucacuggaggagugaauggggugcaggcaagcaccaggaucacuguuaucuggacugagugcauggaggcugcugcuggggugggggaggggaagcaauauuccugacagagagggcaaaacguuauuacccugacaaugaaaucagcaaugaaugaagucaaccacccguauaaaaaaaccuacuuaagcaauaaccaguaaaugauuucaaggucuauuaguaauaccagacuaucuagggcuguaguucaacagcucuaaagguagacuaugccugccaaaagacugcaaacaacuggcaggagcagagacucuguguuugcucuuuggaaacugucaugauuugaauagaaaaagaugaaaauaugguacaaauauagaucacauuucuaugagguagggaccccauuuuauagaagagagaacugagggcugggcacgguggcucaugccuguaaucccagcaauuugagaggccgaggaagguagaucaccugaggucaggaguuucagacuagccuggccaacauggugaaaccccaucucuacuaaaaauacaaaaaauuagccgggcauaguggugggcaccuguaaucccagcuacucgggaggcugaggcaggagaaucgcuugaacccaggaggcggagguugcaguaaacugagauuacgccacugcacuccagacugggcaacaagagugaaacucugucaaaaaaaaagaagaagaagaaggagaaggaggaaaaggagaaggagaaggagaacaagaggaaacugaggcuaauaaauuugaccuagcauugauugaauccugccugauuccacgcuguucaccaccaugcaccagugccuuccaaagggauaaggguauccccuacacuguucaagaaaaagaagucugacucagggcacccaaucauuacagccauggagaaggcaucauuguaggguagagauauuucauccaacuuuuccagaaacauaccucaaccaaccuaaggcaggcuuaacucuuuuucauaaaaucgucccucaaccuugguccuuuccucuaacaaucacccuccaugcuuucagaaucauucaucugaagagcaugucuacauuccuucccguuccugggucucuacaaugcagucugagauguugcaacuccuuccucuuucacccugcaaaaguuuuccuuugacccucugaguugccaauuccaaaugacauuuuauuccuuauuuuaaacuuaauagcuccuccagaaaggcuauuuuugaguguaaaccugccaccucugguaugcugcccuugcucugugcucucaccuccccaauuaacuacacugcauuagaacaguguacauaugucucucccacccacgagagcugugugagggcagagaguggauaacaguuauccuuguacccaugggcauaguccugaacuagacacacaguaacacuuaauacauuuugcugggugaauaaaugauauuucugaaaccugauuucacccucacugcccugaaauuucauugccuuaggagaaagcccacaugaaaagccaccagugaccuucauaucaauaaauccaaucaacuauacucaaucuuuaccuagcuugaccucuuagcagauuggacacagguagucauucauuccuucucaauucacucccuuccacucaccaucuuccagguuuccaccuaucucucuagaugcuccuucuccaucuuuucacaaaauaccuaucccucaaauguggguauuccucagaaugcuucuaagccccuuuguccucccuuucuacaucuugucccaaggucaucucaucuguuccugugguuucuuuuucuuuuuauuuuuuucuuucuuuuuuuuuuuuuuuuuuuuuuuugagacagaaucuugcucugucacccaagauggagugcaguggagcugucucggcucacugcaaccucuuccuccaggguucaagcgauucuccugccucagccuccagaguagcugggacuacaggugcacaccaccaugcccggcuaguuuuuguauuuuuaguagagacaggguuucgccauguuggccaggcuggucucgaacuccuggccucaagugaucagcccaccucagccucccaaaguguugggauuacaggugugagccaccgcccuggccuguuccuaugguuucaauaaccauauauacaaugaugacucccaaaaguauaucaucagcccaacugucaugauucuagauauauaugaauauucaaccaccuacuggacauuaccaggcacaucaaacucaacauguccaaaacugauuccaucaauuucucccaaaccuacugcaccuucgguguuccccauacaaguaacuggcgucaccauccacccauuuaugcaagccaaagaccugggcauguuauugucaucaacaacuuccacucauaucuacucauaguccaagucuuaagucucccuguccccaaaacaugacucuaguccaagccaccaucauuucucacuaggaucauagcagcagcuucccaccugucucccagcuuucaauccuacauagaaaaacuaaucuuucuuaaacucacaaauucuaaaaucuaaaucacaaaugccacucuucugcuuuuaaaggccuuaagaguuuucucauugccuuagaagacagcccaccaaacuccuuaauauaguuggugcaauagauuggaguuuuccaauaugccucaacgucucccaucccauauuccuuucuuacaaugugacuuugacacucuacccaucaagaggcagggucuguaccccucuucucgaaacuggauggucuucugugaaugccucuaccuauagaguaugacagaauugacaccaugcaacuucagagacuaggucauaaaaggcaaugcaacuuccacuuugggugcuacaacacucauucuggacgcuuucagcugccugcauaagcagucugacugcccacgagucaccacgcugugagaaagcucaacacaguccauacggaaagaccacauggaaagacugacacaauuugauaaagaaggccgggugcgguggcucacacccguaauccuaacacuuuguuugggaggccgaggcggguagaucaccugaggucaggaguucaagacuaaccuggccaacacggugaaaccccgucucuacuaaaaauauaaaaauuagccgggcgugguggggcacgccuguaaucccagcuacucaggaggcugaggaaggagaauugcuugaaucugagagguggagguugcagugagccgagaucgcgccacugcacuccaaccugcacaaccggagcaagacuccaccucaaaaaaagaaaaaaaagaagcccagauugucugcaacuuccucagcaaccguuuuuccagcuccugucaccaucugcugcaaccacaugagggacccugaccuagaacugucccacuaagcccuucccaaauuucuaagccacagaaaucauaaaaaaaaugacuacuguuuuaagacacuacguuuuagacuauuuguuauagcacaauaauaacuagcacagcuuauaaagcuuugaacaaccuaugccuugacucuauuuaccucugcaagccaacucucaaccuuuucuuccugaaauucaacacugcagcccacccugaacuccuuucagugccugaaaggagcacuucuggcauuuagguuuucauacauucuguucuugcugcuuggaacacuccucuucuacucuugauuaauucuucuucgccauucagguaucagcucaaacuucuacaggaaugguuucuaaaugccuagguuaggacuggucuccuccugugccuuguucuaccuugcaaaucacaacaccaucacaauccauuaaaacccuguaucagaggccaggcacgguggcucacgccuguaaucccagcacuuugggaggccgaggcaggcggaucaugaggucaagagaucaagaccauccuggccaacauggugaaaccccgucuaaaaaauacaaaaauuagcugagcaugguggugcaugccuguagucccagcuacucaggaggagacaggagaaucucuugaaccugggaagcagagguugcagugagcugagauugcgccacugcacuccagccuggugacagagcgagacuccgucucaaaaaaacaaaacaaaacaaaaaucccuguauuggguugcccauccugaccccggcaugcacccaugcaugcggucacacacacccacgcacacacauaaagugcuccaaaaagacaaugacagugcagggaacguggcaaccucuucgcaaauacuuguugaauguuuaaucuccaacccuaucucuuuccuaaauuccaaagagcauaucugccuacuaugcuaaaaauaaauuccaaauucaacaugcccccauccuccuccucacaguaaaugauaucacugccuacaaauugucuaaaccagaaacaucaucucuucauucaaagacuauuuauugagggccgggcacgguagguggcucacgccugcaaucccagcacuuugggaggccgaggcaggcagaucacuugaguucaggaguucgagaccagccuggccaacauggugaaaccccaucuguacuaaaaauacaaaaauuagcagggcggggugacaugcaccuguagucccagcuacucaggacacugaggcaggagaaucccuugaacccgggaggcagagguugcagugagccaagauccugcuacuguacuccagccugggcgacagagcaagacucugucucaaaacaacaacaacaacaaccaaacaaacaaacaaaaaaaauauuuaucaagcuucucuguuuccuugcuggggauacaguggauuauagauaggcacagcucuucuggcacaaaacuuacaagaugguagauguuuuccuugacacuucccucucccuuauacuugacaucuuaauaggucucauugguuguauugauuauaccuucuaaauugugcucagaucuauccuuccuuguccaccccaacugccaucaccguaguucagguuuuugucauuuccugccuggauugcuacaagagcuuccuaauagugucucugccuccagccuuguccccuaaguuccaccccagcuauaucacuccccuguuuaaaguccuuuaaugguuccucauaugcuuugaauaaauucuaaaacccuacaaagauauaccuuguguucuagccccuugcccaucuugguccccucauaucccacaaucccccaugcacccccacaccccauacauuuuuuucaucuugugccuuuacauuggcuuucccugugccuaaaacguccugcccccuucuucauucaacauacaauuauugagcaccuagcagauaccaggcacuguucuaugugcuggugauucagcagugaguaaaacaaaguccuuauucacauauguuuauauucuagagggaaagagagacaaguaaaugauguguugaacacuguuauaaagaaaaagaggccaggcacgguggcucaugccuguaaucccagcaccuugggagaccaaggcgggcagaucgccugaggucaggaguuugagaccagccugacuaacauggugaaacccuauuucugcuaaaauaccaaaauuagccaggcacaguggcagcgccuguaaucccaucuacacaggaggcugaggaaggagaaucgcuugaacccggaaggcggagguugcagugagcugagaucgugccauugcacuccagccugggcaacagagcgagacaccaucucaaaaaaaaagaaaaagaaaacaggauggggaacugagagugaccauuuuagauacgauaggucucuaguaagguacuauuuuugcaaagaggugaauggaguaagggaauaagcucugcaggcaucuggagacgugccuuccuugcagaagaaacaaauacaaaaucccugagacauguaugugccaggaaaaugcaggagaggcaagaaggccaguguagcuggagcagacaaagugagggcaagaaguccaaggugaaucaaagaagucagguggaguagggccacauaggccacgguagaaaugugggugcuucagcccagccugacuccuuucauccuucagugcugaugcagacaucauccccugaacaagccacucuccaccccugcaagcaccugccacauauacauguuuaagugacuaugucuaccucgcuucccaccacacugugcguucccuacaggcaggggcuccaccuuucaguuccaugcuuuauagagcccaacauguucagaaaaaauuucucaaauuauucaaacuuucuucuuuuguuccaauuccacacccugcaagcaacuuccugauuacuagauugguuucccaguuacuaggguaucagggaggggaugccuugauagugaacacacaccuucuggucauuagaaauuacucaugugggaaaggauuccguauuuaauaaauggugcugugagaacugccuagccauaugcagaaaauugaaacuggagcccuuccuuauaucuuauacaaaaauuaacucacgauggauucaagacuuaaauguaaaacccaaaacuauaaaaacccuagaaaaaaaucuaggguuuuauagcaauaccauucaggacauaggcacgggcaaagauuucauggcaaaaauaccaaaagcaauugccaaaaaagcaaaaauugacaaaugggaucuuauuaaacuaaagagcuucugcacagcaaaauaaauuaucaucagagggaagagacaaccucuacagaaugggagaaaauuuuugcaaucuauccaucugaaaaaggucuaauaaccagagucuacaaggaauuuaaacaaauuuacaagaaagaaacaaacaaucccauuaaaaagugagaaaaggacaugaacaaacacuucucaaaagaggacauucaugcggccaacaaacaugaaaaaaagcucaacagcacugaucauuagagaaaugcaaaucaaaaccacaaugagaaaucaucucacgucagucagaaugucaauaauuaaaaagucaagaaacagucaggcauggugguucacaucuguaaucccagcacuucgggaggcugaggcagguggaucaccugaggucaguaguucaagaccagccugaccaacauggagaaaccccgucucuaacaauacaaaauuagccaaauacaaaauuagcugggcauggggguguguacgccuguuaucccagcuacucaggaggcuaaggcaggagaauuccuugaacuugggaggcggagguugcauugagccgagauugugccauugcacuccagccugggcaacaagagugaaacuucgucucaaaaaacaaaaaacaaacaaacaaaaaaaggcaagaaacaacagaugcugacaaguuugcagagaaaaaggaacaccuggccaggugcaguggcucaugccuguaaucccagcacuuugggaggccaaggcagguggaccacaaggucaggaguucaagaccagccuggccaagauggggaaacuccauaucuacuaaaaauacaaaaauuagccaggugugguggugggcuccuguaauccuagcuacucagaaggcugaggcagagaaccacucaaaacaaggaggcagagguugcaguuagccaagaucaugccacugcauuccagccuaggugacagagcaagacucagucucaaaagaaaaagaaagguacggcaaguaagaaaaugugguacauauauaccaugaaauaguaugcagccauaaaaaggaaugagaucauguccuuugcagggacauggaugaaacuggaagccauuauccucagcaaacuaauguaggaacagaaaaccaaacaccaaauguucucacuuauaagugggagcugaacggugagaacacauagacaaaugcgggggaagaacaacacacacuggggccugucgguagagguugguagagggagggcaucaggaaucauagcuaauggaugcuaggcuuaauacccaggugauggguugaucuguacagcaaacaaucauggcacauguuuaccuauguaacaaagcugcacauccugcacaugugcccuggaacuuaaaauaaaaguggaagaaaaauuaaauaaauaaaaauuuuaaaaaaagaaauuacccauguaugcucaucaauaaacuguacauacaucaaaggccgagggcgguggcucacgccuguaaucccagcacuuugggaggcugaggcgggcagaucacgaggucaggagauugagaccauccuggccaacauggugaaaccucgucucuacuaaaaauacaaaaauuagcugggugugguggcaggagccuguaaucccagccacucgggaggcugaggcaggagaaucgcuugaagcugggaucucggcucacugcaaccuccgccuacugacauagcgagacucugucucaaaaaaaaaaaaaaaaaaaaaacuguacauacaucaguaaacugacauuaucauucacacaucaaucucuuuuuuuuuuuuuuuuuuuuuuuuuugagacagagucuugcucugucgcccaggcuagagugcaauggugcaaucucggcucacugcaaccuccaccucccagguucaagcgauucuccugccucagccucccaaguagcugggauuacaggugcccgccaucaugcccggcuaauuuuuuuguguuuuaguagagacaggguuucaccauaucgaccucuuuuuuuagguaagcgugacucaacugcugggaaaaugacccaaaucugugucaugacacccaaagaaggcgcugcucauggaagggccacauaagcagccuggcagaagacuuggaugcccugucuaccucacacucagcccaccuucccuauuuuagauggcagccccaucacccacaccuguccaagcucaaaucucuagcuucaugaacucugagagcuuccauauuccccauaccuagaauauauggguaauggggugugcaugaaggauuaugggauaugagaaggccaaagcggcaaaagcacaaggcacaccuuccuagggauuuagauuuuauccuaaagcauaugaggagccacuggaggauuuuaaacagggagcaacauacugggguggaaaccuaugggcaaggcuggaggcagggcuuuaccugugagagcuccccgacccccggcaaaaaguccuugaaaguccacuguuaacuuuuuuuuuuuuuuuuuuuugagacggagucucgcucugucgcccaggcuagagugcaguggcgcgaucugggcucacugcaagcuccgcuucccggguucaugccauucuccugccucagccucccaaguagcugggacuacaggcuccugccaccaugcccggcuaauuuuuucuguauuuuuaguaaagacgggauuucacuguguuagccaggauggucucaaucuccugaccucgagauccaccagccucggccucccaaagugcugggauuacaggcgugagccaccgcgccgggccaacuauuucuuuauucauacccucaucucuguuccuaaggccacuccacagugcagauauucaucacccuucacauggauucagguuucagcucccuaaaccagucuccccaccuucugucucuugcucuuuccaaaaacauucuccauguggccaccagaguucuccuuuuaacuaagucucauuauuucacuaguccccauaccccugcuuaauaaucaguagcuguguagcuuuguagcucccaccuguaauccuagcuacucaggagguaggaggauuacuugaggccaggaguuggaggcugcagugagcuaugacugcaccacugcacuccugccugggcgacagagcaagaacccccaucucuaaaaauauaaaaauaaacaauagcuuccccuuaucuuuuagauaaaguccaaccugauuauaaaacccaucucacccagggcugucuccucgcccuucucccaccccacauuccaaccauaccaaaccaacgaccuggaauucucugaacauucuguaccuugcaccuccacaccuuugcacaugcagucuccugugugaaaggucacaggagacagcuauauuuauuuucaaaauucagcucagacaccauguucucugcgauaccuuccuaagcuauccuccccuacaaaaauaaaguugucccauuuaggucgggcgugguagcucaugccuguagucccagcaauuugggaagcugaggcgggcaguucgccugagguuaggaguucgagaccagccuggccaacguggugaaaccccgucucuacuaaaaacacaaaaauuagccgggugugguggugcacagcuguaaucccagcugcucaggaggcuggggcaggagaaucgcuuaacuugggacauggagguugcgugagugaggcgagaucacaccacugcacuccagccugggcaacaagagugaaacuucaucucaaaaaaaaaaaaagaaguugccccauuugcucuuauggugccucuaucaguguacaaauuauauugcaugacaauuauuuguuaacaugucagucuccuuucuggacuauaaauuauugaauggcaagggccagacaucauucuucuuuguuuuucagcacuaaguaaaauaucuagcacacacauagcaugcccuaauuaaauuuuuucuaagggagggaauguaugaaagcucuaaauuaaagcccuucucuugcuaaaucugaagauucugccuaaguucucacuuaggcuaaucagaaugucuucauaggucccagcaucugacuugugucaggugcuuauucaacagugccugaagaccaggcacaauggcucacgcccguaauccuagcacuuugggaggccaaggcaggcagauagcuugagcccaggaguuugagaccagccugggcaacauagcgagaccccaucucuauuaaagaaaauuaaaaaacaaaaccaaaacaguggcugaaggaauaaacccaugaaucauaugucacuaaauucuuagucuugguugcccuucugaaccuucuuuagaucucuaugcuccucugaaguuaucaaagauagaacaaaguccagauauuaucuaugcaguaauauuucauuuaucuaaccauaacuacucagaugaagccaagaagcaggaagaggaacaggacuauaagugaccaagaaagacaguaauuugaaacauaauucauaauucaugguuuucacugaaucucauuccauucucacaacagccuggaauuaaacagucagugcaccuggcucaaggucacauagcuauugagcccaaccucaaacacaagugugugcacaagugcugugcaccuuucacucuaucagagaaaucucaaaugugugucacacauguguguacaaaacucuaugcauuuuacucacugaagagcucugcauacgaaccauaacugcggcuacuuugcauguauucuuuuuguuuuguuuuguuuugucuuuugagacagagucucgcucuguggcccaggcuggagugcaguagcaugaucucggcuacugcaaccucugcuucccggguucaagcguuccuccugugucagccucccuaguagcugggauuauaggcacccaccaccacacccagcuuuuuuuuuuuuuuuugagacagagucuggcucugucacccaggcuggcgugcaauggcgcgaucucugcucacugcaaccucugccucccggguucaagcgauuccccugccucagccucccaaguagcugggacuauaggcacgcaccaccacacccagcuaauuuuuuugcguuuuucauagagacgggguuucaccauguuggccaggaugaucuugaucucuugaccucgugauccacccaucucggccucccaaagugcugggauuccaggcgugagccaccaugcccggccuuuuuuguauuuuuaguagagaggggguuucacgauccgcccaucuuagcuucccaaagugcuaggauuacaggcaugagcgacugcacccggccuuugcauguauucuuacaaggauguacaggcacgugaauguguacaugggugaaugaggauuuaaacauguaugucucuauacccaaauuagaagcagaaaauuggccaggugcaguggcugugaaaucccaucucuucuaaaaauacaaaaaauuagcuuggcgugguggcgggcgccuguaaucccagcuacuugggaggcugaggcaagagaaucgcuggaacucgggaggcggagguugcagugagcugagaucgcaccauugcacuccagccugggcaacaagagggaaacacugucucaaaaaaaaaaaaaaaaaaaaaaaagcagcaacagcagaaaauuaaaaaggguugacuggcagagguaggcacaaggucagaaucgaggaacaagagcugucagaaaugacacagacaaagauaguuaaaauaauagaauucuaaggccgggaagguggcccaugccuguaaucccagcacuuugggaggccgagguaggcggauuaccugagguccggaguucgagacuagccugaccaacauggagaaaccccaucucuacuaaaaauacaaaauuagccgggcaugguagcacaucuguaaucccagcuacucgggaggcugaggcaggagaaucacuugaaccugggaggcagagguugcggugagccaagaucacgccauugcauuccagccugggcaacaagagcgaaacuccaucucaaaaaaaaaaaaaaaaauagauuucugguauuuuaaaggaaugcagccaucuuagaaauauuacuuagaugaaaugauccuucucugcacaugauauaauuaaccauaugcccacauuugagggugcuccaagaccaauagauccuaaaauuaguuuugccaguaagcaaccuaccagaucaucugcaaguaaugcaagagaaaucacagaucauauuuaagaccucagugaaggcugggcacaguggcucaugccuguaaucccagcacuuugggaggccaaggcgggcggaucaccugaggucgggaguucaagaccagccugaccaacauggagaaacccugucucuaauaaaaauacaaaaauuagccaggcgugguggcacaugccuguaaucccagcuacuugagaggcugaggcaggagaaucacuugaacccgggaggcagagguuguggugagccgagauugugccauugcacuccagccugggcaacaagagugaaacuccgucucggaaaaaaaaaaccucagugaaaacccccuucuugcaacacaaagcagugccuuccaccccucccugacuguugccauguaugacaaacaucccauaugcagagaugaguccaggccagacacaaggacacacaaaacacagaaggaccccacagaagacagccaguucucuacacaacaguaaaaucagagaagcuggaaaggaaguugaggagugaauggggcaauacagaaauugaaagaaaaaaggacacaaacugauuggagagcggugagccaaugagcaauugcaccuggugcaaaauuccugugccccaacugcuagagcagcugccccucaaauugacagaaugucugagcuucuucacaguugcaggguggaaggcaucucuaagguccuaggcucucccagguuggaagggcauuuuucaagaauaguggcaucugagggauggggcuauggagaaucaucaucucagcaccuccaauggcuuuacugaauguacagauuuaaauaauguuuuauuuaugagauggagaaaaagccaagguggacugaaaugacaguauuaaaaaucuagcccacagaggccgggugcaguggcucacgccugugaucccaacacuuugggaagccaaggcagguagaucacuugagcucaggaguucgaguccagccuggccaacacagugaaaccccgucuccaccaaaaauacaaaaaaauuagcuaggcaugguggcacaugccuguaaucccagcuacuagggaggcugaggcaggagaaucacuugaacccagaagauggagguugcagugagcugagauugcaccacucaagccugggcgacagagugacucuaucucaaaaaaaaaaaaaaaaaaaaaggaagaauccagccuacagaaauacucaugcagcugcaaaaagauauucacuggagcauuaucuguaagacugagaaacugaaaccaacguacauggccauuaacagaggaccagcuagauaaauaaacuacuaugcauccuuaaaauucacaugaaauaauaugaagcauuuuuuaaaaaguagaucuguaaguagaaaagaaugucacugauaaugcuagaggaaaagcacacuguagaauuacauguagacuaguaugaccucauuuuuguaaaagaacaaaacuacaccucuuuuuuuuuuauuuuuauuuuuuugagauagagucucacucuguugcccaggcuggagugcaguggugcgaucuuggcucaccgcaaccucugccuccuggguucaagcgauucuccugccucagccuccugaguagcugggauuacaggcaccugccaccacacccagcuaauuuuuguauuuuuaguagagaugggguuucaccauguuggccaggcuagucucgaacuccugaccucaggugaucugcccacuucagccucccaaagugcugggauuacaggcauaagccaccacacccugccaaaacuacaucucuugaaggaacaagaaaaaaaaaucagugugccuguggucccugcuacucaggaggcugaggcaggaggauagcuugagccuagaaguucgaggcugaaguaagguauaaucacaccacugcacuccagucugggugacagagcaaaauaccugucucuuuaaaaaaaaaaaaaaaaaaucaggaagaauaugcaaacugcuaauagugcuuacugugagaagcuggggaaaaggugaguguuuuugcgauacacugugguacuguuugaauuuucacacaaagcauacuuuaacuauauauauauauauauauguugucagagacauuccucucuaucuccuucuuacucccagacugcacucacaucccagccucuguccagcccuccacccaccaccuccuaccccagccccacuuacaaaugcaggcagcagccagcaggcggcuggcagcauaaggggcgaagcagcucgggaagagaggcuguaccauguaguuggcaaaggugauggcaaugauggccuggcuggugggcucaaugaugagcagggagguccagagucugaugaaagcaaggaauccuccaaaggccuccaggauauaggcauagcuggccccagauuucuuaaugguggugcccaguuccgcauaacaaagggccccaaagacggagaagaggcccccgacagcccagaugaccagagagagaccaaaggaggcacuguauaugagcacacccuugggggaaacaaagaugcccgagccgaucauguuccccacaaucaggcacacgccguuaagcagugagaucuccuucuucagcuucaccugcuccggcccugggcuggccccaucacccaaaggggagguuuccaccucaggcugggaggccacuucauacucagugcugucaaccaugguggaggagaggaaacccuucaccagcuuccuggcauugcccuuuaaggaagaaagaugaugcuauagauuaggugguuggcaauuacauagaaccucuacccgccuccaacacaggguaauacgggcagcucaccaaccaaugcggagaccuccaaauaaccuuuucuccagcucacucaucaaaacaaccccaacuugaauauuugucuaucuaucuauguauuuauuuauuuauugacagagucucgcucuguagcccaggcuggagugcaguggugcaaucucggcucggcucacugcaaccucagccucccggguucaagcgcuucucuugccucagccucccaaguagcugggauuacaggcaccugccaccacgcguggcuaauuuuuuuuuuuuuuuuuugagauggaguuuugcucuuguugcccaggcuggagugcaauggcgcgaucucagcucacugcaaccuccgccucccggguucaagugauucuccugccucagccucccaaguagcugggauuauaggcaugcaccaccacacccagcuaauuuuguauuuuuaguagagaugggguuucuccauguuggucaggauggucucaaacucccgaccucagguuauccgcccgccucggccucccaaagugcugggauuacaggcgugagccaccuugcccagccuccaacuugaauuuuuaagagaaggcacucauucgccagagagaaaggaucugucucucaucauuaggacauugcugcccacccgacucaccaaauagagaacuaaaucuugggccgggcgcuguggcucacaucuguaaacccagcacuuugggaggccaaggcgggcagaucaccuaaagucgggaguucgagaccagccugaccaacauuuagaaacccagucucuacuaaaaauacaaaaauuagccaugcgugguggcacaugccuguaaucccagcugcuugggaggcugaggcaggagaaucacuugagcccgggaggcagagguugcgguaagcuaagacugggccauugcacuccagccugggcaacaagagcaaaacucugucucaaaaaaaaaacaaaaucaaaaacaaaacacuaaauguugguucucucugagccugcuauaauacaagacaggcaugggggcaguguggcggcucccagaaaauaacuauaauggcuugaccccgaguuuucagccuuauccaaaacccgucuucccuccaauuucagcuucagggaucaccugugcugagguacaacauuaggaacugacccuaccagcagcuaaucugugggagcgucucaugacacugcucuuuuccccaaggacucuacgucugccaaaacuaaaggcuucagaaaccugcuggaaacccacaaccauccuccugcccaaagagcaucccuuaacccuuagcuggagucuucagcccuggcaaagcccaaguagacccacuucacccugaaagaagacaggcuauuaucuuuuccuugcuuuuccuuucccauucucugguauucuaagccuccugcuaucgaucccucacaucagcaucguugaaucacccaaaaaaguaugaaugagagaagggcgauccaauguaccauaaaaccuagggaugauuggaggcagcugauggccacucccuaccccagaguugcugcuggagagauaucaccccgagccaaggcagggagacagcugcagccaggcagcacaugcuggaaaacaccgaacaggagacagcugagaggaaaaugggagaggcuagucaagcaauggagagauguuagggugagaggcacucgggagaagaagcgauuagacacugcacagcagcaaagaggaggguuagcaagguaaguggagaugagaagaggguggaacgcacacucacuccuugguccuggauauaagcagguucucacggcagugugagcagcagucagggagagaagugccuuccaggaucuguggucugaugcuccuccuucccagccagcaguaaaagggaaggccagacaaaugccuauggauuuaagcaagaaggguggaggaggugaggcagcccgcaaaggaaggagugagggagggggaaaggaguauuaagcaaccaucuggguccaagguucacuggcccuucacaucugcaaaaggggcagcuaggagcucuuggcucagcacuuucugugauaagaaggugcucucucaggaaucuccuuugucagcucugcucugggaccaggggcccagaagaaaggacagucagcugagugcaguaucuguagcccuggggaagcugucccagagcaaguuagcugaggacaggacaguagcggggaaggaauacacagcacucucucucucuguguccuccaugccccacccuagccucucuucucucucaccccaagcauuuaagaaagggaggaagguugcacagugugacacaaaggcuuguucccaugcugagauu

SEQ ID NO: 192492 - RNA, 9370 nt, Homo sapiens
auggccgaccucacuucccuuacgcaacauggacguuuucagucacuuccugugauuuugagguuauucugauccaggacuacuugcaugaccaaagccaagauggcagguacguccuuuuagaauuuaagguuagugaagccaucuauuuccccgacccccuucagugaaaauggucuuucgcaucuggcccuucuuuuuggaggcgugcuugccagcagucaaaauggcuccauuccggaauagauuuaauaggaagugaagcugugacggcgaggcguugcccggccuaucuuugcuaggcguucucagaauuaguucuuucugcccacacuagacauggcgcuugccagcguguuggagagaccgcuaccggugaaccagcgcggguuuuucggacuugggggucgugcagaucugcuggaucuagguccagggagucucagugauggucugagccuggccgcgccaggcuggggugucccagaagagccaggaaucgaaaugcuucauggaacaaccacccuggccuucaagguguggagccagcccccuugccaggcugaguacugaacgcccgcgacuugccuggccucccagccugaccggaguuugcgguggccuuggccaccaacccaggcggaggcuggguccucucguucggaccgcagcaguuuugcugucucauuggcccaggaggccccugucuuugcucugguuggaaaggguggcgguggggccggggguaagucgggggaggaaggugaggccucuuggguugauuccuaggcgaccccagguugcugcuguucaggaucuucuagcugggaaaggccgcaacaacaaugaaucuuggccgagggaaggcuauuguaaacguuuaccaaaguuuuggaaacugggcggccccucaaggcagggguaacugaaacuggcaugaaggggaagcguggugaggguaagcauuguacuaagaaucagacauuugggguuccuugcccagcucugcaauaacuagcucuagauugagaaaucauuugauuucauugaaccuguuuccucaucuauaaaaugauuuguuuuuuuuuuuuuuuugaaacagggcuuuucgcugucgcucaggcuggagugcaguggcuccagcgccucagccuccagaguagcugacacuauaggcacacaccaccacgacaggcuaaguuuuuuuacuuuuuguagagauggaucucccuguguugcccaggcuggucuccagcaccuggccucaagcgguccucccgccuuggucucccaaaaugccuggguuacaggagugagccaccacgcccauccuauaaaaugaauuuaauauggguuauauccaugucaagggauugaugugaagcucgggugacauuaauauauggugaaguauagaaguauacugugaaguauaaaaggacggagaaagagaugugcuggguuuggauugaugcaaaaagaaguauguaggaguguuuuuguggucuuauguggccuguuuuguguuuuccucugaucuuaacaguuccgccauggagucauaguugcagcugacuccagggcuacagcgggugcuuacauugccucccagacggugaagaaggugauagagaucaacccauaccugcuaggcaccauggcugggggcgcagcggauugcagcuucugggaacggcuguuggcucggcaaugucgaaucuaugagcuucgaaauaaggaacgcaucucuguagcagcugccuccaaacugcuugccaacaugguguaucaguacaaaggcauggggcuguccaugggcaccaugaucuguggcugggauaagagaggcccuggugaguuaagcugcaaccacaugauccuugggcugacacuacagugaggagggguuggauggacagaugaauuaaagggcuuggugucaaugcugaagaaguguaauuagguccuuagcccuuccuucucucuuuuuuuuuuuccuguuuuuuuagacugugucucauucugucgcucaggcuggagugcaguggcaugaucucagcucacugcagccuccgcccccagguucaggaauucaagaccagccuggccaacauggcgaaaccccaucucuacuaaaaauacaaaaauuagcccggcgugguggcgggcgccuguaauaccagcugcucaggaggcugaggcaugagaauugcuugaacccaggagguggauguugcagugagcagagaucgcgccacugcacuccagccugggcgacagagugagacucugucucaaaaaaaagaauuuaagaauucguugaaggccgggcgugguggcucacuccuguaaucccagcacuuugggaggcugagacaguggaucacgaggucaggagaucgagaccauccuggcuaacaaggugaaaccccgucucuaccaaaaauacaaaaaauuagccaggcgugguggcaggcgccuguagucccagcuacucaggaggcugaggcaggagaauagugugaacccaggaggcggagcuugcagugagucgagauggugccacugcacuccagccugggcaacagagcgagacucugucucaaaaaaaaaaacaaaaaaaagaauucguugaaucccacauguggcaguagugcuauuucaaguguucauugaccauguguggcuuguggcuacuguauuggacucuaauauaugguugucccucaaaaguuagucauuucucuucuguuuuuuucuuuuuuucuuuuuuugagaugcaaaguuucacuccgaucguccagucuggcguguaauggcauuguuucagcucacuacaaccucugccuccuggguucaagugauucuccugccgcagucucccaaguaccugggauuacaagcgcccaccagcaugcccagcuaauuuuauauuuuuaguagagaugggguuucaccauguuggccaggcuggucucgaaauccugaccucaggugauucacccgccucagccucccaaagugccaggauuaaaggcgugagccgcugcacccggccucuucucuuuuuuucuuuagagagucuuuggccuagaaggggccuuuugggcuccucucuuuuuugaggggguggggauggagucucgcucugucgccccgacuggagugcagcggcgggaucucagcucacugcaaucucugccucccagguucaagugauucuccugccucaaccuuccauguagcugagacuacaggcauaugccaccaugcgcgucuaauuuuuguauuuuuaguagagacaggguuucaccauguuggccaggcuggucuugaacuccugaccucaggugaucugcccaccucagccugccaaaguguugagauuacaggagugagccauugcgccuaguccugggcucauuucuuuuauuucuuugcugguuauaaucacccuuacaaucaugcuagguccgguucuaucaucucugaaaauaaguuccuuagccuguuuuuccuuuccagcauuuaagaaacuugccagacaguucaacuuuguauuuaaugucauuuccucaucagccaguuuugaauugcccguuuaguaaaguuggaguauagcuagucaccuucuaauuuucccuuccauaugcuuaaaaauaauuauucuuuccuccuuuugauuuugcuucauucauuuaccugcuuacuaaauaccuaguuaucuuauagaacaauuauaggguaccuaccacuuuuucacuugcuuucaaacgagaauagaaagggcuguagggaguauccacuuacuacccaauggaggaugaaaggaaauuaaaaaccggaugugagagaggagcucacuuuguuacuuuggaaauugagaugcuuuucucugaaaggugggaaaagacaguuccauacauuuuacgugauccagggaagcauuuuggaaauguugcuuugaaccuuuagcuggcggauuuguucuaggugauggaaacaguguaaaagaguacagggaccggguaacaaggaaaauccagggagacugagcaucauuuaaacagugccuucuucaagaggccuuccugaugacccugucccauucauugugagucagccccuugccucauauuacaguuggcccuugagcaacauggguuugaaucacucagguccacuuauacgcagguauuuuucaaccuaauucugauugaaaauacacauucccagaauuugaaacccaaauauacagaggaccaauuuauuuauuuauuuauuuauuuauuuuugagauggaguuuuccucuugucacccaugcuggagugcaauggcgcgaucucaguucauugcaaccuccaccuccuggguucaagugaucuccugccucagccucccgaguagcugggauuacagacacccgccacccugccagcuaacuuuuguauuuuuaguagagacaggguuucaccauguuggccaggcuggucuuaaacuccugaccucgggugauccaccugccucagccucccaaagugcuggguggcgugagccaccauaucuggccaacuuuucauauaugcagguucugcagggccaacuuugggacuugagugugcauagauuuugguauaugcaggggucuugggacaaauccccuucauauaccaaaggaugacuaguuaacccaaggcugaauaagauaaauaaccuuuuuuuuuuuuuauugagacggagucucgcucugucgcccaggcuggagugcaguggugccaucucugcucacugcaagcuccgccucccggauucacgccauucuccugccucagccucccgaguagcugggacuacaggugcccgccaccacgcccggcuaauuuuuuguauuuuuaguagagacgggguuucacuguguuagccaggauggucucaaucuccugaccucaugauccacccgccucggccucccaaagugcugggauugcaggcgugagccacagcuccuggccugauaaauaccguuuuuaaaagaaccaguuggcugggcaugguggcucaugccuguaaucucagcacuuugggaggccgagauggguggaucaccggagaucaggaguucgagaccagccugaccaacaugguggaaccuugucucuacuaaaaauacaaaauuauugggaggccgaggcgggcggaucacgaggccaggagaucgagaccauccuggcuaacacggugaaaccccaucucuacuaaaaauacaaaaaauuagcugggcguggugguggucgccuguagucccagcuacuugggaggcugaggcaggagaauggcgugaacccaggagguggagcuugcagugagcugagaucgugccacugcacuccagacugggcaacagagcaagacuccaucucaaaaaaaaaaaauacaaaauuagccggcugugguggcacaugccuguaaucccagcuacucagggagaugaggcaggagaaucucuugaacccuggaggugcaugccuguaaucccagcuacucaggaggcugaggcaggagaaucaaucacuugaaccugggaggcagagguugcaguaagcugagauugugccauugcacuccagcuugggaaacaagaaagaaacuuugucucaaaaaucagucagucaaucaauaaauaaaaagaaccagucaaaugcggaaggaguuuugaggaggaagagauuacuuaugaugggaggaauuggggaagacuucauggauugguggugguuguccuggauguaaaaaagggaaagggaacauaacaaagaaagggaggaaagaagcaugagcuuuugaggaguaacugaaaguccaguuuaauuggaacuaagugggugaaggggaauagugagccauaaagccagaaggguacuuuggaaccagaugaugaccccccucuaggcaagagagcauggcacuggggcugaggaggggccagagaaaggaguaagguagacaucagaaucaccugaaccugaaaaccaauaagggcagaggugcucaagcuggcuugcauuaaaaucaccugggggacuuaaaaaacaaguuccauaccuguuucccaccccacaccaguuauaaaaaauaccuaggguaaguccugugcauuuuugaaaaaaaucuuuguuagaugacucuagugcacagugagaugugagaaucacugaaacaggaaaaagaguagugaugcuauuggcagaauuucagaagacaggaggaagcguggguuuguggcgcacaagagagaugagugugguagguaauggagaaccacugguaucuaaguuuaggaaguuugaaucuguacaugaugacaaagacauccagcuggagggauccaguaggcaguugggauugaacacuuugucuaaauuuucaucuguaccaaaagucagcuaguuuuuucauaaagggccaaauaguaaauauuuuaggucugcaggccuaaaucuuugucucaaauacuuaacucugccgguguugcacaaaacaaccauagacaguauggaaacaguggcucuguuccaauaacauuuuaauuacaaaaauaaaggcaguuggccuggccaaacccuggucuauaccagcaauagaaauauaaugugagccauauauguaauuuuacauuuuauacuagcuacgcuuuuaaaauuaaaaaaaauuaauuucaauauauuuuguuuaaccuaauaaauccaaaauauuauguuagcagguaguacuaguucauuucaaaugcucaacuaguccuguguggcuaguggcuaccauauggacagugcaggucuuuacaaugugauuacaaacucuaggcuuuauuauccuccuguguaaaguaugucuuguucuccagauagucuaaacucuuugaguucuggcauuauggaguuuguuuuucugucacacaggcugcagugcaguggcauaaucacagcucacuguagccucaaccuccugggcucaagugacugggauuauggggucuuuugaugggggaguggggauuauguuuuguuuguuuguuuuuugagacagaguuucacucuuguugcccaggcuggagugcaguggugcgaucucggcucacugcaaacuccaccucccagguucaagugauucuccugccuccgccuccugaguagcugggauuacaggcaugcgccaccacgccuggcuaauuuuguauuuuuaguagagacaggguuucuccauguuggucaggcuugucuugaacuccugaccucaggugacccaccugccucggccucccaaagugcugggauuacggguuugagccacugcgccuggccggggauuauguuuuaaauguuaucuuucacagugucugaaguucugugcuugaaaccuaagucauuuggaauguacuuguuuugugggugugcugagaggaucggcaacauggcaagguaguuauuauaauauaaggugagauggggugguauguuguagaauccuggagucuuaauauuaaauuuuauuccuucagguuuuuuuuuuuuccugaagacagcaucucagucuguugcccaagcuggagugugguggugugauuauagcuuacugcagccugcaaguccugagcucaaacaauccuccuguuucaaccucccacagacaugcaccaccacacucagcuagcuuuuaaaaaaauaauaauaauuuuauagaaguccuaucuuguauuuauguuggcuucccuggguuucucuuuuauauauauauauauuauuuuauuuauuuauuauuauuauuauuauuuuuuuuuuuuuugagacaaagucuugcucugucucccaggcuggagugcaguggcgcgaucucggcucaccgcaagcuccgccucccggguuuacgccauucuccugccucagccuccugaguagcugggacugcaggcgaccgcaaccacaccuggcuaauuuuuuguuuuuuaguagagacgggguuucaccguguuagccaggaugaucucgaucuccugaccucgugauccacccgccucggccucccaaagugcugggauuacaggcguuagccaccgcgccuggccuauuuauuauauuauuuugagacagcguuucacucuuguugcccaggcuggagugcaauggcgcgaucuuggcuuaccgcaaccuuugccucccagguucaagugauucuccugcaucagccuccugaguagcugggauuauaggcaugugccaccacgccuggcaaauuuuguauuuuuaguagagaugggguuucuucauguuggucaggcuggucucaaacgccugaccucaggugaucugcccaccucagccucccaaagugcugggauuacaggcaugagccaccgcgcccggccuauuuuuuuauuuuuuuaaauuuuauucuagguuuuaagagaacuacugcuggccgggcgagguggcucacgccuguaaucccagcacuuugggaguccgagaagggcagauccccagaggucaggaguucaagaccagccugaccaacauggugaaaccccgucucuacuaaaaauacaaaaauuagcugggcgugguuacgagcgcuuguaauccuagcuaccugggaaacugaggcaggagaaucacuuuaacccaggaggcggagguuguggugagccgagauugcgccauugcacucuagcuugggcaacaagagcaaaacuccaucucaaaaaaaaagaacuacugccuuggcauaugaauuagauaucaaaaggggugaucuuuuuuuuuuuccugcuaaccucaucucccuuuccaggccucuacuacguggacagugaagggaaccggauuucaggggccaccuucucuguagguucuggcucuguguaugcauauggggucauggaucggggcuauuccuaugaccuggaaguggagcaggccuaugaucuggcccgucgagccaucuaccaagccaccuacagagaugccuacucaggaggugcagucaaccucuaccacgugcgggaggauggcuggauccgagucuccagugacaauguggcugaucuacaugagaaguauaguggcucuacccccugaaagaggguggaugcagcugcuuguguuucuuggggugacugucauugguaauacggacacagugacccauccuccauccuauuuauaguggaagggccuucaauuguaucaguacuuuuuuuuaagcucuggcacauugaccucuauguguuaccagucauuaaugagcugcugcagaggugacuauuuguuuuacuuucuuggauguuaacauuacacuacucacuacucaaucuca

SEQ ID NO: 192493 - RNA, 5353 nt, Homo sapiens
ggcccucccuggaggagaacugaaacuuaggguggggacuguagaaaggggcggagagaucagccgcccagccaggaguuaagcugaggucgucugagcccugcgacagccuggacagcaacucagguaagaucagccaaggaugggagucagccugggaucuagggcuagaaaguccagccagauugagggcaggggguccuaggggucgcucuguuagacugagggauagacagaagaucucuuaagucaggaagugggagauucagccugagagugagacugacaagggccagcuccccagacccuuguaggcaaaggucaggaggaccuacugcuggauuguucaaggaagaaggcuccuggccccagccucaguggaccauuuguuuccuugccaucuggcccugcccacuucugcugcagcuccaaccccaccccuacuuccugccccaccuacuccuggggccggcagggggugggggucaggcuagguuguguaggcuguggggcggugggugaagagccugauggaucucagcagaaccuaccucugcugaugcucgggaaucuagacagggccugucaccaggaacgaucaccaaaggaauucuuuuguaaacaauacaucucugaaaaguccuaaaauuaagaccagugcccaagguuuccuuccagguaucacagcuuagagugcuaaaaacaauguuuugggggguuuuguuguuguuguuguuguuugucacugcuagugauggcagaaaggaaacaauucugucccauagaguguugaaauguguuuggagcuaaaagaagauggaugggaucucugggaccuguugccagaaucuagucucaauggccagggucucaggagauguucccucccaaagugucaguucugaugcauccugcuccuauuaucccccaggauggcaucaggcagggcacgcugcacccgaaaacuccggaacugggugguggagcaaguggagagugggcaguuucccggagugugcugggaugauacagcuaagaccauguuccggauucccuggaaacaugcaggcaagcaggacuuccgggaggaccaggaugcugccuucuucaaggugaaagggccuggaaaccacuguuccucugugugugggaugguguauacacacugguacacucauccucgagcacuugcgucugccuggguuucagauaagggacagauuggagaggaaaacuagcugcaucauuugcagaguccaguacaaaaugaaaauguggaggccuuguucaaaaauuuuagggauauuggccaggcacgguggcucacgccuguaaucccagcacuucgggaggccaagguggguggaucacgaggucaagagaucaagaccagccuggccaacauggugaaacccugucucuacuaaaaauacaaaacuuagcugggccuagcggugcaugccuguagucccagcuacucgggagacugaggcaggagaaucgcuugaaccagggagguggaguuguagugagucgagaucgcaccacugcacuccagccuggugacagagugagacucugucucaaaaaaaaaaaaaaaaaauuuccaaggauuucaagauggcaacgcagagcacagacccugcauaaucccuucugagcucagagcugcacgccuguaaagccaguccuauuggaggggcagguggagccuguaacacacugccucuucuucccuugcuuucuuuccuaggccugggcaauauuuaagggaaaguauaaggagggggacacaggagguccagcugucuggaagacucgccugcgcugugcacucaacaagaguucugaauuuaaggagguuccugagaggggccgcauggauguugcugagcccuacaagguguaucaguugcugccaccaggaaucgucucuggugaguuuccccuuguccaaccacugcuagacucagcagacuggggaggaaggauagaugugcaggcuucccccaggcuuauagcucugcccuguccaugcccuuggggggcugcaacccagguuucccuuccuagaccugcccauccuucacugccucagaccucuccuucacccucuguccuugcucaagacccugaccuuucucugucccucaacaauuccacaggccagccagggacucagaaaguaccaucaaagcgacagcacaguucuguguccucugagaggaaggaggaagaggaugccaugcagaacugcacacucagucccucugugcuccaggacucccucaauaauguaagagauggagagggaacugggugggccuaagggcaggacaguaaccagagggagaggugggccaaugaaagacacugugucuugggaggccgaggcuggcagaucacgugaggucagaaguucgaaaccagccucgaccaacauggugagaacccgucucuacuaaaaauacaaaaauuagcugugcguuguggcaucugccuguaaucccagcuacucaggaggccgaggcaggagaaucgcuugaaccggggggcggagauagcagugagccgagaucgcgccacugcacuccagccugggcaacaagagugaaacucugucucaaaaaaagagaaaaaaaauaaaaagacacuguguccgcaggaggaggagggggccagugggggagcaguccauucagacauugggagcagcagcagcagcagcagcccugagccacaggaagguaccaccugcccugccucuugugucgucccccaugccacacccucuggcccaagacuccccagucccacucugaaugaccagugccuuugcuucccuuccaguuacagacacaacugaggcccccuuucaaggggaucagaggucccuggaguuucugcuuccuccagagccagguacguggcauuucugacuuucuccugugcccugugccccugaggucuuccaccuuugacuaugcaugcauuaucuagucagucagggcuuacagcaaacuguacccacauuaccauagcccuaggcagugguuucuagguggcgagaauuccauaugccuggccagacuccaaaaagcuugcuucccaaaaauaccacccuauacacucuccuggaaaucuacauugagacauugauuucauugggccaaacagaggcccaaucucaagggaccuucuaguaaacuacaagccccugggcauugagcccugaggccucauggugaaucacauacuagcuacuugccucagugauaggaaaaccugagaggaagcccccuggcugguguggggaggggagguggaguuguuccccuggggaggggcugcugccagccugcaugcuccuccagcaccagguagggcuguucuauccccagacuacucacugcugcucaccuucaucuacaacgggcgcguggugggcgaggcccaggugcaaagccuggauugccgccuuguggcugagcccucaggcucugagagcagcauggagcaggugcuguuccccaagccuggcccacuggagcccacgcagcgccugcugagccagcuugagaggggcauccuaguggccagcaacccccgaggccucuucgugcagcgccuuugccccauccccaucuccuggaaugcaccccaggcuccaccugggccaggcccgcaucugcugcccagcaacgagugcguggagcucuucagaaccgccuacuucugcagaggugaggcuguucucucugggcacaugagcuuccacccccuaccucuuaguacccccugggcccaacuuguuggguccugcuaccucccuaucugccagcagauccuccauguagccuaugcauggcacuccugcgcuuguguguugcauauccuguguggccauaugcccagccuggcagcuaccuggcagcucuccuccagccaagacaauggaagaggugguucagguagagcccagcacaagagugucauaucuuggagaacaccaucacacugaagcaugcagucacuaugugaaggugcacagaagaauuggcacagagauuuugagccucauggccuucuccuacguacacacauuugggagagcuggcacacaucacacacacuggcccuggcugcaccgucuuuaccacacuccaggcaugccuuaggguugcgcuucucucccauccaauuccagcuccuacucaauucuaaaccugaccuuaagagugggaccagguguacagggggugcagaguguggguguucccagggccaugggugcccuagcacugggaggaugugagcaaguagcaaaggucugggcacaucugaguuagcagccagggcugcuaccugggaggacucuaaacucucccagcagagagcuugucgggcugugcugugaucugcuacuucuaagcacuuauaugaggcaggggcacccuuuccuauuugcacaugggugaguagcacuuaguuccaaguacuucugaccuugcagcuccugcucuggcaagacccccuccuaccucucuccaucauggguuccucacuauugccucccugccuguggcccucucucuucuuuuuguucuucgaacccuugacccuuucucuuucagacuuggucagguacuuucagggccugggccccccaccgaaguuccagguaacacugaauuucugggaagagagccauggcuccagccauacuccacagaaucuuaucacagugaaggugagcucggagcagggguagaguacccaucuaaugagagcagagacaguggugcuccaggaggcaaagggggucucccaguggggaaggagcuccuggggguggugucugucccugaugcacgcacugagaugcucuucuccaucucuuccaauacagauggagcaggccuuugcccgauacuugcuggagcagacuccagagcagcaggcagccauucugucccugguguagagccugggggacccaucuuccaccucaccucuuuguucuuccugucuccuuugaaguagacucauucuucacacgauugaccuguccucuuugugauaauucucaguaguuguccgugauaaucguguccugaaaauccucgcacacacuggcugguggagaacucaaggcuaauuuuuuauccuuuuuuuuuuuuaauuuugagauauacgcccucuuucaucuguaagggacuaggaaauuccaaauggugugaacccagggggccuuucccucuucccugaccucccaacucuaaagccaagcacuuuauauuuuccucuuagauauucacuaaggacuuaaaauaaaauuuuauugaaagaggaa

SEQ ID NO: 192494 - RNA, 14097 nt, Homo sapiens
uucauuaaaaaacaguuuauuagcaucuguucccccagugcaagugaagacugacucccucuccgggagcccuggacucccccuccgggagcccuggacuccccaccugagcuccuggggagcugcucuguagugugccccuaucuuggggcaauguccuugcucaucugacuccagucccauugcuccuggcacggggcuaagcuccaccucgagaugccauagggauggucucuccuaagugacugucaccuccagcgucugagaagaagcccccauccccaggggcuggggccacauccaccuggaugacaccgugcaccugggagagcugugggcuguccaagcuggcaaugagcuggcgggggccuggucgcacaggcacaaacgacuggcgcagugucacuguuucauugccuccaaugucccugugggcagagacaaggucaugggccuggaguaauuggggguggaguggggaguaagagcugauccagggcagucaggaggaagaagcaggagguggacccauucagacaauuccaggcuuaccugaaauuuccacacccaagaccaggauccccagggcgccucugcauagccagcucagcagccacccaccagcugccugugcuggaacucuccccaucgucugggacuccucccucccugcucccacauccaccuggacaaagacugcugaugccaccgcagaggccucucaugccauccccuccaucaccacugcuccugccccagacagaacauccucaucucaccugggguuuccaaaaccaagaaaacuucaaaaugagacuuugggggcccaacacaauauuuucaaauacuuucaguuuugacaagagcauagguugaagaaaaguaaucacucucugcuaugaucgucguuccaaagagaaaagagcauuuucacacaccaaaacauuagaaggauguuaucuuugaaaaaaaaggaaaauccuucccaagaacagacaacagacaucuuuaaauggacauaaacccuuaugucucugugugugugugugugugugugugugugugugagagagacagagagguggguggacaaacacacacacacacacacaaccaguguuuucauuuucuccuuuccacaugggccucugaaaaauugauucccagaccuccccugggaaucaugauuucacuaguccucuaacgggacuccuugccucgcaucccacuuuuguauucuguucugcuaaccacucagaggugaacuaaauccuucaaggauuuagugcuccuuuggugcuuguggcacacgauccuggcucucuaacuugacacacaggcucacucugacccagucccugcuacuugcacagccucaucaccccccaucauuccuccugcugagcagcccuaccgaaugccuucuuccccagacucaccuccacagucaugcuuugcagucuuugccuuguguggaaugagcacccagcucugccuccccacccuggguguccuugugaaggccuacuuuuccuccaaggccuggcacaccacuuccucagugacggcuccccugagcaccuccugccucuaggaaaaggaaacucacccuucucugagcuccuccagcaaucugcacguuucauuuuauacacugaacaugacugcauuuauauugcauuugcucgugccugugggaauuuguccuuccugccuuugccuaaaccuuaccucuggugcccuauucaacccaagccugccgcuggggacccuuuccagacauagaaccugugcauuaacuauuguccucuaagagaaugagccaacaucccuaacuccaaggaugaguuuuuuucagggcaaagcauuuggcuuggaaccugguucugagggguuucccuggaccacucuacucccuuuucuaccacuuguuagcugugaggcuuaugagaagcuauuuaacuucucuguuccucacuuucugggucauaaaauggaagugaaaguaaaaggaggagugggaucugauuaucuugaagguguuucugagcucucugaaggagggaggcagggauauauaauagaacguaguaugauaggaagucuauaaauuaagucuauaacuuaauggcuaggcuauguccugacugcuuacaaauuugcacucuuaauuuuugcuaacuuuucauagauacaagauucaagguuguucaagcucagaccagcccucagaagucuauuuacucuauaccauaauugaacuauaauauuucagaaaguaaccuuuacauugcaguaacggauuauuuucaagagaaacuguuuucuagguggaaaugucaagaucucucccuccccuggucucauugugaggugggggacuuuaccacaccucuuuugugagcugaagcugaguacaagccaucugcuaaagcugggauguuccuggaacugagugugggucaugaaaccaacuccccaacaaggacaccagaacuuagacgucgaaacgagcauuguccaauuguguacuuguucaaucguauugccugggcuugaaacauguuuaaaacuccuccuggacucuucuucagagccauuuaaaccauacacacaggcgugugcucagugaugccacggucagccuguccuuccuuccacagcaugccucgguucugauggaaaagggcaguuacccacuuguucacuuaucuuauuaauuagucuuagcucuugaugacuucagguuucucugcaaagucaaaucuaccccuaagaaggcagacugaccacucugaggacauucuagagaauaugauucagacucugagggaaauucccaggaaggguuuggaacagacuuccagccucucuggugacugcuuuugguggugacaacagccaucuggaggagugaguucuggaauguuuauuaaguggccagucaccacagggggguggcacaccuuaugcuauaaugggguuccaugccacagccucugaugugcgaaugagaggcaaaguacacccaucuuggaaucuuagguaccugaaccaacagcucagagaugucccccuggaggcucccaauuguacuggaggcucuggucugggcucacagcagcuaaggagccacagacuguccagggaggaucugccuuaagaaaccaucauccaacccugucuuuuacuguagggagacucacauaaacccuacagcuaaagacaggaaacaggucccccaacacucagcacaguggcccuuuccuuacuuccaggcagggccaagaggcaaaggccugguggggcugcugaggcaaguccagcucugcggaucccuuaggacgaggaaccuccccccaccaugguggggguguggguaagagaugccugcugggcaagacuagcagagcaggcuacccgggggguucaggcucuguucacugagcugccagagaccaugguauggugacaugaggaaagcccuacuuugugacacaucauagcauucccaggggcccaggcuggggcaaagaucaacauagcuuccuucucagcuuuggccuaauggcgaagguggcagccaccaccaggagagcugcugugugugagggaggggugggcaagugggcaggggguccucugcuuccuccccucaguuuccccaccccaagccauuguucuuucucaggaacucgcugucugaagaugaagccugccccugucccagaaggcugaucuagaaggccaggcucuggccugcucugcuuucccuccgugcuuuuccuaggcggggacggggcagcacguguaagucuguaucaaagaugacagccgcaggcccaggaacacagcaugugugugcccucacuacacccaggggcuugcccagcccaggaucaggcccagacgggcuggguaagggccugagggauggaguucucuccucuggaacugcuacuuggcccucauggcacaaaacaaacaaugaguuugagagccugugcaugguaugcaccacagugggaagagcagaguuugcccccuacgagcugugagaccauaugagaugugaccgccagcuuccccaucuguaaguggggguaauaauggcaauaauaaaaauaacaacuaccaauggagcacuaacuuugugccaagcagugcacuaaacaacccuagguccaggggcuauugcuaucccugcuuuacaggugagaacacugaggcuugaaggagagaagucgcuugcccaagggcauauagccaguaagugcuagagcugaacccguaucauuaggauuccaaaacuucgcuugugugugugugucucugugugugugugugugucugugugugugugugacagagagagagagagacacacggggucucacucugucgcccaggcuggagugcaguggcacaaacauggcucacuucagccucaaccucuccaggcucaggugauccucccaccuuagacucccaaguagcugggacaacaggcgcacagcaccaaaccugguuaauuuuuuaaaaauuuuuuguagaaacaggguuucaucauguugcccaggcuggucuccaacuccugggcucaagugauccacucaccuuggccugccaaagugcugggauuacaggugugagccaccacaccuggccuucuaauguacuuaaauuagaguuuuuguguccaaaggagauaauauuccugaaagggccuggucaauucuucagugcugggcaaauauuagcaaugaguuacuaaugauuccuaugugggccuucugcucccuaauuagauagugaggcagggcaaggacauggcauagcaccaggugcccaagaggucucccuaaaggcuggugggacugagcugggccgggagguauugcuagcuggccccaaccugcuugguuggguccugacagaacauacuuguccagacagagagggagcaaagcugggagccagggcagccuguggggaaggccagaguggaagcagggguagggggagaggccagacucacccaacguugaggaucuugggccucuguaacccagagccuucgagccggaagacgacauuggugagggugacgggaaggggguucuugaagacaaucuguacuucacacuccuggccaaccacugcugcucccaguaacugagagaaaaagaggcccaucccccacgucagagacccuggccaaacacacggggaccguacacugcaccagagaggggaagcugcuuagaagcaaaaccuccccgagucccacauuuauccuccugagagaagauuccccagaagucagagaagaaacuccaaccuauuccucaauaaaggcugucacagaaccagagacauaagaucccaugcuacagaugaggaaacugaggccccagagccgguccuugaccuucuccuacaaaggcucaucaggccagccugcugcuggcuuagcgcccaccucugauguccuuauccccuggccuucacucucugaccaccccucaugccccagcaaacugcauucaccgugagggagaggucuggggugcgcagacggaaggugugcugcuuggccagcaccugcccgcucuccuugacguggccugagacauugagcagcauggcccccugguccacaagauggggccgguauuccuuguaggccacuggcauggucacacgguccgcuguggagaagaggcauggcgucacugaggccugcuucccuacaugaggcuucccccagggacuccccacugcuccuggggucuccauguccacagcccugaggugcccagccauccagggggcagggcuggguaaggagcacuuacaggccccuggugccagcuccacuuccuucuuggucuccuugaagaugguaccacugacaccaguauagaaagugacugagagguagaggugcaguuucacugugcggcggcugcugcugugauugaucagcaucacagagaccaucagauccugccccaucaccgcguccugugccuccaccugcauggccacauccuccgcugagccccgguuggcauacacauuggguuugcugccgugggcugcugcugucucuacugccuuccgcucugcgucugagccuggggguugagggucaagggugagguuccaauucccacguggguggccaagcacuuggcaggaacacuuguuguggggcccagagcuggcuggguugggggaaugguaccuucugggugcuuauagagguaggugauguccucccgcauguuggagcugauggccuuugugacaaugagugugccgauggccuucuccuccacauaaacaaucuugaagcugccaucauccugccgcugccaguacaccuugucacuauucaccuguggggggugggggugagcaggaaugagugagccagagggucugaggguggccugacucccggccuccuuccccugaucccaggagcuaugggacagggcuuggucccaagggugggagcuuccuggcagagcccaaggggagacuuuccaagacgagccagacgaggccagagugcagggaagaagcuggucugggaggcuccuggcagagcacuuuggcaauaucaguaaucccucacacucaauggcugacuuuacgacuagugaagcaguuucauacccguuaucucuucugaucccgaguauaggaagcaaggcagccuugauuauccccuuuuacaggugaggaaacugacuuguauaaugagugacuugccccgggucgcagagcuggucagucagcggugaaguugggaccagagaacccaugacugaagcccaagaaggcaccuggagcccagcccucaccucagcaaaaaugaaaggcgugucguacuucauguagaccaggccauucuugauggacuccacagagcaggggccgcagcagaagaugccuagagagugaggcgggacagaggcaagagaucugagaaggcggagagggcucuucagacccuggguaagguccacacagggccccagccccacccacucaggcccggucccacugccugguggccucuggaacaaggucaucagcccugacccaaacacuugggggucaguugacagccagugcaacacagguauggaaaacaaagagagagcggcuccauuuggcucucaaucugcuuuccucagcccaggcugcucugcuggaggaugggggcaggguacagaugugcggaccagccugccugauaaccaagucccugacauacucuuucauggcuggcugacacuggauguccaccaucugugacccccagaggacaggacgccccauccuuuaucauaaccaacccagaguccacaguggcccugccugcuggcugggagagcgaggacaccaccgccaccaccauuccagagagaugcggaacaacccucagcucugcagccugcugcccuuucuacuggggggagcuggugggaaauagagucugcccuuaucauacucaggaggcugucuagaagagauaggcugacaggaagaggccuggcaagagaggacagagugguaagugaguaccauccaaccggaaagaaucuuagacaagacauaacacuacacacuccuuuacagacggggaaacagcaaggugaaguucaugccaggaucucacaagacagguggugcagggagaaugaaaggagcucagacuuuuugaguagcugcuacacucccggcaugcugcuggucccuucagauacagaauuucucauuuaauccucccaaucaccauauaugguaucuauuaccccaaauuacauccaaaccaccaaagccuaaaaguucgaggugcuugcccaagagcauacaucugagaagugaucaggcugggaucaagccccagucuggcuggcccugagcccccugccugauguccaccccaccacuucccagaguugggggccagagcucagaucugccagcgucugggacaggcuguuucagcaucacaggcaucaccggguugcacagcucauggggcuguguucacauaucugagugagagggagggcacugggaagaggccaggggaggaauguaggcuagggaggacucucugaccugggguaagggagaggcuggacagaagguagcuggcagggcaggccugguggccuggggcugggguaucacgguaagaagggguggggguuuguuugagaacagaguguaugguaguucuaauuucugcagaaacacauguauguggacacagaaaagagacccguugguuauauuaacaguaauuauauauuaaggcagggucauaagggcuauuuucuucuuugaaccuaucugagcccugauuuuuuucuaugcuguauauauaacucacagugagcaauggaacagacaggaaggaacucguugaaagcaagaguaugugcuuaaaaggacuggacuugcucugucacugaccuaccacucugugccccagaggaggucacuccaucucucuggccacccuuuggagugggucaaaaaauccggcugaucgucagaaucaccagaagaacuuucaaaaauauacauuguuagcaucuauccugggaaagucuaauguaucagguuuggaguagaaccuagaaauuuacuuuaaaaauauuuuugaaaaaaaacccaaauaccuccugagagagaauagggaagcuuuacauuuuguguuguucaauucuauacuuuuuuuuuccuuccaagcauguauuacuuauaaaaaugacuuuaaaaugguccuucaguuaauuaucuccaggauauguaaguuaaaaagcaaguaagaauagugaauaugaauucuuucucugaauacucuuccagcuuuugaauuuugaaccucccuuguauauuaaccauuauaaauaaaauaaaccauuauaaauaaguaaaauguaggcaaauagagaguuauauagaaugguaaaaauaaacuaacauccacguggugguucagcugacaaacccguuuaagaagccgcgggguuacauggcuuggcucuccggcccggcccagcacugacacucuggacuguguuaaucaggugggggagauaagcaggggcaugguggggaguggggggcccagcuuaccacugcuagucucuugggguguggcauccaccaccugccacccaucaaagcccgagggcagauccggccucuucauccagcagucguuccacacauggaaguuccuggauggacauggaggaggggcugggucugagccccagggucaggaguccucaguuuccccagccuccccagcccugcccacccuccaccuccaaagcucaggucaccauucuucagcacagaugggcaguccaccccagcucaccagacagaaucaugguucaggugcuccaggggcuucauguucucgucgaaguagauguccaugguaagggaugugucugugucgugggcggaguugaaguuggugacaguacggguggccagacccaggcagcgcagcacuguggaggagcgaagguugggguucaaggcauggguugggggcaagugaggcaucgugucaggaguaucagggggagaagggcaacuaggauugccaagcugggcauagacugccagggucagggccacgggggccacaaggccuuugggcuacagagcacuuggggucaggggaagcuaggccaccugccuggcucaguccuugccugucccuucucccuccuuucccuuaggccucucucuguuguuaacacuaauuaaugauaauuaaggccagccuauuacccacccccgccugcacccugcacuguagccacaucugggcagggcuggguaagccuggcuuuccucccuucucccuguagggcccgggccacuccugucccagucccuccacuaccugugguggucacgccagcaaagacccagcacuggccauaggggacggaauaucccgugcguagguagcuaagcaggaucuccacgcugcccacccacgcugauggguuggugccucgggaguaaucaccagaccaguucccaaucaggacuccauugucauccagggaguucaccugcccaggacaggaugagauagggcggagguggaggaggggcucaggaccugccaugugguccauggggaccagccgggccccgauccugcaaccaccccuuaccccuaaaugccucaggauccagacaccagccugagcuccacccagcccuucccucagccaucugccccccucccacccgggcucugacacaggaaugugaauccugggugugccaaguuuuggguuuggcccuacauuccacaggagcugggacaggagccaggaaaggcgggguggggggcaggcaagggagagaagaggagggagaccccuuccugaaguauccuuuacgagggcagggacagggcuggggguucuugaggaauccagaaagggcaggaggaggguggggguguggcgaggcagcaggcacacacacaguaggacucagagaugugagggugcucaccauggcagagaugacccgggagacauugacugggucuccacggccuccauauggcaucccccgccgguccaggauguauaagcaggcauccagcaccccguggucaaacuggaaggagggauggagggcagaggugacagccugaacccuaggccagcacccugcuccaauaccccagcccccacacccaccccagcuccucuggguguaugugacccuggccagccgcaccauaccuggccguaguuccagguccgcucaccaaucugugcuucggucccguaguaaauucucccagacucauuaagaacauacuccugccgccaauccucaugguccacguacacaauguccucuguguccccagaacacacaaaacugguucccuccaguucucucccugggccucaccuacuucuggccaguucugcaggacucauguccacagaagaaaaugcggggaugccccuagccugacaggacugcugugggaggacacggggagcaugacagaugguggaggagauuggcuguagccaggggccuuugccaggagagguguggcuggcugugugacccugggcuggccaccuuucugcaccaggccucgguccucucaucugcccaaugggaggcuggcuucuccuggggucaggcaccuaggcaccccgccacauccgagggcaggaagcccuucccugucuuucccucccaucuacccucugcuccagaccccagcugcucaccugggcaccagggguugaagaggauguagaucucauugcgggggucaaagggcaacuggaacuccccagcgucugauugugugcggacugugaacugaaacuugccgaugauggcguugggggaaguguggacccgcagguucagauucugcccacuggccuugaccaccugggcuuuccagccuccacugccccccuugcccacugggaugaucacgugcgugcccuugcccaccucgggguuguuuccuagaguaggaaaucagcaauuagcuggcaaggccucccugaggagaggggauggagccugggacuucucccggccccacccacaauguguaugagccacuguguaugucccuacguugggccaucaccuuauucucugacagucucccuuagagcagcucugucuccacccaaugcuugcccacauguuagggcagugccgcaguccaacaucccaaaccuguuccccugacacugaacucugagguggggaggagagacgagggcuccugucaccuucugccugccugacuaucacagugccugggcuggaggggcagauccaccugccccguaugaaagggcaguccugauccugaaggccaacccugccugcuuccuggggcugcagcuuccagagcccagggcaucccugguggaggugguagggguuccugggaaauuaaaggaugaggugggcaagguuaggcccuaaucaaaggguaaaaggagucaccugccccaggcagcagcauaaucaccagccugagaagucaagcuacaccaagcaacgcgguaagggaggcaccugccuugggucauggggacagagggacagagacagagagagacagaauuggcagagaugggggacauggaaggcaagagggagagagagagauagaagagagaaccagccacauccuggggaaugagaacagaugcacaaaggacagagcagcaaugccgaaggaggcaccgaggcaggcccugaagaggaguacucugagaccgaugccccaggaggcuugaggaggaugggcuugggaaaaacugcaacaccaagacccucucugagacacaaccccaggggcacacccacacacuugcaccugccuuaucuggcagaggugaggaguggggcagggaggagccuaaagaccucucugacccuaaugccagccucuccccaccaaacauagggccuucacccgucccaauccaagccccacugaccgaugaguaacucaagggugaugcgaucagaggauucauagguccgggacaggaggaggagcauauggaaaggcugcccgcggcgcacuaucagcucgucguacucauacucgucuguguggugcucucggcgguucugguccgagcgcgagcucagcaaguccacaccguucacuacuagcaugcccucugcaaggacacagcuccgugucagugaagccccaugaggagcccaggcccuuaucauuagcuuccuaucccccccagaaaugccaggcugagucucuggucccauuaaagccuuuuagcucucagcugaggaggacagaccggccucaccucggauggugccaucuccagcugcauugacaccgcugccccgggauacaggccggcgggagucugagccccgggagccaggucuucgagugccagagcuggacccucgaccccuggagucagaggguucagguccccagucgucaucugccgcauuucggcaugaacagcagccacagcagcgagcccagaaggaacggccuccuccucugcgagagcguccgucuggcucuggcucuggcucuggagauggcgugguagggggcugcaagggguugccaccccaacggcccacaucggaacguggcccauccaucaugccuguuaggaagaggcaggguggcuccuuaacccagguagucccagccaguugacccagaaacccuccauccagacagcugauucagucccacccgaugaccgaaacaaucccaccuuggcccagagauucuccagacacauccagagaccuuccgcgaagaccauucagacucacccagagaagcuucucaugcugcagagaaaagccuuccccucacccccaccaaacaacauccgaaaaacugcccaaugaagaaacccacucaacgauccaucccaggaaauccacauaguucccugcauggacacuugucccagccucaagacccagcugcacacacaucagagugcuccagcaucccugggccugguccguccaccugcuagcucugcagucuagaggugcacaacacugacagcuucuagaacucauuucuuagcagaaaucccccaacucaagguuccucacaagacagacaagugaccccggggccugugguccuuggcauucccaagucagggaagaccccacuuggggcugccaggagggguagggcauggcaggugcccggagccugugcacagggaaagcagagucuugguguugggaacagccuagcuggggcugacagguacacagcuggcccacaccccaccuugcuggauccaggcacggccucugauagugugggccgccuggacucggcaccacaguacccgugggagccccucaccuggcagcaguguuggcaaccgcaguacugaguccuggggcugagauggaacaggucaggauggaugggacaggacccacagacuggaugccgcagggacagaccugguaagugacuuaugu

SEQ ID NO: 192495 - RNA, 39812 nt, Homo sapiens
guuacgccgcugauguggaguagggccgagcgcggaacgcgaggggcugcugggguguuugucgcagcggguuuuccucggcgguuugcggagcugcuaggauggagcagguugcggagggagcaagggugaccgcagucccugugucagcugccgacagcacugaggaguuggccgaagucgaagaaggaguuggaguagugggcgaagauaaugacgcagccgcgagaggagcggaggccuuuggcgacagugaggaggacggagaggauguguucgagguggagaagauccuggacaugaagaccgaggggguauguggaggggccccggcgcggggcugggcggggagcuccgggccuggcggggaggacgcgagcuggaaacagcacgggcagacccaaaacaggagcgggggaggaaugugagaguucaaugcaagcacgcgaaaucgugggaaaagcgaagugacauuuccaacugcacucuuagggcugagugugugagggaagcuucagcaaauuuuggaggauuguuuuggccgaagagacgaagcaguuugggaugugguguguggugaucacaaggcugcaggcagcuggugaagggagcugcugcgcuuuggcgugauaugauagugaaguaaugcuucucgucguaguccacuguccacgccaucguuacaguguuuuccaaaaccguaaccaacucccugguuuaaaaucuuccggaauuuucauuugcccuuggaguaaaaucucaaucuuacccagaggguggcauuuaaaggccuucauaaccugaucagcaucaucccucucuccccuaugcguuguauagcucgcagccacacagaaauacuuggaauucaucacaccaugccuugguguuuccuguucuccuggccuggacaguucucugcccucuucuucuggugaaaucuuacucaaaugcuuccaaggccucgggguguagcucucugggaaagcuuuuuuugacccuaaccucugcagagugaggagcuucucaucucugcucuuuuuacuuuuuguauugaccucuaugaaggcauuuaagccauuaucguucuuuguuugucucuccugcuauauguggucuccuuuaauccaaggggaagcauggacaauaagaaaacaaucuguuucaguagauggaugugagguaaacaaaggucccacaguggucauucuguauguuguguuuucauugucuguuauuucccauuggucauaugcugccuugugucaauuuuuugcgcauucauucagcauuuuuuaucaacuacuguaugccaggugcuguguuagguccggacaauauagagauuuuaauugaagcauacacaguugcuaauaguggaaacuuuuccuaugaggaguuaaguaauuaagagcugaugucauuaauauuguuauuugcaauaaagauggaaauguuuuuauguauaauuucuccaaauauauuguaagcacuuugaggugaaaggaugagccacuguuagacuauuuuguaucacuugcauuuaacacaauaccuggcacacaggagguauuugaaaaauauucggcuagggccgggcgcaguggcuuauaccuguaaucuagcacuuugggaggccaaggcggacggaucacgaggucagggguucgagaccagccuggccaacauggugaaaccccgucucuacuaaaacacaaaaaaauacaaaaauuagcugggcgagguagcgggcgccaguaaucccagcuacucgggaggcugaggcaggagaauugcuugaacccgggaggcggagguugcaguaaaacaagauugcgccacugcccuccagccugggcgacagagggagacuccgucucaaaaaaaauaauaauaauuuggcuagaaggauaaaaucuuuagaauuaagaugauucucauucauacaguguuuaauuuugccagccucaaagaauuguaagcacuguauaccuaaagccucaccagucuaaagagggugaaacuaagaaacuuauuuguguaaggcaauuaggcuuuaguguugugaguuaaaauucaaguucuugcauuuuuaggugcucuugugaaggagugguuuauaugauuaaagaugauaugguuuggcuguguccccacccagaaucucaucuugaauuguauuccccauaauucccaugugucaagggcgcgaccagguggagguaggaucgugggagugguuucgcccaugcuguucucacgauagugagugagucucaaucuggugguuuuauaagcgucuggcauuuccccugcuugcacucacucgauccugccacccugugaagaaggugccugcuucuccuuugccuuccgccaugauuauaaguuuccugaggccuccccagccaugcugaacugagucaauuaagccucuuuccuuuauaaauuacccagucucagguauuucuucauagcaguuugagaacggacuaauacaaaagguguuagcggaacaggacuauugcaguuuucuguuuucacugcugagugaaccagccgguugguuagccaccuagccauugacaaacuuaaggguacugcuagcgguuuguuaggccuccuuauagucuagucuauagucuauaaucagaaacacuuacaauugauucacuuuuuacuaauuaauaauauuucuugauucuaacuauauguaugaauaauuaacauaagaacuguggaaauacauacauacaccaccauuccaaaucauuauuuauaauuuauuugggguaauagaguaagcagagaauuaaauucuaauaguguauauuaauuuccuuuuuuuuuuuugagacagauucucuguugcccaggcuggagugcauuggcauaaucauggcucucugcagccuugaccucccaggcucaaacaauccugccaccucagccucucggaguagaugggacuauaggugugcucuaccaugacuaauauuuuaauuuuuuauagagauggggucucccuacguugcccaugcuggccuugaacuccugggcucaagugauucuccacccuuggccucccaaagugcugggauuuacaggugugagccacugugccaggccaauuuuuuaauuuuuuuaacaaaauuuuaaacuguugcucuaguguauaugaucugguagaauaggggucugccuuuuaguuuggcucacugauuaaaggaaacuuuggcuaccaagaaauagacugcuucuggaauuuugaagucaaauuuauaaauccuagggcuaucaugcaauuuccuuauacauggcaaaacccuggacaauuuuuuggauuuacaugacuccauacaaagacguggaauucagggauuucaucuguauuuguauacugccaugcuccuaaaacucagaagguuccugaaacauagugaccacguucaauaacuauuuguugaaugagugaaugaaugaagcacaccuguugaaguaaaggguaacaauuaucaguaaauuaaaucuggagcuauaauuaagauauguuccuuaauacuugaaaauuguucuuaauacccuccucaucaauuaggucauauuucacugauaacuagcauuagauuuauaacuauguuaauguaaaagguaauuuucuagucuccacugcuuuuuaaaaauuaucagaaauguaagaauuagauagacucucauauaccuucacccagauucucuaguuguuaaucauuuauuuaucuuuuuucuguuuauguacauuuuuuucuggcccauuugaaagugguguuuuuaagggcuauguugaauaacgcauuuaccacuauuuuuaugcacacacacaaacaaggaucauuuuuguucccaugacccauuacugauaaaauuagcugauaaaauccacccgccucggccucccaaagugcugggauuacaggcaugagccaccgcuccuggcucugauguuuauucuaaaaccaaauauauugcuuucuuuuaggcaguucugcauacuauugacuaagauuucuuuucuuuucccccauucaugcaagcuaagaagcugucuucuuagcugugcugucucaucuuuaauuucuucaguuuuaauuaugccuuuacagaagacagaagcucuuacaaaguuauauacaggccgggcgcggugggucacgccuguaaucccagcacuuugagaggccaaggcaggcggaucacgaagucaagagauugagaccauccuggcuaacauggugaaaccccgucucuacuaaaaauacaaaaaauuaggugggcaugguggcaggcgccuguagucccagcuacucgggaggcugaggcaggagaauggcaugaacccgggagguggagcuugcagugagcagagaucgugccacugcaguccagccugggcgaaagagugagacuccaucucaaaaaaaaaaaaaaguuguauacaauaguuuuccuuuuguauauuauuuugccuaaaagaauaugcauauauucucaauggauaaaaucaccaucuucccacccauuuaauguagcugaacaguaaaaauaaaacuguauugcugaacaauaaaacuguauugauguacucuuaacuauuauuuuaaaauuuuaaggcuuuucaggcuuaucuuuaaaaguuaagauuuugaggcugggcacgguggcucacaccuguaaucccagcacuuugggaagccgaggcagacggaucacgaggucaggagaucgagacuauccuggccaacauggugaaaccccgucucuacuaaaauacaaaaaauuagccaggcgugguggugugcgccuguagucucagcuacucgggaggcugaggcaggggaaucacuugaacccaggaggcgaagguuguggugagccgagaucgugacacugcacuccagccugacagagcaagacucugucucaaaaaaaaaaaaaguuaagauuuugaauuuguucuuuuucugauauuucuugaguucagauucuacucagugcuuguacuugaucuuucuacacagauaacugaaugauugaagggcaguguggguacaauugaaggguaaaauggguggggagcaguucuuggcacuucgcuuggaaaguuuauugccuuggugguggugugaagaaaaucaggcaaguguuaaguguguagcuagaauggugcuagcggaucucuugaggucaggaguucaagaccagccuggccaacauggugaaaccccaucucuacuaaaaauacaaaaauuagccaggcguggugcugggcaccuguaaucccagcuacuugggagggagaggcaggagaauugcuugaacccaggaggcagagguugcagugagcugagauugugccacugcacuccagccugggcaacagagcgagacuccgucucaaaaaaaaaaaaaaaaauuuaccauaggguuuuuaaaaggcagcuugguaugggagacaugugggaguggugcuacagggucugugugucuuuguuuggauggcuauuuuggcuagucacccaucuggaggucugguuggcgcuggugguagccuaguugcuugcgacuccuccugagcaggaggauucuacagugccugguuuguuugagauuagccucuggaaugucuuuuuuuuuuuucuuuugagauggaaucuugcucugucacccaggcuggaguacaauggugugaucucagcucacugcaaccuccgccuccuggguucaagcgauucuccugccucaggcuccugaguagccagaauuacaggcacacgccaccacacccggcuaauuuuuguauuuuuaguagagacacgguuucaccauguuggucaggguggucucaaacgccugaccucgugauccaccugccucggccucccaaagugcugggauuacaggugugagccaccacaccuggccuacccucuggaauuucuuaagcaagagcauaauuagauaagcaugcauugcuggaagagagugucuagagaggaaaggaaugcagggguaagagaggagggaaggaagaaaaagaaggugauuaaaauauauuuuaaaaacugagguccccaguuacagaugcauugccaaauccaaagucgugaaaacuuauuccuguguuaagaauuuuaugggccaggcacagaggcucaugccuguaaucucagcauuuugggaggccgaggcggacagaucucuugagcccaggaguuugaaaccagccuggccaacaugccgaaaccccaucucuacuaaacaauacaaaacucagcugagcaugguggugcccaccuguaaucucagcuacuugggaggcugagcgaugagaaucacuugaacccgggaggcggagguugcagugagccaagaucgcgccacuacucugcagccugggcgacccugucuuaaaaaaaaaacaaccaaaaagaaaaaaaaagcugugggguaagacacuggguuugaauuucagcugaacuacccauuagcugugugaucuuugacuaguuacuuuaucuagaagcuuuagucuccucaucuauaaaauggguaauacuaccuaguucauggggauguuguaaauauuaaugaugaacuaauaaaugcaaagauuuagacagcgcauggcacauuguaaagcaguugaugaauguaauucuuuugauuucccuuuaaccauuuaaaaauauagaacaauucuuagaucacaaggugagcaaaaacaggaggcaggcccugcuguaguuugcugaccccugauacagagagauggacucuuguaucugguggaguguaaauuggagcauuuuuucuggaaggcauuuggcaguguguuuuaaucuuuaaauggcuugccuuuuuuuuuuuugagaugggauuucacuauguugcccaggcuggcuucgaacuccugagcuuaagcgauccucccacuucagccugucaaguaucugggacucuaggugccuacuaccacgccuggcugccaucaacccuggaaauggcuagguuuuuuuuaccccauugaccuccuuucugggaauuuauucuaacaacuuaauaagagauacacagggauauuacagcuuuauuuauaaguacaaaaaaaauggaaaagggagcguuuuuguacuauuuuuuguuguauuuguaugauggaauaaucuuaagucacuaaagagcguuugaaaaguuauaacaaaaagugcuugauacguaagugaaaaagcaauauuaaaaauuauaguauuauccuaauguuuuaaaaacauucuaaauauguauuaauguaauaggugaaggaaauagaucaaauuguuuucaguauccauuuauuauuugguucuuccuaucuuuucuauuuuucauugcuuuucaagaauuacguacugcuuuauggaaucagaauaggacuucagucuuugguuuaugaaaaacagaucaauaauauacuguuuuuucuuuucauuucucucuuuuguuuuccacaccagggucuggcucuguuacccaggcuggagugcaauggcacuaucuuggcucacugcaaccucugccuccugggcuuaaguaauccucccaccucagccuccuaaguaacuuggaccacaguuacaugccacugugcccagcuaauuuuuuuuuuuuuuuuuuugagauggagucucgcucuuuugcccaggcaggagugcaguggcacaaucucugcucacugcaaccucugccuccuggauacaagcgauucuccugccucagccucccaaguagcugggacuacaggcacgugccaccaucuuuuuuuuuuuuuuuuuuuuuuuuuuugagacagaguuucacucuuguugcucaagcuggagugcaauggcgugugaucuuggcucacugcaaccucugccuucuggguucaagcgauucuccugccucagcuuccgaaguagcugggauuacaggcgcccaccaccacacccagcuaauuuuuuuguguuuuuuaguagagaaaagguuucaccauguuggccaggcuggucuucaacuccugaccucaggugaugcgcuugccucggccucccaaaaugcugggauuacgggcaugagccacugcgccuggcccauaauuuuuguauuuuuaguagagacaagguuucaccauguuggucaggcuguucucaaacuccugggcucaagcagucugcccaccuugaccucccaaagugcugggauuauaggcaugaucccacugcaccuggucaauacuuuuuuucuuaagccacuuuucucaggagauguguguacuuuagaaugugaaaauuuccacuuagaagcaauuuucaaguucuuucaugucuucucaucaguuuuuuuuuuuuuuuuggaaauuuaaucaaguuagcaaucugcuuuauuugccuccuuuuauuuucuauaacaggguaaaguucuuuacaaaguucgcuggaaaggcuauacaucggaugaugauaccugggagcccgagauucaccuggaggacuguaaagaagugcuucuugaauuuaggaagaaaauugcagagaacaaagccaaagcagucaggaaggauauucagguacuauguuuugucucauauuuguuuuuacauacauaaauuuauuguaaauuuuaacucucaaaguauguguaguaaaugauuuacaaauaacaaaguguaccguauucuuuaguguaaauuccauguagccaauucucacagacugcuuucagugauuuuugcuggguucuucuuucuguacccaaccuacaguugcaguugacaaacaagaauaguuuggagaugaauauugauauuuuccuuuaaguuaagaguaaggucaagguggagaaaaaagagacaugccaaacuaucauuuguucguccgugacaugagcaacuuguuuuuguauauuuauucugcauuauuaacuaugucuuaugccugcuuuuucugcuaguuaaaacaaauuaucuggugaggaccugguuuaaaaaaaaaaaaaacaacuuagaacuauauagugaagauaucucacauuaagagaaugauucucaugauuuuauaggcugaacauugaucuuucucccuacaauuuaaguuucaacuauguuuuuuaaaauaccuagucuuuucuuaaaugaccaaaacaauauuaguuuugacuguguguaguaguuguuaauaauaauagcaauaacagaagugccuggcauuuauugagcauguguguauacuacauaacuaccauacacugggucagcacugguuuaguaagugaagcaaucacuuaguaaaacagguguauuuauaagaugaccacuggucugucaugagcuuugagugauguuacgugacacuaauggacuucuacugaacuguuuugucaacaucguaguauuuuuagcuuuuuuuucuuuuuugaguaaacauggagugucucauaggggccagaccccuaaacaguuacaguuacggaaagauagguaaaaucuauuuucugcgcuugaucugucuucagguuauacguagauguaugauuuuuuucuuuucuucucauuuauuuuuaaauacagucuugcuucugucacccaggcuggagugcaguggcacagucaugguccacugcagccucaaccucuggguucaagugacaauccucccaccucagccucccaagcagcuaggacuauagauacacgccaccaggccuggcuaauuuuuuuucuuuuuuccagagacagggucucucucuauugaucaggcugguaggaacuccuggccucaaguaauccucgcaccucggccucccaaaguguugguugggauuacaggugugagccacugugcccgaccugauuuuucuuuuaaagaugguaccauauacuaauuuugcccuuugcccuuccuuuaaaauaaucuuuuauuaauacauauuuuauucagaaaacaaauauggguauuuuuuuuggcaccaguacauuuucagagauucuuuuauucaacauguuacuauuggugcuaaaacuguuguacauuuagcuggaaccccuucauaccagccccuguguccuggcgcucccacucaggguagcacugcucucuuuuuuggcacaguggcacaucccagccucaauaaauccaugcugaccucuguaacucggccugucaccacagugucaccacagagaccuacguguucucccuuuuccuaccaggagaacucuggucacaacaguauugcauguccucauuuacuaaaucuuacaauacagagaaauuaaccucagauuugcuaugcccuuucuacugugaaugacaaacaguauuuguuaaucuauuugauaaaguuccacauucauuuguaguucuuuuuguucuuagaauauaugcacuguuuaauguucagaaguuacuugaauuuuuuuuucugugugguuaucaauuuuauaaacagguucauuugucuguuuguauucaguuuuaggguuccuccauccuugccgaugcaauuuuguugaguauguaaaauacuuaaugugguucaaaggauaaaacuagaaauuaacuaggaccuaucuucucccugcccucucucucccucuauaucuaauuugaaauacuguccuuuacucccaguuaauaacuauaaucagcaagcauaauauuccuuuaauauguucucaccacaucucccuguuauuuccuagauacacuguaccuuguuagaacauuuagucacacauacuacagucucucuuauaacccucauucagucuuaguccuagaagcaaauacauaauuaaugcuuuccaccaguccuuauggugauguuuguccagucauuuuugguuaucugaaguucaugcuuuaguaccggacgucucaaaguguggacuccggcaggagcaucaguccccagcagaggugcaugcaagaguuugcaacccaccucugugguaggaaggcucuugagaacaauauucacugacuucuuuuguuuccuaacaguguguuggcagccuuucuaucugaaugccaguugcagauuccuuagugcacauuuucuuuucucaggugucuuacuguguuaauccauuguuaucuggcacaaaacauugcucuugaugaccaguugaguuuauuugucuuguaagugacuuggggucuuuuugccugaugcuccaaaguuuuuguuuguuuucucuucuguuuuauagacaugucuuuuugguaugcuuuuauugcuuuuaggauagucaaccuggcuaauuaaaaaaaaauuuuuuuuuagaucuuuuguuucugucuucucuggccuacuugguuuggaaucuaauccuagcaguuuuuccuccuuguggggcuugguccuggaaguccugaggagagcuucacuggucccuuuugcagggccugggaggggucagccaccucuccccuucuccgccuugcccagugcacagcaggccccaccccacagcugcucucucaggcagcagcagccugggcuuuuccagauuguugccuucgcuuccccugagugaccauccacaccacaugggccuuaccacuguuuuaguuuugguaaggccugugugguagggacuugggacuuacuaaaaccaaaagcugucuguggggaguuuuguuuugcuguccuaguugccuuguuuuuuaugaggugauucagggagauuggaaagguuaagccagugccaccauauucccacuuguuaaccuuggugguguccauuucuuaggcagugcagggaagacauuuuuaaaguauaucuggccaggcgccguggcucaccccuguaauccuagcacuuugggaggccgagaggucagggguucgagaccagccuggacaacaugaugaaacccugucuuuacuaaaaauacaaaaauuagcagggugugguggcacguuccucuaaucccagcuauucgugaagcugaggcaggagaaucgcuugaacccaggaggcagggguugcagugagucacugcacuccagccugggugacagaaugagacucugucucaaaaaaaaaaaaaaaaagcuaucguuuccaucccuucucucuacccccaagucauuuaggauaaggugguuuugggaaaugggaacagaaaauacuuugcauaguguuuuuguguuuauacgaguacuuuauucuuaaguuucuuuuuuucaauuuuaaaauaggaaaauauuuuuucauaagcaauauuucagauaacacaugaacuugggaaguaagauuugugugcagucuugcuuguucuguacauaacugucaaacguaggagcaaguuuaaggacauuccaggauccagggucuuagaaaacguuuuguauuugcauugguaacuacuuuguuggcagccaagaaagucuguaaaaauuacuuucuuggugguuuuggaaauguugaaauucaaaucauuuauagcccaccauaccugaguccuuucacucccacuuuggguugggcgcucagcagcacugaguuucugugcaccccugccuuccagacucacacuugcccucaccgccaagaccuguuugcugagucagagauagagguagcauacgauuucagcuuagguaagcaguuuuaagaaguugagauucugcuuggaacaaaaaauauucuuaccaaauuucauuaguacuacuuuucaaaaccuuuaaaaucaauauguuaaugaauauuuuaaucuguuuuguauuuuauagagacuauccuuaaauaacgacauauuugaggcgaacucugauagcgaucagcaaagugagacaaaagaagauacuuccccaaagaagaaaaagaaaaaauugaggcagagagaagagaaaagcccagaugaucugaaaaagaaaaaagcaaaggccgggaagcuaaaagacaaguccaaaccagaccuggagagcuccuuggaaaguuuaguuuuugauuuaaggacaaagaaaagaauuucugaagccaaagaagaacuaaaggaguccaaaaagcccaaaaaagaugaaguaaaagaaacaaaagaauuaaagaaaguuaaaaagggugaaauaagagauuuaaagacgaaaacaagagaagaucccaaagaaaauagaaaaacaaaaaaagaaaaauuugucgaaucccagguggaaucugaaucaaguguacuuaaugauucucccuuuccagaggaugacagugaagggcuacauuccgacagcagagaagagaaacaaaacacuaaaagugcaagagagagagcagggcaggacauggggcuggagcauggcuuugagaagccccuagacagugccaugagugcugaggaggauaccgaugucagaggcaggaggaaaaagaagaccccgagaaaggcugaggacacuagagagaacaggaagcuagagaacaagaacgcuuucuuagagaagaaaacugugccuaaaaagcagaggaaucaagacagaagcaaaagugcugcagaguuagagaagcugaugccuguaucugcccaaacgccaaagggccggagguugagcggggaagagagaggccucugguccacggacucagccgaggagguaagggccacgggaggcagcagaaaacccauguugaguggucaagacauuucacaagcaaggaaagggaaacagucaagcuauaagaaaguguuuaugaccaugggcggucauaaaugaagauccuccagcuuuuggacaccgcagcuuaucucuuagucucugguuuguuucucuuagaaugauuaugacuagaaaauuaaaggcuaauuugugaacaaaaaucaggaugguuuuuagagguacucagaugauauauggagcauuguauacucagguuuauagcuucaucagcuuauuuuauuaacuuuucacauccugcuuggucauuuccccuguugucuugaguauaccacuauuaaauaauaggacacaaacuacauuaaccaguauuuuaaugcuuuuuaaaauguauuuaauagggaauuugucccauuauaaaaauuauuuuuauauggcuuugcaaaauggauauauuuuccaaauuaugagaguauuuauauaugcaauauuuaucaagggcuauaaaaaacaucauuuuuuucauccauuauuuccaguuuugggaauguauuuuaaggaaaucauuuuaaagaaggaaaagcugugcauacauaguuauuuauggcaguauuaucuucauuagugcuacagcaaaauagaacaacuuagaaaaugcaguggagaagaaaacccuacauaaaugugaacacagucauguaaaaauauguguguaauguaaacaaaaaugaauuuuaaaaaagauuauccauguaaaaguacgaggaccagaagggggaacauggagaaguacaauagucaugguugguuaagacuauggguggaaaacuuucuuauaauuuucuuuuuuuuuuuuuaauaauaaaauuccuaaaagaggguuggaaaacugauguuggguuuggaauuugauauuuugugaauuauuauaugguugacugaggaagcaaaauucuuuugugugaagaggauuuaaugaucaguuaucauguaccacaguauacaagggugauucccugaagccacaaaccuguauuuuccgguucucaaauaaauuuacagugucaacucuuuauccauucuuguuuuggauaucaugucauuuucaggacaaagaaaccaaaagaaaugaauccaaagaaaaauaucagaaaaggcaugauucugacaaggaagaaaaaggcagaaaagagccaaaaggauuaaagagugaguguaaauauuaacguuuugccauuuacguugcuaucuuuuauacaaauaaccaguuaccuaaauuuauuauauaaaaauuuauauaauuuuuuuuccuuauuuucaccuuguuuuuccuuuuuaauaugaugagggaucugauuagaauuacugagacuggaaauuaguuguggcagaaaaauaaauguguuuuuauagcaagaugcuaaauuuuaaaaaaccuuuuaauauauucauuauauguaacucugugucauuuguguaaauauaauauugaauacgcauuuuggaucacuucaagauagaccauaauagaaaauccauuauauauauaaauauuggaacaaauacuuuauauuucuugaaaacaaacaaaaaaacaccauuacaguguuugaauaaacccuagcagauaaauauuuaguuucuguagcaaaaguacuuggaacacauguuuucuggcaaacagugguucuaagagauggaugcuuuuccuuagguuuucuuacugaaagcuguauguaacugaaguaauauuaaaaguaaguuuuuuucuaagccuaggcugguuuuggcaguagaagcaggugaaugaaguggcaggagcaguggcuguuucagugggucacacauaaaguggcuguaagacuguuguucaaagcaaaacaaaaaucuuaaaugccuucuauucuucaaagaaugacuagagguucaaaauacuguaaaacuggaccuggccuuguuaaccuuuuuuccuccuaguaucuuguaugucaguuucagauacauuuuuacugugaacauacagccuuaaauggaacuacuguuugucccauucauaaggguacucacuagaguccaguuuucaauauucccugauaauaaaaccugucugcuguguacccagaguuuauaauagaauucauccuaauucucuucuuuuugggguuauuucuuaugucaggucuaguaccugccaguuuucuucccacuuucuucuuuaguuaaaagcugguagcgucagguacaguuuuaccagguacacaggcagugcucuggcacccugcuguuucccucacuugccaccagaagccauuuugguacaagcuucaacauccagcuauagacagucuggugucuuuagcugugggaaaggugcuggugugacuuggaucacucugagacucacugccuucaguaggccuuugucacaacugcaggugaguaguucagaacaucugcuuaacagccauucacacuggacauccuuucugaauauugagcagccaguagaaagaccagcugaaacgauuuuguggcuuugacaguaaaucagaccaggcuuuauaagcaagguagauguuaguaaaaauuaagaaaauaucuuguugcuuuaacacuaaguuagauuuucuuuugaauguaacagaaauuugugacucauacuuaaccaucuauuuuaauuuuuucguuagcacuuaaggaaaucagaaaugcauuugauuuauuuaaauuaacuccagaagaaaaaaaugauguuucugagaauaaucggaaaagggaagaaauaccacuggauuuuaaaaccauagacgaucacaaaaccaaggaaaacaaacagucacuuaaagaaaggagaaacaccagagacgaaacggauacuugggcauacauugcugcagaaggugaucaggagguuuuagacagcgugugccaagcagaugagaauucaggugaguuuggaaucauuuugcagaauuuuucaagguagugcaccauauuauuuuacuguacucuucucuguauuucugaucucaacgaucaaaaaauaauggagucgaagaguuuauuuggaucuccugaauaaauaacauuuuauauugaagacgggucauucugugacuucucaauggaucaaacaauuuuucugaguuccuauaauguucucagcacguauagaaauuaaaagauuucugauuuucuaccuuaccuacucuuaccuggcagccccauuuuauaucuuacuauuuaauagauuucuuucaggaaauuaucaaauauaaacuuauuuguauuuuacccuuuuaauguuguagcaaguaacacuaaauaagauuauauuauaaaugcuguccugaggacauuggagcuggucaagaagaagaauacagacuacaguagugguggggaggaggagugcuaaaaaguguacauacauguuuauaacuaggaccuaauaaaucagagagguuagucuaauaaaacuuuguauaauuugugaaucuugagaaacaguugagaauugaaaaauucggaauauaugacagacuagaucgccugggaaacccuuauacuacaaaaaugacuauaucuuggauaccgagggaaaaugugcuuuuggauauauugcugagcuugcaggaaauuaggguaauuucugguaccagugggcaaggaggaagagguaugucgcccagagggcagaugccaaauaguaacacugcuguugagauaccaggcaguaaaaaacagauacaguaggggaacaucaguaaagccagaaguggauuccugguuuucuauaaaauaagccucugacacaguuuguugagaacaaaagaaacacaugaaaaagagguacgauuacagguuguguacagauuuaaaagaugaaagaauucuaugagcaauuucuuaccaguugauuugaaaacuagcuaggcggccaggcacaguggccuguagucccagcacuuugggagguugaggcagguggauugccugagcucaggaguuggagaccagccugggcgacacagugaaaccccaucucuacuaaaauacaaaaacuuagcugggcguggcagugugcaccuguauucccagcuacucaggaggcugaggcaggagaauugcuugaaccugggaggcggagguugcagugagcugaaaucacaccacagcacuccagcuugggugacacagugagacuccaccuccaaaaaaaaaaaaaagaaaacuggcuaggcaugguggcaugugccuauagucacagcuacucuggaggcgaggcaggaggaucaauaagcccaggaguuugaggcuauauuaugcuaagauuguaccugugaauagccacuguacuccauccuggucaacauagcaagacuucaucucuaaaauugaaaaagagguuugaaaacugaaugacaugggaaaauuccuugggaaaaaaauaaugagacugauccaaaaaagacugaauagucacaacuguuaaagaacaugagggcugggcacggcggcucacaccuguaaucccagcacuuugggaggccgaggcaggcagaucacaaggucaggaguccgagaccagccuggacaacaugcugaaacccugucucuacuaaaaauacaaaaaaaaauucgcugggcaugguggugcgugccugcagucccagccacuugggaggcugaggcaggagaaucgcuugaacccaggaggcagagguuguggugagccaagaucacgucacugcaccccagccugggcaacagugcgagucuccaucucaaaauaaaaaaagaacaugaaauacgggauugcuggcaagauggccgaauaggaacagcuccguuccgcaauucucagcgagauugacacagaaagcaggugauuucugcauuuccaacugagguacccgguucaucucauugggacugguuggacagugggugcagcccacggagggugagccaaagcagggucgggcguugccucaccugggaaaugcagggggucggggaacucccuccccuagccaagggaaucucugagggacugugccaugaggaacggugcacucuggcccagauacugugcuuuucccauggucuucgcaacucacagaccaggagauucccucugguggcuaugccgccagggcccuggauuugaaacacaaaacuggguggcuguuugggccgacacugagcuagcugcagaaguuuuuuuuccauaccccaguggcaccuggaacgccagcgagacaaaaccguucauuccucuggaaagggggcugaagccagggagccaaguggucuggcuuggcgggucccacccccacagaguucagcaagcuaagauccacuggcuugaaauucucgcugccagcacagcagucugagaucaaucugggccacuugagcuuggugggaggagggguguccgccauugcugaggcucgaguaggucguuuuacccucauaguguaagcaaagccuccgggauguucgaacugggaggagcgcaccguagcucagcaaggcugcuguggccagacugccucuagauuccuccucucugggcagggcaucucuggaaaaaaggcggcagccacagucagggucuuguagauaaaacccccaucucccugggacagagcaacucggggaaggggcggcugugggcgcagcuucagcagacuuaaacgucccugccucacggcucugaagagagcaguggaucucccagcacagcauuugagcucugcuaagggucagacugccuccucaagugggucccugacccccaugucuccugacugggagauaccucccaguaggggccaacagacgccucauacaggagagcuccggcuggcaucuggcgggugccccucugggacgaagcuuccagaggaaggaacaggcagcaaucuuugcuguucugcagcuuccgcuggugauacccaggcaaacagagucuggagugagccuccagcaaaccugcagcagaggugccuguuagaaggaaaacuaacaaacagaaaggaauagcaucaacauuaacaaaaaggauguccacucacaccccaucugaaagucaccaacaucaaagaccaaagguagauaacuccacaaagauggggagaaaccagugcaaaaagucugaaaauugcaaaaaccagaacaccucuucuccaaaggaucacaacuccucgccaagggaacaaaacugggcggagaaugaguuugacgaauugacagaaguaggcuucagaagguggguaauaaacuccucugagcuaaaagagcauguucuaacccaaugcaaggaagcuaagaaccuugagaaaagguuagaggaauugcugacuagaauaacaaguuuagggaagaacagaaaugaccugauggagcugaaaacacagcacgagaacuucaugaagcauacacaaguaucaauaacgaaaucgguaagcagaagaaaggauaucagagauugaagaucaacuuaaugaaauaaagcaagaagacaagauuagaggaaaaagaaugaaaaggaaugaacaaagccuccaagaaauauggaacuaugugcaaagaccaaaucuacguuuaauuaguguacgugaaagugacgaggaggauggaaccaaguuggaaaacacucuucaaaguauuauccaggagaaccuccccaaccuagcaagacaggccaacauucaaauucaggaaauacagagagcagcauuaagauacuccucaagaagagcauccccaagacguaaucaucagauucaccaagguugaaaugagggaaaaaauguuaagggcagucagagagaaaagucggguuacccacaaagggaagccugucagacuaacaucauucucagcaaacuaacacaagaacagaaaacuaaacacacacuacauguucucacucauaagugguaguugaacaaggagaacacauggacccagggaggggaacaucacacaccagggccugucaggggguaggggcuccgggagggauagcauuaggagaaacaccugauguagaugacaggaugaggggugcagcaaacugccauggcacguguaugccuguguaacagaccugcaugcucugcacauguaccccagaacuuauaguaauaaaaaaaagaacguggaauaauaaaaacagccucauaaauuuaacgccaagucagauggguuucucaaaccaaaggcuaccaaacuuauaaaagucgcucuaaaaauagacaaagaaugcuaaugcuaacuuauucugggagaccaucauaacuucaguaccaaaaccagacaaaaacuauauauaagaaaaggccgggcgcaguggcucaugccuguauucccagcacuuugggaggccgaggcgggugaaucaccugaggucgggaguucgagaccagccuuaccaacauggaaaaacccucucucuacuaaaaauacaaaauuagcuggaugugguggcacaugccuguaaucccagcuacucaggaaguugaggcaggagaaucgcuugaacccaggaggcagagguuucagugagcugagaugaaaccauugcaauccagucugggcaacaagaacgacacaccaucucaaaaaaaaaaagaaaaaugacaggccaagcucacuaaacgaagucacacgcaaaaucccccacaaaauauuagcaaauuuaaucuggcccuguuuuaaaaaaaaucucaugaucacguuggguuuuuccuacaaauuguaaaggagaaauugauuuaauagcauucuugauuaaaaaguaaaaacaaauuaugaauaaagggagcuuucucgauugauaaaggacauuaaaccuuuagcaacauaagccaggcaugguggcucacaccuacaaucuuaacacuuugggagcugaaaugagaggaucacuugagcccaggaguucaagacuagccugggaaaacaagacccugucuguacaaaaaauuaaaaaagcugggugugguacuauuugccuauagccucagcuacuuggauggcugagacaggaggaccacuugagcccggaaguucgaggaugcagugagccaugauaacaccacuguacuccagccuggguaacagagugagacucugucucaaaaacaccaccaccaccaccaccaccaccaaaaaacccuuuagcagcaugaguuauaaugguguaacauuagaaacauugauuugauuugauuuuuuauagagauggguuucaccauguuucccaggcuggucuugaacuccuggguuccagugauccacuugccucagccucccagugugcugggacuacaggcaugagccaccaugacuggccagaaacauugauuuuaaaccaggaauaauacaaggaugccuucugucaacacuuuuauucaacauuauacuaaggucuacucaguacaguaagacaaagaaauaaaaaagccauaggcauuggaaaggaacggggaggggaaauagcugucacccaggcgggaugccucccaccuauaaucccagugcuuugagaggccaagcagaucgcuugagcucagaaguuuugagaccagccugggcaacauggugaaacuccacuucuacaaaaaauacaaaauuaggcgcaugccuguaaucccagcuauuugggaggcugaagcaggauaaucgcuuaaauccgggaagguggagguuacagugagacgagaucgcgccauuguacuccagccugggcaacaagagcaaaacuccgucucaacaacaacguaauaaaauaaaauaaaauaaaccaggcaggauggcacauaccuguagucccagcuacucaggaagcuaagguaggaggaccauuugagcccaggaggcagagauuguagugagcuaaaaucgugccacugcacuucagccuggacgacagagcaagacuguugucaaaaaaaaaaaaaaaaaaaaaaacugucgucaucagauucauauuaaaaaccuaaaaucuacaaauaaauuauuagaaguauuaaaaauguagcaaggugacuggauauaagaucagugacaaaagccaauuuucuuuuuuaaaccuauauacauuucuacauaaauaauaaauguauuuuuuaaaagauacaguuuucaggccgggcgcgguggcucacaccuauaaucccagcaccuugggaggccgaggcggguggcucauuugaggucaggauuuugagaccagccuggccaacauggugaaaccccgucucuacuaaaaauacaaaaauuagcuaggcgugguggcacaugucuguaaucccagcuacucgggaggcugaggcaggagaaucgcuucaaccgggaaggcggagguugcagugagcugagaucgugccaucgcacuccagccugggggacaagagugagacuuucuuucaaaaauaaaaaauaaaaacauacaguuuucaauagcaacacauuaaaagauuuaaaagauugcuuagaauauuguucauaaaagaugggccaggcacgguggcucacgccuguaauccugggagacuguggaggguggaucacuugaggucaggaguucgaggccagccuggccaacauggugaaaccccgucucuacuaaaaauacaaaaauuagccaguugugguggcauacgccuguggucccagcuacucaggaggcugaggcaggagaauugcuugaacccaggagguggagguugcagugagcugagauagugccacugcacuccagccugggcaacagcacaaaacucugucucaaaaaaaaaaaaaaaaaaaaaggccuguauggagaaaauuuuaaagauuucuugauugcuugaaaguuacuaaaauguauauaugccauuuuuauuagaaaacaguuuuaggguccaggcacggugguucacgccuguaauccuagcaguuugggaggcugaggcaggcagaucauuugaggucagaaguucgagaccagccuggcuaacauggugaaaccccaucucuacuacaaaauacaaaaauuagccaggcagaauuuuuuuugcaugagcaaaaaaauagcuuuuuuuuuuuugcgcuugagcaaaacauagcucaugcaauuucagcuacucaggaggccaaggcacagaaaucacaugaaccugggagguggagguugcagugagccgagauggcgccacugcacuccagccuggggacagagcaagacuccgucucaaaaaaaaaagaaaagaaaaucaagcauaucagguccagaggcaagacccacacuugucaggaaugaacauggguuuugaaccaguuugcuuuguuagagaccacaaucugagcugcagcucagccuuuccagugguucuggucuaggcaugcucucuguucuuacagcaguccugugaguuuggugguauuaucucaguucauaaagaccucaucuguucugcuuccacaaucuuuccacauugcuuccucaguggugggaugggucauggggcauagcaggugggggcuucaugggggacucagacaccugaauaagaagacuggcucugccacucacugcugugugucucugagcaaacccuggagccucucccagccucucucaucuguaacaugucuccccuuacagguuauuguguauggaggaaauaaauccauucauguaaauaaguuaacaugucuuaugauugcuaguggcuuucacuauuaccauugcugauagaccugggaugcugcaccaggauggacagcccagaggcugugcuguuucucugcugucagcucucagaguuagcagaaguguuaguuugaguugagggcuuuggaaaaguucuucauuuauugcauauguuuuacaaacuuuuuuucuguggccaggccaucugccuaacaucaucuauauaguuugaggaacugguuucaggugaaaauccuuuaacucuaccaucaaguaguucuguuuuucacuuguaaaaaaagcacaaaaccauugugaauuacucccaaaugaccugcacugaagucugugugauugauugcaguggugauaaaggcugaacacaugcguccucaguguucccgugccuguagguccugucggggaagacucuagcaauaccucacgggggugggugugggccagggcacugggagcaggaggcuuccagauguaggggccugugggagucuggaaggauccauaagcagugccuuugacucacaugcugggauagcucacaugcugagaauggcuuuaucuguacaugguuggaagcaguguauguccaagaagaaugguguaagggagaagagucacauuagaauugcauuuccucuuaccagauccccgaucccuccuuccuuugagcuacuuagucuuaaaauuccuccuuugcuauuuuacaaugacagcuuaccuauuuaucuuuaugccuucagaguaccauggcuucuaaauguggaucguucauauuacuucccaaagaaaauuggggauuuuaucaauuaaaagaccccauuauacaaugacuuguguuaaaaguguacauaaagcuuugguuaagacaccacaaauuucauaaacaacauuguggguuuuuuauacuucagacaaauguauguuaacaaggcuauuguguguuccagauggcaggcagcagauucugaguuugggcauggaccugcaguuggaauggaugaaguuggaagauuuccaaaagcaccuugaugggaaagaugagaauuuugcugcaacagaugcaauuccaaguagugaguaguuuuggaaauauugaaaucccuuucacaaaucuagauuuauaaaaucuaacuuauuuuuucuuucauuuuagauguguuaagggaugcugugaaaaauggggauuauauuacuguaaaaguugcacuuaauucaaaugaagaauauaaccuggaccaagagguaauaugucguugaaaaaucucaugaaaggaaaauggaaaguaacacuugaaagaauucaguuuaacuuuucauuuauuuuaauuacaaaaggcugggcgugguggugcacaccuguaaucccagcacuuugggaggccgaggcaggaggauugcuugagcccaggaauucaagaccagccugggcuccauggugaaaccccaacucuacaaaaaauacaaaaauuagcuggacauggugguguacaccuuuggucccaguuacuuggguggcugaggugacaggaucaccugagccugggaggucaaggcugugguaaguggagaucacaccacugcaccccagccugggcaacagagcaagacucccaucucaaaaaaaaaaaaaauaaugcacguucacuuuguaaaauaaaaaaauuguagaacccuauaaauguacaauuauagucccuuuaauuccaacccccuccccucuaaaagugaugguuugguuugguuauggucuaccuguuuuguaugugguuuacccucugccacucuugagagcguagagugagaccauuuuccuguggucauuuguguuucuuugaugguugucccauuuacaacaaugguccaucucuccuguuguagcuggggauuuuucauacugauauguauggauuuuuuuuuuuuuuuuuuuuuuuugagacagugucucgcucuguugcccaggcuggagugcaguggugugaucucagcucacugcaagcuccgccucccggguucacgccauucuccugccucagccucccgaguagcuggacuacaguugccugccaccucgcccggcuaauuuuuuguauuuuuuuuuuuuuaguagagacgggguuucaccauguuagccaggauggucucgaucuccugaccuugugaucugccugccuccgccucccaaagugcugggauuacaggcgugagccaccgcgccuggccacguauggauuuuuuuaauggaagcauauugacccuuucucccuagauuuuagguuuguguuugagucuuguauugcuugaagauuuuuaguuuuaggcaaucauaucuguugaucuuuuacauuuauggcuuuuggguaucuugucuugcuuagaaaauauuuuuauauucuuuaguuuuuuagcuuagcuguggauuuuuuagguuuaauccuuugggauuacaauucacaaaauuauugggcuuuugauuaaaauugcaugaaauaauauagauugagaauugacauuuacuuuuugcaucuucugucuaggaacaugguaauucuacauucacucagcucuucauuuauauccuuaagcaaaguucuauggguuuuuucauucauauagacguugcacauuuccuauagauguaugccuauauguuuuauaauggucauuagagucuuuuuucauuuacauuuuguuuucuaacugguuauugcuugucgaugguaaagcuguggaugucuuuguacacauaaguguguguaacuccagucauuuaaugaaauucuuauaguuuuuaaguuacuuguuuuggauuuucuagguagaaaauuugaucguaugccccccaaaaauucacuguucauuuuguauggugcaaacuuuucaugugccuuuaggauuuaauacacaaaacaaaaagaagauacaaaaaugagagcugggcgugguggcaugcaccuguaaucccaucuacuugaggcuguggcaggaggaaugcuugagcccaggaguuugagaccagccugggcugacauagcaacaccgucucaauaaaaaagaaagaaagaaaaacaacaccaacaaaaaaaauugaagcauuccuuggagauauuguggguuugguuccagacuguuggaauaaagcgagucacacaaauuuguugguuuccuggugcauauaaaauuuagguuuacacuauacuguagucuaaaugugaauagcauuacaucuuuuaaaaaaccuauauaucuuaauuuacaacacuuuauugcuaaaaaaugcugacacaacaacacaaaaugagcacaugcugugggguaaugaugugaauaaacgugcuuguggcaggguuaccacaaaccuucccuuuguaaaaaacacagucccugugaagugcaguaaagcaaagcucagugaaacaagguaggccuauagaggaaaguuguaaaauuuuaugcaaacauucauaugugaaaagauacucuaaaagcuaguagcuucugaugguugggauauuuuagugaaaauccuaaguagaugccuaaaucagugccuauuagugauuucacauugaaacaucucgagugagaagacuugguucugaaauuguucugacuaaagauuaacacguuuuuuauuuaacaaaccaacacaggauuccaguggaaugacacuggugaugcuugccgccgccggagggcaggacgaccuccugcgacuccucaucacaaaaggcgcgaaagugaacggucggcagaagaacgggaccaccgcccucauucaugcugcagagaagguuuguggcuucuuaugcaucaguuucagagcuuucaugguauuccugccgauggacugagaggaucucuuugguagugaaauauagcagucacauggucacaucgcuuuuuuuuuuuuuuuagacggagucucgcucugucgccgaggcuggagugcaguggcacgaucucagcucacugcaagcuccaccucccggguucacuccugccucagccuccugaguagcugggacuacaggcagguaccugccaccacacccggcuaauuucuuuguauuuuuaguagagaugggguuucaccauguuagccaggauggucucgaucuccugaccucgugaucugccugccuuggccucccaaagugcugguauuacaggcgugagccaccgcgccuggcugucacacggucccauagcuuuuuaaaaauuuauuuuuagaaauaaggucucacucugucacacagguuggagugcagguggcaccaucauaacucacuguagcuucaaacuccuggacucaagcaauccucucgccucagccucccaaguagcugggacuaaguguguaccaccacaccuggcuaauuuuaaaaauuuuuguaaagacauggucucacuguguugcccagccugggcucaagugauccuccugccucaguuaaagugcugggauuacaggcaugagccaccgcacccagcuggaguaacuuuuuaauuuuguuucaguugaucugugacauguaaugaauggauuuaucaucaguaguacauuguaaucacauuucaaaaugugauuuaucucguuggaaguaauuuauauuaaaauacucugauuaaaguacuaauauuuuaaucuuagauaauuuaauuuuuuugaauaaaugguauuuguauuccuuuugguuaauaauuuaauugaaauguuuccauauauuaucuuuuuaaaggauuuauaugcagagguucuuagguuggagcuagcgguuccauucgcaguugcuggcagcacagugaguggccacguuugggccucuguggggcggggugcacccccguggccccacgggaaugcugcagcccgcaaccacuugugauagaaccugcuggguauuuuuccugaugacuaaaaauuucaaaauaucugaaaacugucuuuuaaauaauuugggaaauuaaauuugccuuuuuuucuuuucauagaacuuuuuaacaacaguggcuauucuuuuggaagcaggagcuuuuguaaauguccagcaaagcaauggugagacugcacugaugaagguaaaucccuccugcaggucaucccuuucuucacuacguuggcaggugcucguguuggcaucugccacugccaggcacugugcuggggacugagaacagaguggguaccaagacaguccuagagucagccgcuugcaggggagaaggagaagcgggcuggcaggguagcagugagagcucaguaugggcaguggugugaucagaacaggcacagagagccaugaggucacagggaagugcuccgagcugggcccuggggacccugacaauccuuaggguggaugaggcaggugccacacuguguccuaaauggcagucaagucagccgggagggagcacuccggccgcagcuggagcagcagggaggcugcuggccucgaaagugcaggccuaggggugggacggaguuccucgugcacucuguguguucgucauuuuauguuggugaauuuguugccucgggcuuguuccuguguucuggaacgugguuugcagacagguuuugagagaaaggucagcaguuuggcauuugucuuagggggcccugccaggucugguugguuccucuguggcaguuguggguuccuggcccaggaugcuguuaggauauagcagguccagacacccagccagugguggccggcucagcucccuguggggaccuguccucuuuccuuccugggaugcuuggcuccauguaagccauugagccaagcgggggccugcccacagcgcccauuccagccgcuguccccaguaagcaaaagagcacagccaggcccugggucugcagggcaccuggcaucaagucucacugugaacccucuucugauggccuggaccaccugucccuuguccuccugcugcaugaggcccauaaacagucuccuucugucgcccgggcuggagugcaguggcaccaucaugacucacugaugccuuggcuuccagagcucaagugccucccucagccucccgaguagcugggacuacaggugcgagccaccacacccagccauuuuuuuucuuauuagagacaaggucucacuguguugcccaggcuugucuugaacuccuggccucaagcacuuuccuuuugguucauggaaauguucauuuuguuugggagccugagguuugucuuuguuucccuucauuuguuucugugguugucuuguguggagcagagguggccucugcaagcaucaucuuagugacagaugaccagguguacccugaacugcagccacgcaggugcauuuagagcaugagagaggugggugggcacagaagcccccuucaugccaagccuuagggaguucguccugagggcacuggggagccacagcaagguugaagcugaagaaggguagaaucggauuagaggguuuucauuuguguauuuuaaugcugcuuaguacagaaggggcauagauugagaagaagauaguuugcaaacuugucaggagggucuccagauuaugugaaauaacagaagucuguaccucgggaguggcaggagggauggagugggugaggugcccacuugguaagagcuugguaacuggaggugacgccugggcaucccauuuccuaaguuggggcacggcuggcagagcugggggaguugggcguugggucguguagaugucaccucuguacauuucacaggggcaucuaggcucaggagagaggugugggcuggagauucagguuuguugcuguccagcucugcaacagugaccguagccauagguugagaguggggucauccauggggaauuggaaaggagaaaagggccauagauggaaagagccugcguggggagaagcagaggaggaggaggaagugguccacgggcuggcagcaccucccccacacagcaggcagaaggcaggcgggagugccccaggucagcaccucagggcugugugccuugcugagguacguguguugaguuggggaguggggugcagaggggagauggcucuggaaguggguuggggagggcguggcguuucuucccugagcggacauguagcacuuauuuauuuuacugggucugaauucaguagacugccuuuaucugccaugagguuuauuuaaguguuuguuccugaaaagcuguauuuuaauugcuuucaggauuuagcauguugaaguuugaguuuuagaaugagaagauguaaacauagugauuuucagaaauuaaaaaccuuuuuaucugaggagaaaguguguaacauugguccuuaccagagugggcaggugcagagggacugcccucgccugucacugcaggcucuguuggucccagaagggccucucacccuccccguggcuguaaugugggccacucgcucugucccgagccuguccuggacggcgucccuaaccucugcacuggaugcccaggguaacaaccagaaaggucucaggcauugcccaggcuccccugauggcagaguucccccugccagaagcacuggaugacaccguugucgggguaguguggcggcuccuccuagggcugcgggagugccaccgcuccuggaggcugcucugcaaagugacgcugcugccccagcaucugccucacaggguagggaggcacaggcacccuuauccucuuuucgcaaauggaaacgugccacucagaagaauuaagggacuuaucugaagucacguggcuaauaagugacagagacaaggagacagucugucagcugugccacagcuccaucguacauuugcagguucagauucggaucugugcuuggguugucuccuuuaaagcggcagcuggggacauuucgaggguguuuugugguccugagagguguuuuugagauuccugagacaaaguugucuacagugaaggccaggcuuacguaucucugcgccucgcugaggggcuggcucacgggggacagcguggcauggacagagggcagcagcaggggacugcuuagcaaggccuggugucuguucugucuugggacugaagcauccuuuuugaaguugcccauuuccugaaaacucagugcuaagauauuaacugaauguagcacacagauuuuuauguuggccccugagucaaagauacuccccacuugcauuuaagcaaugcugugugacuccuaacgcuguggccugacgggccccaaaaguucucuauccuucuuccauggccugugcccucucuucacagaaccgcuaagcauguauggagaagggaccagcacccaugccacaguuuacagcuaaguaauuguuacuccuuuuuaccugacguaggccuguaaaagaggaaauucagacaucguacgacucguaauugaauguggagcugacugcaauauuuugucaaagcaccagaauagugcccugcacuuugcgaagcagucuaacaaugugcuuguguacgacuugcugaagaaccauuuagagacguaagugagaagcgacugugccauaguuaagucacauaucauacaucuguuuauguagacauauuauaauuggaguggccuguguguaacugcucagaaaaacauccagcacaaguccugaugguuuuguuuccaguagaucacagauuuaauaaauggcauaugaauuauuuuucugcaaguuauuuaacucucagaaaauuucaaacuuaacacuggccuaucugggaguauuuuccuuaaauauuaaguaugcucuuaauuugguuagcaaagguuuucuuaaaaacauuuaaacuuggccgggcgcaguggcucacgcuuguaauccuaguacuuugggaggccgaggcggguggaucacuuaaggucaggaguuugagaccauccuggccaacaugaugaaacccuggcucuacuaaaaauacaaaaauuagccgggcguggugguggguaccuguaaccccagcuacucaggaugcugaggcaggagaaucgcuugaacccgggaggcggagguugcagugaccugagaucacaccacugcacuccagccugggcgacagagcaacacucuguuuccgccccccaccaccaaaaaaagaaagaaacuuuaaacauuugucuuucuuuuuaauagacuuuauuuuuugcaacacuuuuaagcacagcaaaguugagcggaggguacagauuuccaagccuccccaccgccauccuccccgacugucgagaucccagucacccacagugggacauacagcuggggaaccuacagggacauggcauaauccccuggagcgcagcauugacauuagggcucacucguaguguuacccauucuaugaauuuggacaaauacauaaugacauccaucccucaucacagugucauacagaauaguuucacugccuuaaaaagccuguguuuuccaccuuuucaucccucccucccccagccccugacaaccaccaguaauuuaauuccuucauauuuugcccuuuccagaacagguggaaucacacauuauuuggucuuugcagguuggccucuuucauuuagcaauaggcauucaagauuccuuccaugucuugauagugcauuucuguuuagcacugacuaauauucuguuguugguugucaagauuuacuaguuuauucaaguucauucuuuuucaaauaaauucucaaucauauuuuauuuuauugcagguucauacuuauaacacaauuuaguauuucuaucacuuaagaacucuuggcaacacauaucagaaacuugcauguaucagacaguagcgaacucaaggcgguguuuauguagcaggucucgggugggccucugggaccgcgccuguugaacucagugcugcugauggcugcagucccaacuccucuggucacacgggggguuugcauagauccagcaaguagagugacccacuuuccugauuugcccaguacugagggguuccccuuucugauuuuccacugauucauuagacaacuauguauuaagcauagacuuugugccaggcacuguucuaaaggcuggggagauggaaauggcaguggagggaagagacuugccuucuuagaacuucaauuccacugagauggacaacaagacagacacaugggugucaggugcuugguggaaguagagcuggaaagcggaggcaggcagagcugcaggucuuuguuuggaagguuggccugggaagcccucacugguauucgacaggcuugugguucuuuucuacauuaacguuaacacguacuauuuuuuuuucuuagacuuucaagaguagcagaagagacaauaaaggauuacuuugaagcucgccuugcucugcuagaaccaguuuuuccaaucgcaugucaucgacucugugaggguccagauuuuucaacagauuucaauuacaaacccccacagaacauaccagaagguaagccgaugccucccuucacacuuuucuaugugaagugugacacuauauuaacagauuuuuagacagaauccuuucuuggaacaaaacuuuaaggaaauuccauuacguguaauaauucugcagaccgguuaacaguagagccacucugguggaagagacauccagcugacaccccaucccuguuuuaacacccauauagagcauggaaguuaggucuuaauaaucacacuaguucucaaugaguuuuauuaaaauucagcgucaagauucuaagccuagaauguuuuuucccugaauuuuguuguuuguaauagucuuugcccuuugaaaaagaaaaaaauagucuugcuccauaguaaagcugaguggaaagagauggagaagccacuuuccucucuagccucugcucgacagacccucuccaggcagggcugcggcuggcccucucuacacguggcgccagguagacguggaggcagugcagucugccgaggggaggaagccgggcucuggcuuuuuuugcuuagaaacuccuguuccccauuuuguaaaugguuuguauucauuccuggaaaauguauuuaagaacauauagcccugccccugaaagagccguuuguaauaucuuaguguugagagaacuuaucaggugguugcuguuguuuugagauggagucucccugugucacccaggcugcagugcauggcaugaucuuggcucacugcaaccucugccuucuggcuucaagugauccgccugccucagccucccaaagugcugggauuacaggcgugagccaccgugcgcguucaguaauuuauaguuuugauuauucggguggaccaucugcauugccagguaugaguaccagagaacgaugcccugagcuggcccuggugaaccugagcccccacugacaccuacaacugcugggccugcaguuuucucagcauguguacaaugucugcauccaccaacuuuuuuuuuuuuuuuucaggagucucacacuguuccccaggcuggagugcaguggugcgaucucggcucacugcaaccuccgccuccuggguucaagcaauucuccugccucaaccucccgaguagcuggaauuacaggugcccaccaugauacccagcuaaauuuuguguucuuaguagagauggggguuucaccauauuggccaggcugaucuugaacuccuggccucaagugaucugccugccucugccucccaaagugcugggauuacagacaugagccaccaugccuggccaauuuuugguuauguauuaaucagaaaaauuggaaggggcaaaaggguauguggaagaaaauggaaaaccacucagacccacacccaaagaugcccaccacaggaaugucccugggacgugugcacauucagcagcaguguuuaaauaccaguuaaauaacuucaguguagaaaaucauacguaagucuuuuccaggaacugucagcagagauuacuugggcaaaagguaaaaagaguucugugguugaaaaaugccaggugacacgagcuuugagagggccagccuccucugagccuccaggcagagugggugaugccugucugaccaggcccagcucaggggccugcuuccaucugguguugaguguuccucuggggacugaagguugccuuugaaguaauucacacacaucucccauuuucaggcucuggcauccugcuguuuaucuuccaugcaaacuuuuuggguaaagaaguuauugcucggcucuguggaccguguaguguacaagcuguaguucugaaugauaaauuucagcuuccuguuuuucugguaagauacucuguauuucacuacugaaaaguacauucuucuaaucaaaagcacagaugacuuaauuuuaaauuccugugucuuaauaaaauauaagcauucagaaaacgauccaguaauagugguugggaaugaggcaauacccauaaaguaaaauuauccuaaguuuugucaguaggaauuuuuccugcuuauuuuuugccuuaaauugugcucaccauacugucuuagggccagcauuguucugaauauaaauacuuaaugaucucaaagauucuuuguacauaauuacuuugccacuguuagaauuauuuccuuggacugaauuaagcaaaauuugcuagauauagacauuuuaacacuuguacuguauauugcugggggcauucuaauccaguuucccagauugauucugucauuuguauauuuuuaauaaaucaagggaaaaauaaaucacuuuuuuuuuuuuuuugaagacagggucucgcucuguuguccaggcuggagugcaguggcgcggauuacagcucacuggagucuugacuucccaggcacaagcaauccucccaccucagccuccuaacuaccugggacuaaaaaugcacgccaccacauccggcuaauuuuuuguauuuuuuguagagaugggguuucaccauguuggccaggcuggucucaaacuucugggcucaagcgauuguccgccuuggccuccuccacaacaucuugacuuaugaaauaaaaaauaaaacuuauuuaugauucuuuuacaucauugguguuuuaagggcuucugguguaaguuugaaaacacugacuuuuuuuuucucuuuccauuguaggacagucauuuuguuuacucauucagcccuguugcaggucccaauaaacucuucauaagguugacagaagcacccucugccaaggugacaguccuuucuucacauuuagugucacuacucaaguuguugcuccagauuacuuuaucaacauuagaaaaaaaauuccaagaauccugguguaccuguccuagagacaggcacucccugggguagugaugcuaggugcacccucucucaguuuacaauguguuagacauaauaaugcggcaggaaaagaacuagguugcagcugagaaagaugccucucuagaggauggagccaucugaaucaugaucuaggccuugguauggaguugccaaauguaugucuuuaggccggucccuaaccucucuuguaugaaaggaagcuggacaaaauagucucucuaauaaaacaguaauauaaaauuauaagcacuuggaauuauuucuugaauuaaaauggcaaugaucuaacaauguaaauugauaagcaacuugaaaauauugccaaauaauagaagcaaaucuuggccauuuguggguuuuuucuuguaagaaaggggaaaucuggaucuguacugacaccugcguucuuuucuuucaacagguuaaguugcuaauaggugcauacagagugcagcugcagugaccaaacagaagggacugggcggaguucucuucagaccgauuccuauacucucuuugacagcaguuuggaauucuucuagcacaucuauguaaaguuuugucuguaaaccucuugcaguuaagccuguugucuguuguagucuguaagaugcgacauagcugugucugugccaguaugccggaaucucagugcaguguccagacugcguauuucaguuuuuccacaauguggauaguacauaugaggauuauuuaagaaaauuaaagacuucacuuucuuuuuucuggagacggaguuucgcucuuguugcccaggcuggagugcaauggugcgaucucggcucacugcaagcucugccuccuggguucaagugauucuccugccucagccuccugaguagcugggauuacagacacccgccauggcacccagcuaauuuuguauuuuuaguagagaugggguuuauccauguuggucaggcuggucuugaacuccugaccucaggugauccgcccgccucggccucccaaagugcuuggauuacaggcaugagccaccgcacccagcaagaguuauuuucuuaacuugaaauuuucuacuagcccuggugaacuucugugcuuaaaaaaaaaaaaaaaaaaaggaaaaauucagcucuaaaacauuugcuuacagcaagggagccauguuauauucaaguuacccaagcaccaaauaaaguguggguuugcugcccuugaaaggguugggaggccugaucuuuuucuaguagacaguugccacacauuccccaagcacaaaagguggagauggcagucacuuuguaaauaugcuguagucacuuaucaucuuuucaaaggguaacaagagaaucuaagauguaguaagaauguaaaccaguacacuaugagaccuaaaagagaguauuaaaugugaacuuuuagcagagcgugguggcucacaccuauaaucccagcgcuuuggaggcugagguuggaggauugcuuaaguccaggaguucaagaccagccuggguaacaugggguggaacaagccuguagucccagauacucaggaggcugaggugaaaggauugcuugagccagggaggucaaggcugcagugagccgugaaaggccacugcacuccagccugagugacagaaugagaccuugucucaaaaaaaaaaaaaaguuucuuggaaccuauacgguuuuuuuuuguuuuuuuuuuuugaaaagccagaccuugugcccuuguuuugaacaccgacugggaagauggggcuuagguaacagccaaaccuggcugucagcugugugggagccaccacccucucugggaagaguuccugcuucuguauggcaagcauaaaucaagcucagucuggguuauggagaaguugaaaauuguuuuguuccucauuaguuuauaauuguaugaaauacgauuuuaaugaaaacuuuucagaauucacguuuguguagauauuucagagaaccauuuuuacuuuacauccuaaaacugccuuuuccuaugguuuugucaauaaaacacuaugauguuggucuguuuccuuuuaua

SEQ ID NO: 192496 - RNA, 80151 nt, Homo sapiens
guuccggcgccggcuuuggcggaggggugggacuugcaccggcgucucuucuucuaacugcaguuuguggcagcgccauuuugaaugugcagcugcagcgggcgugaguugggggaggacggguugccgacucgccuaccuagcggucucuugauugucgauauuuuguuggcauagguuuauguagagacguauacauauauauagacacacugucuauaaaucuaggccuguauccgguguccgaggcgaacucaguaagaugauguuaagaggaaaccugaagcaagugcgcauugagaaaaacccggcccgccuucgcgcccuggaguccgcggugggcgagagcgagccggcggccgcggcagccauggcgcucgcucuugccggggagccggcaccgcccgcgcccgcgccuccagaggaccacccggacgaggagaugggguucacuaucgacaucaagaguuuccucaagccgggcgagaagacguacacgcagcgcugccgccucuucgugggaaaucugcccaccgacaucacggaggaggacuucaagaggcucuucgaacgcuauggcgagcccagcgaagucuucaucaaccgggaccguggcuucggcuucauccgcuuggugagugucaggcgcccgcgcgagggaacaaaaggacugucgggguggccgcggggucguggggcugaggccagccucguccuaggacgcugucucaaccuguggcaaccguggcgccgcucggccucaucgauuccucugugcgggguuggccgcuuccccagcucggcgccuuugguuucgaguucacggucccgggauuuccugcgcucacaguggccgccguuuucugccgugcgccgaucgugcuuugcgguggcugcaggccugcugcccugcgcuggaucgggcauggugcacccuguccagguagcgagcgcucccggguuccccguugccccggguaccgaaaggguccggggacaggggcgggcagcguuuuggggugagaauucuucaaggcaaaaaucgugccauaaaaaacgaauuggauguacauuuggaaaggaagcuuaagucggaccagacguaucacuggucgugagggucuguccaggagacuugcuucuuaaacaauuauuaacaucccauccuuggcuucaaccacaccuauaugcguuuaaggguagaccacuuuauuucuuuuuaaauuaaauuuauuuauuuuaauagaaauggggucucgcuauguugcccaggcuggucucgaacuccugagcacgagcgauccuccugccuuggccugccacuuuauuucucaccucagugcagccugcuauuuaccucaaacugcuuaggugcccaaacucuguacucaaguaacaccguuuaaucugcaguaaugagacaguguuuaauuguauguaucuaauauaguguuuuucuaccaaacauccuggagaguuucacguuuuuauaggggggagaauaguugauacacaguacuacuucauaaauuacugauacauaucccaguaucagaguaauauagcuuacucucuuuuaaucuaaacuuugaaaaguuuuccaauaauuuaugcaaaaauuaugauuccuuuauauuuaaaaaaaauuugaacaagccuggccaacauggcgaaacuccaucucuacuaaaaauacaaaaauuagcugggcgugguggugcgcgccuguagucccaguuacuugggaggcugaggcagaggcugcagugagcugagaucacgucacugcacuccagccugggcgacagagcgagaucccgucucaaaacaaaacaaaaauugcuaagguuuacgccuuuuuuuuuuuuuuuuuugagacugggucucgcucuaucacccaggcuagagugcaguggcgcgaucucaguuccugggcucaagaaguucucccaccucagccucccgaguagcugggacggggacuacagucacgcacccccaagccugccuaauuuuuguauuuuuuguagaggcgguguuucgccauguuguccagguugcuuucgaauuccugggcucaaacgauccucccgccuuggccucccaaagugcugggauuacagggugagccacuguguccggccuggaacuuugauuuucaaaauuggguucucugucuggacgauacaaaaucuuuuuaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcaucuguuuaacaaagcacaucuugcaccgcccuuaauccauuuaacccugaguggacacagcacauguuucagagagcacaggguuggggguaaggucagaucaacaggauucccaaggcagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccaggcagaggggcuccucacuucccaguaggggcggccgggcagaggcgccccucaccucccggacgggguggcuggccgggcgggggggcugaccccccccaccucccucccggacggggcggcuggccgggcggggggcugauccccccaccucccucccggacggggcggcuggccgggcagaggggcuccucacuucccaguaggggcggccgggcagaggcgccccucaccucccggacggggcggcuggccgggcaggggggcugaccccccccaccucccucccggacggggcggcuggccgggcggggggccgacccccccaccucccucccggacggggcggcuggccgggcggggggccgacacccccaccucccucccggacggggcggcuggccgggcggggggccgacccccccaccucccucccggauggggcggcuggccgggcagaggggcuccucacuucccaguaggggcggccgggcagaggcgccccucaccucccagacgggccggcuggcugggcggagggcugacccccccccaccucccucccagacaggguggcuggccgggcggggggcugacccccccaccucccucccggacggggcggcuggccgggcagaggggcuccucacuucccaguaggggcggccgggcagaggcgccccucaccucccagacggggcggcuggccgggcggagggcugacccccccaccucccuccgggacggggcggcuggccgggugggggggcugacccccccaucucccucccggacgggguggcuggccgggcugaggggcuccucacuucccaguaggggcggccgggcagaggcgccccucaccucccggacggggcggcuggccgggcggggggcugacccccccaccucccucccggacggcacggcuggccgggcgggggggcugaccccccacgucccucccggauggggcggcuggccgggcggggggcugaccccccccaccucccucccggacgggguggcugccgggcggagacgcuccucacuucccagaugggguggcugccgggcggagaggcuccucacuucucagacggggcagcugccgggcggaggggcuccucacuucucagacggggcgguugccaggcagagggucuccucacuucucagacggggcggccgggcagagacgcuccucaccucccagacggggucucggccgggcagaggcgcuccucacaucccagauggggcagcggggcagaggcgcuccccacaucucagacgaugggcggccgggcagagacgcuccucacuuccuaaaugugauggcggcugggaagaggcgcuccucacuuccuagaugggauggcggccgggcggagaugcuccucacuuuccagacugggcagccaggcagaggggcuccucacaucccagacgaugggcggccaggcagagacacuccucacuucccagacgggguggcggccgggcagaggcugcaaucucggcacuuugggaggccaaggcaggcggcugggagguguagguuguagcgagccgagaucacgccacugcacuccagccugggcaccauugagcacugagugaacgagacuccgucugcaaucccggcaccucgggaggccgagguuggcggaucacucgcgguuaggggcuggagaccggcccggccaacacagcgaaaccccgucuccaccaaaaccagucaggcguggcggcgcgugccugcaauugcaggcauucggcagacugaggcaggagaaucaggcagggagguugcagugagccgagauggcagcaguacaguccagcuucggcuccgcaugagagggagaccguggggagagggagagggagggggagggggagggggagggggagggggagagggagaggucuuaauauguagagaaaauuguaauuacaugguacgguauuuuuauuaauuuuuuucuuuuuuaaaaaauuaaucuucuaaaaccuuuaagauaguguaauuuuuuuuuuuugagacggaaucuugcucugucaccacguuggagugcaguggcgggaucuugguucacugcaaccuccaccuccuggguucaagcgauucuccugccucagccucuggaguagcugggacuacaggcgcaugcaaccacgcccagcuaauuuuuguauuuuuaguagagacgggguuucaccauguuggccaggauggucuugaccuauugaccucgugauccgcccgccuuggccucccaaaguucuuggauuucaggggugagccacggcgcccagccaagggacuguuuuuuugagagggagucucacucugucgcccaggcuggagugcaguagcgcgaucucgacucacugcaaccucugccucccugguucaagcgauucuccugccucagccuccugaguagcugggacuacaggugugugccaccaggccuggcuaauuuuuguauuuuuaguagagaugggguuucaucaugcuggucaggcuggucugaaacuccucaccuugugauccgccugccuuggccucccaaagugcugggauuacaggugugagccacugugccuggugagacuguauuuuuuagggcaaacacuucaacauguaaguggcuucaagagaaggguaaauauucgcaaacuauuaauaauaaugaaauauggaaauuuccuuaaaauucagguuaaauaaucauuacauuuugaacauuauaaaugcauuuauuuauuuuuuggacaucagagacagcucgccauuuggugaaaauuuuuauguaaaaguuaucuuuuuuuuuuuuuuuuuuuuuugagcugaggucuugcugugucgcccaggcuggagugcagcggugugaucuuggcucacugcaacccccgccuccuggacuaaagcgauucuccuaccucagccucuggaguagcuggaauuacaggcgcccgccuucaugcccggcuaauuuuuguauuuuuaguagagaugggguuucaccauguuggccaggcuggucucgaacuccugaccucaggugauccacccgccucagccucccaaagugcugggauuacagguguacaggugugagccacugugccuggccucuuuuuuuuuuuuuuuuuuuagauggagccucgcugucacccaggcuggagugcaguggcacacugggcucacugcagccuugccuccccagguucaagcgauucucacuccucagccuccugaauagcuggaauuacaggcaugacaccagcccaggcugauuuuuguauuuuuaguagagauaggguuucaccauguuggccaggcuggucuugaacuccugaccucaggugauccaccugucucggccucccaaagugcugggauuacaggcaugagccaccaugcccggcauauuauuuuuuaggguuuuaaaaauuuacauauaguaggccgggcgcgguggcucacgccuguaaucccagaacuuugggaggccgaggcaggcguaucaugaggucaggagaucgagaccauccuggcuaacacagugaaaccucgucucuacuaaaaauacaaaaaauuagccaauugugguugcaggcaccuguagucccagcuacccgggaggcugaggcaggagaauggcgugaacccaggaggcggagcuugcagugagauugcgcagcugcacuccagccugggugacagagugagacuccaucucaaaaaaaaaaaaauuugcauauaguaaaggguacacauuuuaaguguacugguuggugauuuuuguuuuuucucuugagacagagugcccagacuagagugcaguggcaugaucauggcucacucuagccuccacuuccggggcugaagugauccucacaccucagccccucagguugcugggaccgcaggcacacaccaccacacccagcuaauuuuguuuauuuuuuguagagacaaggucucucucauuauguugcccaggcaggucucaaacuccugggcuuacaugaucccuccuccucagcuucccaaaguguuaggaugacaagugugagccaccaugccuagccacugguuugugaauuuugacaaauguauaugucuguuuaacucaaaccccuaucaaaauauacauauuaucaccccauuaaaugucuucauauuucuuccuauucucauuuuauuuuauuuuuuuuuugagauggagucuugcucugucacccaugcuggagugcaguggugcgaucgcggcucacugcaaguuccgccucccguguucacaccauucuccugccucagccuccccagcagcugggacuacaggcgcacacugccacguccggcuaauuuuuuuguacuuuuaguagagacgggguuucacuguguuagccaggauggucucaaucuccugaccucgugauucuccugccucggccucccaaaguguugggauuacaggcgugagccacugugcccagcccuauucucacuuucaaaacuguuucuaaagucuaccucuuaagaguuguuggauuauaugauguauuagguaagaaaguacccaucucuuuuuagguguuuauuaagugcuugcugcuacuacuguuacuagugaguuaaaagcaauaaacaaaacgacuguuuagaaugcaauuaucccucaguaucugugggggauugauucuaggaccuccuccaguacuaaaauucguagaugcucaaauccuuauacuguguaaaaauggcauuguuuuuccauguuacccaugcaauccuccuguauacuuuaaaucaucucuagauuacuuguaauaccuaguacaauguaaaugcuguaugaauagcuguuaugcuguauuauuugguuuauuuuuuuuuuuugucuauuuauuuuuuugagacggagucucgcucugucacccaggcgugaguguaguggcacugucucagcccacugcaaccucugccucacggguucaagcaauucuccugccucagccuccugaguagcugggacuacaggcccgugccacaugccuggcuaauuuuuguuuuuguuuuuuuuuguauuuuuaguagagacgggguuucacuaugcuggcuaggcuggucucgaacuccugaccucgugaucugcccgccucggccuccuaaagugcugggauuacaggcaugagccacugcgcccagccuauuuaguuucuuuuauuuaaauuuuauuuuuuuauuuuaaaggaauaaagaagaggucuugcuauguugccuaggcuggucuuaaacuccuggccucaaggauucuuccuguuuuggcuucccaaagugcugggauuacaggugugagcccccuuacccugccugucaauuuuaaauuguuucuuucccaaauguuugcuuuucuuucuuucuuuuucuuuuucuuuuuuuuuuuuguuuuuuuuuuuuuggacacagagucugucccugacacccaggcuggagugcaguggugugaucuuggcucacugcaaccucugccuucuggguucaagagauucucccaccucagucccccaaguagcugggacuacaggcgcuuaccaccaugccccggcuaauuuuuguauuuuuugauagagacuagguuuugccauguuggccaggaggccggucuugaacuccugaccucaagugaucuaccugccucagccucccaaagugcugggauuacaggugugagccauugggccuggccccaaauauuuuugauccacuuuugguugaauccauggauacagagggaugacuauaucucuaaaaaggguaacuucauuuguuuuuguaaaaauaauucuauagguagauuuuugcaauaaagggcaauaauuucaagcugucaugaacauuuuagggauugaauaaagagcucuugugaccuuaagacaauuuucauaagacaguauguuuguauucuucuuacauauacauauaaagccucuucaguuguccuuggagaguucccauaacacaaugaaaaagacauacuucuguuaaauuuaccaguuccuuauuuauuguuuuaggugcugcccauauucuacaccaacuuugaauucucccaguagaaggaaguucucuuaccuuguaguuucagcaaugagcauauuuuuuaguuuauaguaaguguauauguacacuuuauauaauggcgagaacuauuauagcucgugaauguugccuuuguuucucuucauguaauagugagaaauguguaacccaugccaguauuucaggagaagucauuaagaagacauuggcuagggcaagauggcucacaccuguaaucuuacacuuugggaggcuaaggcgagaggacuguuugaggccaggaguucgagagaccagcauggggaauauagugagacccccccaucucuacagaaaauuaaaaaauuagccaugcuugguggcaugcacccggaaacccagcuacucgggaggcaggaagaucccuugagccccaaaguuugaggcugcaguaagcuaugauugugccacuguacuccagccugggcaccagaguaagacccugucucagacaccucccuccccugaaaaaaaaacccaagaacuaacaguuuuuacauauaaaauugaagagaaaugaaaauaaaaagaaaaggugauuugucuggcuguagagaggugggauguuuuguuaagauauaaaaaacaggccgggugcgguggcucacgccuguaaucccagcacuuugggaagcugaggugggcaaaucuggagucaggaguucaggccaacauggugaaaccccgucucuacuaaaaauacaaaaaauuagcugggcgugguagcgggcaccuguaaucccagcuacuugggaagccaaggcaggagaaucucuugaacccaggaggcagagguuacagugagccgagauuacgccauuguacucuagcccgggugacagugccagauucugucucaaaaaaaaaaaaaaaaaaugagauaaaaacauaaaggguauggagaauuauuccuuuguugauaguuucuagucaaguuauuauuguuuuuuuauuuuuauuuuuuccgagacagagucuugcucuguucaccaggcuggagugcaguagcgccaucucagcucacugcaaccucugccuccuagguucaagagaucucuugccuaagccucccagguaguugggauuaaggcacccgccaccacgcccagcuaauuuuuguauuuuuaguagaggugggauuucacccuguuggccaggcuggucucaaacuccugaccucaggugauccgcccgccucagccucucaaagugcugggauuacaggggugaaccacugugcccagccucuagucaaguuguuaauauguguucuuaauauauguaggagauuuuaaaacuauauugcuuugaauauuuaauaguugguaacuggccuuaugaagagcuaaucuuuaaaugauuacuuuuaacaaaacaauggaguugggaccuuuuaauuaaaauguuuaaaaugaucauugaauaguuaaaaaccaugugauaccaaaguuaaaagauacaaaaucaaauugacccugucagccauuugcuaaagauaccuaguucucccuagaagccaaacacuguuuugaauuuuuucuguuacugucaucuuuuaaaaauguuuuuucuuccuaaaaaggaauccagaacccuggcugaaauugcaaaagcagagcuggacggcaccauucucaagagcagaccucuacggauucgcuucgcuacacauggagcagccuugacugucaagaaccuuucuccaguuguuuccaaugagcugcuagagcaagcauuuucucaguuugguccaguagagaaagcuguugugguuguggaugaucgcgguagagcuacaggaaaagguuuuguagaguuugcagcaaaaccuccugcacgaaaggcucuggaaagauguggugauggggcauucuugcuaacaacguaaguuuuaaauaucuuguccuucuucuauccaguuacauaugggcuucucucuguuuuggaauucugucuuucauugcaguucauacuagcauaugguaaguagguguugaguaaauauucagugaauauaaauaagaaauuuucguguacugguaggagucaagagucauguacuuucuucaaacuucagaguuuaaaucucugcaguguuuuguauuauuucauuuaacuuaaugaacauauauacaaaguaaaaucuauaaacuuaagguaauccuuucagaaauuguaaucagcuuuauugacaccuaauuuacauuaauaaaaagcaccucaggggugcaguggcucaagccccagacuuucagugcgcggaucaccucaggucaggaguucaugaccagccuggccaacauggcaugaaaccccaucucuacuaaaaauacaaaaauuagccgggcgugguggugcaugccuguagucccagcuacuggggaggcugaggcucaagaaucacuugacuccgggagucggagguugcagugagccgagaucaugccacugcacuccagccugggugacagacucugucucaaaaaaaaaaacaaaaccucaucucuucuaaaaauacaaaaauuaauugggcguggugacacaucccuguaaucccaccuacucaggaggcugaggcaugauaauugcuugaacccuggaggcagagguugcagugaucccagaucaugccacucuacuccagccuaggugaccgagugaccuugucucaaaaaaaauaguaccuugggccaggcgcgguggcuuaugccuguaaucccagcacucugggaggcccaggcggguggauugccugagcucaggaguucgagaccagccugggcaaauggcgaaacccugucucuacuaaaaauaugaggaauuagccgggcuuggugcugcgugccuguaaucccagcuacuugggagggugagucaccagaaucgguugaacccggggggcggagguugcagugaguccagauugugccacugcacuccagacugggcgacagagcgagacucugccuaaaaaacaaaaccaaaaacaacaacaacauaaaaacaucuugggggcagcgugguggagugcacaguagucucagcuauuugcgcuguagucccagcuacucaggaggcugagaugggaggaucacuugagcucaggaggucaaaguugcagugagacccugucucuauuuaaaaagaaaauuaaaaauaauaauaaaauaauaaaagacauucuguuguagagcucaaugagguguuuuuuuuguuuguuuuuuuuuuuggagacgagucucacucugucgcccaggcugcagugcaguggcgaucuugacucacuguaaccucugccucccagguucaagcaauucuccuuccucagccacuugagcagcugggauuacaggugugcaccaccaugccuggcuaaucuuuuguauuuuuuucuuuugagauggagucuugcuggguucaagugauucuccugccucagccucccgaguaguugggauuacaagcgugaaccacuguguccggcuaauuuuuauauuuuuaguagagaugggguuucaccauguugggcaggcuggucuggaacugcugaccucaggugauccacccaccuuggccucccaaagugcugggauuacaugcaugagccaccaugccuggcccguauuuuuguagagacgggguuucaccauguuggccaggcuggucucgaacuccugaccucaaguaauccaccugccugagccucccaaagugcugggauuacaggugugagccacuucacccggcugagcucagugaguuuuaacaaacauauguacucauguaacacacugccauaauaaaaauacagaacacuuccguuaccccacagaaguucccuugugcccuuuuacaguuauucugcacucuaccugccuuagauagcuauuucuuauuuauaaauaaguuuuguguuuucuaauauuaagugaaaucauauaguauguauucuucugugucuggcuucucuugcucagcauauguuuaugagauuucauucauaucuuuguguguauaguauuuuguuccuuuuuauggcugagucauauuccaugguauggacauaacuauguuuuguccgugacauauggauggauauuugaguugcuuacaacuacuggccauugugaauaaagcuacuaugaguauuuguuuacaaggcuucuugugaauauuaggcuuucauguggcuuagguaaauauuuagggguaaauugcuguauguuuaauuguauaagaaacuaccaaguucuuuuccguggugguuguaucauuuuacauuccuaccagcaaugagugagugacuucuaguuacuccacauuuuacccacacuugguguuuuuauuuuuuauuuuuauuauuuuuauuuuauuuuauuauuauuuuuugagacggaguuuucgcucuuguugcccaggcuggagugcaauggcgcgaucucagcucgcugcaacgucugccucccggguucaagcgauucuccuggcucagccucccagauagcugggauuacaggcaugcgccaccaugcccagcuaauuuuguguuuuuaguaagacgggguuuuuuuuugagacggagucucgcucugucccccaggccggagugcaguggcgcgaucucagcucacuucaagcuccgccuccuggguucaccauucuccugccucagccucccgaguagcugggacuacaggcucaugccgccacgcccggcuaauuuuuuguauuuuuaguagagacgggguuucacuguguuagccaggauggucuugaucuccugaccucgugauccaccugccucggccucccaaagugcugggauuacaggcgugagccacugcgcccggccguuagacgggguuucuacguguuggugaggguggucucuaacuccagaccucaguuuggccucccaaagugcugagauuacaggcgugagccaccgcgcccagccuauuauuaauuuuuuguuaauuugcuuuuugaggcagagucuuaaugugucacccaggcuggagugcagugguuccaugucggcugcuacaaccucugccucccgaguucaagugauuauugugccucagccuccugaguagcugggacuacaggcaugcaccacuaugccuggcuaauuuuuuuuuuuuuuuugcaguagagaugggguuucgccacguuggcuaggcuggucaggaacuccuggccucaagugauccaccugcuucgguuucccuaagcgcugggauuacaggugugagccacugugcccaguugccacuugguguuuuuagacuuagauauucuaguuaguuuagcgcaaucucauugugauuuaaauuuuauuuuccugaugacuaaugaugagcaucuuuucaugugcuuuuuggccaauuauauaucuuuccugaaauaucuaaaauuuuuuguccauuuuuuuagaugucccccuuauucauuuuuuuuucuuuucuuuuauuugagacagagucuugcucuguugcccagccuggagugcaguggcgugaucucggcucacugcaagcucugccucccggguucacgccauucuccugccucaaccuccugaguagcugagacuacaggcgccagccaccauguccggcuaauuuuuuuuguauuuuuaguagagacaggguuucacauguuagccaggauggucucgauauccugaccuugugauccgcccgccucagccucccaaagugcugggauuacaggcgugagccaccacgcccguccccugcuuguuauuuuuaauugggcagauugucuucuuacugaauuaugaaaucuagauaagucuguauuauaaaucuuccugccagucuguggcuuguuuuuaaauuuucuuuuauuuuuauuuauuuauuuuuuuggggggggacacggucuugcucugucacucaggccaaagugcaguggagugaucucggcucacugcagccuugaccuccugggcucaaaugauucuccuuccucagccugcugaguagcuaggacuacaggcaugugccaccaugccuggcuaauuuuuugaauuuuuuuuuaaaguagauaugaggucuugcuaugucacccaggcuggucccuaacuccugagcuuaaacuauccuccugucuuggccucccaaagugcuggaauuacaggugugagccauugcaucuguaaaguuuuuuaacuuuaacagugacccucaaagagcagauguuuuuauauuuuaugaaguccaaauuucaucaauuuuuuucuuguaugguuuguucuuuuuguguccuuguaugaucuuugcuuaagauugcagagcuuuucucauguuuucuugagaaauuuuauagcuuuuacauuuauacauuuugagugugacguaaaaauccuuguuaccgugcaggucuccaguuguuccagcaccauuaauugaaaaaauuuaugauuuccccuuuguuaccaggaaaaaaaaaaucuguacuuuuuuguuucauugaccaguuugucaguuccaaaauuguacuugcuuaauuaccauauuuacccuaagcuuugaaaucagguaguauaaucauccaauuuuauuuuuucaaaaauuuuuuuggcuauuuagguucuuuguauuugcuuauuguauggugcugucagcuauugguugggaucauucagauguuuuaggguuuagggaauuuaggguuuagggaauugaucccuaaaauuuaaaaaauuuuguuuccuggcucuauggaacuuaguugcugauuuguaagcauuuuaaaacuuacuuucgacuauuaagcauugauacuaaaacugaaauucgugcuauaucugcuguuuuacaacacaaucuugucagagauugugcucuuauucucuuuccuuagagaaugcucuuucuucagauugucauagaucuugcuuuuccauuuuauuuuuauuuuuuaauuuuuuauuuuuuuucguauuuuuaauagagcugggguuucaccauguuggcuaggcuggucuugaacucuuggccuuaggugaugugccugccucagccuccuagagugcugggauuacagacaugagccacuacuccaggccuacuuuuuguauuuuuuguagagguggauuuugucauuuuguccaggcuggucuucaacuccugagcucaagcaauccaccugucucagcuggccucagccucccagagugcugggauuacaagugugugagccauuguucuuguccuuuuuuuuuuucuuuuuuuuuccucgaggcaaugucucagugugccucccaggcuggagcgcaguggcauuaucacagcucguugcagccucaaccugcuaggcucaagucauccucccaccucaggcucccaagcugcugggacuauaggcaugcaccaccacacccaguuaacuaacgauuucuuauugauagcuuuuuuuuggagauaaggucuuacucucacccaggcugaaugcgaucauaggucacuaugcccucagccuccucaggcucacaugauccucccaccucagccuuccgaguagcugggaccacaggcaugugccaccagacuuggcuaauuuuuuuacuuuuuguauuuucgccauguggcccaggcuggccuugaacucuugggcucaagugaucugcucguuuuggccucccaaagugcuaggauuacagacacaagccaccgcucuuggcugguaggauugauugauugauugauugauagauugauuugagacagggucucacucugucacucagggugcaguucuguggcauguucuuggcucacugcaaccucugccucuuggauucaagcgauucaugugccucagcugccugaauagcugggauuacagauguucaccaccacaccuggcuaauuuuuguauuuuuaguagagacgggguuucacuauguugaccaggcuggucucgaacuccugaccauaagucauccgccugccucagccucccaaaguccugggauuacaggcgugagccacugcgcccagcugcaggcuugcuuuuuaaaacucuuuucugcacacuuuuccugugcagaagaguacaaaaauaauuuuguacuuuuccuauuuuauauuuauauuugaaagggauuacuuuuuccaacauuuuauuugcuuuaucauaucuuuccauuaaaugagauuacuuuuagacaaaaaaaauucuuuaagaaaaacauuauaauauuuccauugccuguugaaaauaaugaguuaucuaggaaaaccugcugauaaguauaaauugcuacuuaacuuuuuaggaaagcaacauuaacccuugauauacuaucagugcuaauuggauccaguuuuaguuuuuugcuuucuuuuuuuuguaaagauugauauuuccuuauuuguuauuuguaguuauuuguaaagacugauacuuccuuauuucuuagaggucuucaaaagaacaaaaagaaaaauuaaaaaaauuaaaacaagcugaguguaguaguaggcaccuguagucccagcuacucugaaggcugagguuugcuugagcccgggaguucgagacuagccugagcaacgucgugagacccgucucucaaaaaaaaaaaaaaaaaaauuagaucccuuuucuuaaaauuaccacauggaucuauugugucauuuuguaaaucuaagauaucauuaucagauccuagugauuuuauuuuuucuccaucauaaaauauuuuauuaauaucgucauccugguaauaauaauaauaauaauaauuauuauuauuauuauuauuuuugagaugggcucucauucugucacccaggguggagugcauggcaugaucuuggcucacugcaaccucugccuucuggguucaagugauuccugugccucaaccuccugaguagcugugauuacaggugcgcaccaccacacccagcuaacuuuugaauuuuuacuggagacaggguuucaccauguuugucguggcugcauccugauaauuauuuuaucauuacuauucaacuauucucaaccaugcuuauaaauaugcaacugagcuaaaaugaaaaaccaucacaaaaugguacaugucuauaagggugauucagugcagaaauaaauugucaucaucauuacacauucuucguuuuaaaaauuauguguagcuugggcaacauggcaaaacccuaucucuacaaaagaaaaauaaaaaaauuagcuaagcaugguggugcacacuuguagucccagguacgugggaggcugaggugggaggaucacuugagccuuguaggucgaggcugcaaugagcagugaucaugccacugcauggcagccugggcaauagaacaagacccugucucaaaaaaaagaaauuacaugugcaaaauauugcauuaucuuuuaagccaccuuuuuuuuuuuuuuuuuuuaaggcaaguucugcucuuacccagguuggagugcaguggcacgaucauagcucauuguaaccuggaauuccuggccucaaaugauccucccacuucagucugccagagugcugggauuacaggcaaaagccaccuugcccagcccuuaagucaccauguuuuuuuuaguacuguauauuuuaccuuguuuccacaguucuaagaaaagaucagccacaaugaggaaagaucagucacaaauacguaguugauguuauauauaauuacagaaaacaugaaaaccccagauguauaccaguugguaugguuaaaaaaauuauugugcaugcaugcagugcguaaaauggugccauuuuacauugaguacauuggauaucugaaaaaaagcauguauagguaauucauuuuauguaaacuuaugcauauauccaacagaaaggcaagucuuaagugguuuucacaaaaaugugaucagagcuccucuccauauguuaggauuucaggggccuuguuucuucugcaauacuugcuauuuaaguuuuuucacaaugaaacauuuuucaaguuuuuuuguaaauaaauuaacacuuuaaauuuuaguauuuucaagccugaaagaacacugaaauacuuuuucucucucuuacccccugaaaaaaaccuucaguuucuuuuuuuccgagacaggguuucagucugcugcccaggcuggagugcaguggugugaucucugcucacugcaacuuccaccuccuggauucaagcaauucucguuccucagucuccugaguaguugggaccacagccgcugcccggccaccaugcccggccaauuuuuuguauuaguagagaugggguuuuaccauguuggccaggcuggucucaaacuccuaacuucaggugauacacuugccuuggccucccaaggcguugagauuaccaacgugagccaccacgccuggccgaguucacuuugauuuaaugaacucucuuuaccaagaacugugcuaagugcccuaccuuucuucuuucguuaucauaacaacccuaugaugcacugauaucccauuuuaccgaugagaaaacuucagagaaaacuucagcuagcgcaggaaccuccuagccaaaggcuaugcagcucauaaccugcuguaaaccccagggccucagucccgaagccucucucucucaguccuucaaguuuauaaccaaacuaaugauugacuuggugguaaaauggggagaaaaacaaaaacccaagcaguaacuucagauuuaacauuaugguugaacacuuugauuuguuucuuuuugaucuguuuuguacuuauuauauacuuauauuugcaaaaagaguaaccuggacagacguagucacucaugccuauaaucccagcacuuugggaggcugaagcgagaggauaucuugagcccaggagguugaggcugcagugagcugugaucgccccacugcacuccagccuagacaacagagugagacacugucucaagaaaaaagaauaaauguaguuauuauaccuaugguaaacagaauuuaaguugaguuuuuuuuuuuuuggaaacaguuuugcucuuguugccuaggcuagagugcaaugccgcggucucagcucacugcaaccucugcuuccuggguucaagugauuauccugccucagccucccaaguagcugggacuacaggcauguaccaccauacccagcuaauuuuuuguauuuaguagagacgggguuucaccauguuggucaggcuggucucaaacuccugagugauccaccugccuuggccucccaaagugcugggauuacagcugugagccaccgugcccggccuuagguugaguuuaacaaauuuugguuauaccuaaagaugaaagugaaauaaacaagaugagucagaaaauggacaaagggagcuucuauagggagugguguauguacaaugaaaccauagauagaaacacauuuuagcauguguuccaauaaauaaaaauaagacacagucccuuaaguaauucccuuguacacaauacguacccauguuccuuggucuuuuuauguuguguaauuagaugaaugugguugugauugaucuuuuuuucugagacggagucucguuguaucauccuggcuggagugcaauggcacgaucucggcucacugcaaccucugccucccagguuccagcgauucuacugccucagccucccgaguagcugggacuacaggcgugugccaccacgccuggcuaauuuuuguuauuuuuuuuaguagagauggcauuucacuauauuggccagacuggucucaaacuccugaccucgugauccacgcaccucggccucccaaagugcugggguuacaggcgugagccaccacgcccagccugauugaucuuugcucacugguuuauguuucuucagaaguggaauuguaggagcaagaugauauauagagugguagagggagacuuuauaaacuuguuuguaucgauuaaguucccucuuagaaaucuguacuucuccucucccgcacuguguaagaguugucuagugguccaaacuuacaugugaaaaguuuacaauuuguuaaaaucucuaacauauuugagaguacagagaugucagaguuuucccuuaauucugauuacgguuucccuuggcuucauauacuuuugucauuucugaugaaugacauaucaucugcuuaguucauuuuucccucuuaauucuguuucugaaguuucucugaagggggauggucuuguguuacuggagggguuugcuuguuucuuuguuggccucugcucaggugcaccuuuuaucugauucuguuacuguucuauguuuguggcccugccauagcuuccagcggaugaaugguccauaaaaugcaucaucuucauuuuggcccugggccuuuuuggguacuuuuagaaguaccacaucuuaagucucuuuaccuuuggguuccuauucaguuuaucugagguuucuauaaucucauuccaccacuccaugauauuccauaccugcuuuaacuguuuccuuaaaaugucuucacuaacucaguaauaauuuugaaaaguuauuuuguaucuuuucuuacauuuaggaucuaaagucuguguuaaucucugguauuauguguaagagaagcuuuuggaguccaaaaacccuucaucucucuagcuuaguuuuuucucucugaagcaucacuguuuugaagguaguauaaauagauuuuaaugccccuugcauggugaagagccgaucucaaaggaaauuuuaauaucagugugccauccauucugcuuauuccucuuccccuccaugaacucuccuuuucuccuauuuuacugaagaaaacaguaaagaaggagggccucuagucauaucuuucauuacccacucuugucauuuccuuaucccagcuuuucuccuugaaugucuggugucuucugccuucccuuuuucccuuuuugucuggcuaacaucuuuuauuuuuauuuuuauuuagagaugacaucuugccuuauugcccagguuagagugcaguggcucuaucauagcucacugcagccucaaauuccugggcucaagugaucuucccaccucagccuccugaguaguguaugcuaccuggcuaauuuuaaauuuuuuuuuuuuuuaauuugagacggaguuucacucugucgccugggcuggagugcaguggcgugaucuuggcucacugcaaccuccgucucccggauucaagcgauucuccugccucagccuccuaaguagcugggauuacaggcgugcaccaccacgcccggcuaauuuuuuguauuuuuaguagagacgagguuucaccauguuggucaggcuggucucaaacuccugaucuugugauccacccgccucagccuaccaaagugcugggauuacaggcgugagccacugugcccggcuaauuuuaaaauuuuuuauagagacaggaucucgucaucuuucccaggcugaucuugaauuucugggcucaagccaucuuccccgccucugcuucccaaagcucuagaauuacagguuugagccacuucgccgaaauguuuuaggucggauuuucagcuuuaacuuuuuuuuuuuuuuuggugacagagucucacucugucgcccaggcuggaguacaguggugcgaucgccacucacugcaaccucugccuccugaguucaggcgauucucauaccucagccuccugaguagcugggacuacaggcgugugccaccacgccuggcuaaauuuuguaguuuuaguagaaacgggguuucaccacguuggccauguuggucucaaacucuugaccugagguaguccgccugccuuggccuuccaaagugcugggauuacaggugugagccacuguuccugcuggccaacauuuuuaagaacuuucugaacaauacugauagauacagggaaacugggugguggguacagauggguggguugagguggugggacauguugaugauaaagauauauauuuagaaaaugucucacuugagaaaaaugucucagaaguaucauuuguacucauaaaaaucaaucaauagcugaagcaguggcugugaugaugaccacacauauaaaacauggguuagguacaaauucguuuucauuauacuuucuaaauguuaacuauaaccguuaugcugguucauaauuguugcuuuauuuacucaucuuuuuguggcuuuugacauucaccucucucugacucaguaaauguuuauugacugauuuuuuuuuuuuuuugugauggagucuugcuguguugcccaggcuggagugcagugaugcgaucuugacucacuucaaccucugccucugggguucaagcaguucuccugccucagcguccucaguagcugggauuacaggcacacaccacaaugcccggcuaauuuuuuguauuuuuacuagagauggaauuucaccauguuggccuggauggucuugaacuccugaccucaaaugaugugcccuccuuggccucccaaaguacugggauuacaggcgugagccacugcuucggcuguugacugauuuuuaugaguacaaaugauacuucugagacauuuuucucaagugagacauuuucuaaguauauaucuuuauuauuauaaaacauuucuuuuaagacgguauuaauucuuggcacuguguuaauuuuuaugaaugcuuuuauaccuauccaggaccccucguccagucauuguggaacccauggagcaguuugaugaugaagauggcuugccagagaagcugaugcagaaaacucaacaauaucauaaguaagauuuuauuaauagauaauuugugucuguacuauuaaggguguucauuacauuuguuuucaaauauuggauuaugagguguucuguuuauuuauauaaucuggguaauagaguggucuagucuacauggaaugcuaguuuucuuuucuuucuuucuuuuuguuuuuuuugagauaguaucuugcucugucgcccaggcuggagugcaguggugugaucuuggcucccuguaaucucuaccucccacguucaagugauucucgugccucagacuccugaguagcugggauuacaggcacgcaccaccaugcccagcuaauaguuuucuuuuuuuauauggguaaaacauacuaauuuuuuuuagaaaugucuacuuuuauaacuggggcagggaggguacuaggaggacacugucaauaauauucaugccagaaaaacgaugaaaucuagauaacaugaaaauacuuuuuuuuuuuuuguuuuugagauggagucuuacuccuguagcacaggcuggagugcaguggcgugaacucggcucacugcaaccuccaccucccagguucaagcaauucuccuuccucagccucccgaguagcugggauuacaggugugcgccaccacgcccgacuaauuuuuuuguguuuucaguagagaugggguuucgccauguuggccaggcuggucucaaacuccugaucucaggugaucuacccgccuaggccucccaaagugcuaggauuacaggugugagccaccacgcccagcuggaaauacuucuuaaguuuuauuuugugcuucaagucuauuguagguuaaaaggagauuuuuggugugccaggguagagcaggguauuccuaguuaaauaaccuggcacagcggaaaaacucuuagagguugcaaaaaauagcucauuuucaaaauguauguuuauuuucccuuuucacuuagaauaauacaaguauauuuacauaaauugccuauaugagugcacuuuuuuuuuuuugagacggagucucacucuguugcccaggcuggagugcaguggcacgaucucggcucacugcaagcuccaucucccggguucacaccauucuccugccucagccucccgaguagcugggaccacaggcgcccaccaccaugccuggcuaguuuuuuguauuuuaguagagacgggguuucaccauguuagccaggauggucucgaucuccugaccucgugauccacccaccucggccucccaaagugcugggauuacaggcgugagccaccgcacccagccgagugcauuuuuuuuuuaaguuuauaaagcuuuauuaaacauuucaaacagcugugcaacgaacacaucaaauaaaaguccuagaauagcaguccagauguuucacaaguauggccucacagucccauucccuagauggacugccuccaguucuguucucugccugucccaccucccuuuccucuccaauuacuuuugcagagcuuauuauauuuuuaaaaaccagucacuuacuuauuuauuuuuuugcaggggaggaaugaaggguuuuauugaaaaugaaaguacacucugcagugugggccugagcauaggggcucaaaggcccuguuacagaguuuuugugaguuuaaauacccucuacuugggguaugccuuauguaaaugaagaggaugagguaaaguuacaagucauuuacucgguguauguccuauggagaggauauuuccuguuauagcugaauugugaauuggucuucuguucccugcuuccagacuguauuuuccugccucaucucuccacuuagagaugugauccucauaaaucuuuaugggaggcagagggaccgauggucuuuuuuucuguaacugcuucaugcugacuuggggcauagucucuaccuauuggggaucacggaacucucgcccugcucuaucuaauggaggcaggguaguuucuugauggcuagggguggugucuuugccuggaacuggcuggagccuuuguugcauggucaucugaagcuugauggucugucaaggguuccagugggugcacaguuccaaaaguguggagggacccuucucaguugugagaccaugaacccaaaguucaaggucccaaagcuuuguugugguguggauggcaaggacagucuuucuuucuuuuuuuuuuuuuuuuuugagacggagucucacuccauugcccaggcuggagugcaguggcacgaucucagcucacugcaacccccgccucccagguucaagcaauucgccugccucagcaucccaaguagcugggacuguaggcacgugccaccaugcccggcuaauuuuuuuguauuuuuaguagagacgggguuucaccguguuagccaggauggucucgauuuccugaccuugugauccgccugccuuggccucccagagugcugggauuacaggcgugagccaccaugcccggcgacugacugucuuugacguuuccagaagauucaaaccauaaaacgcuuucuuagggccgggcacaguggcuuacacguguaauccuagcacuuugggaggccgaggcgggcagaucacgaggucaggaguuugagaccagccuaacauggugaaacccccgucucuacuaaaauuacaaaaaucagccgggugugguggcacgcaucuguaauucuagcuacucaggaggcugaggcgggagaauugcuugaacccaggaggcggagguuguggugagccaagaucgcgccaccacacuccagccuggaugacagugagacuccgucucaaaaaaaaaaagguuuucuuuacccuuuugccagcaugccaggcuucugaguucucgcucccugaguggccguagugaaccugcuugacucuuccuccuggcuggcucaccaaaauauguuaacgguggagaguauccaaguucuuggcgucuugaacaaagaauuggacaaaaugcucaaagcaaggaaggagcgaaggguuuuauugaaaaugaaaguaccacuccacagucugggagugggccugagcauaggggcucaaaggccuacuuauuuauuuuuugagacagucucacuuugucauccaggcuggagugcaguggugcagucucagcucacugcaaccuccaccucccgaguucaagugauucuugucccucacccucccugaguagcugggauuacaggcgugcaccaccacacccagcuaauuuuuguauuuuuaguagagacgggguuuuaccauaauggccaggcuggacucgaacuccugaccuugggugauccacccaccuuggccucccaaggugcugggauuacagaugugagccacugcgcccggcccacuuguuuauuagauaaauaaaacuuggagugccuuuguguuagccacuguucuaggugcuagcaguguagucaagcagguaguuggauuuauaacuaggauuuagagcaacuguccuggcuggauuuaugaacaugauauuuuaaagucaaaggaccaaaccuugaaccuuggaguucuucaguguguagagauugggaagaucagaaggaaucaauaacgacugagaagggagcauucauucauuggaauagggggaagaaccaucagacuguguccuggaagcaagggaggagaguauuucagggaggaagcauuagcauuagcguugauuauaauucauaucuauuguuuuuuuuuuuuuugagauggaguuucucucuuauugccuaggcuggagugcaguggcgcgaucuuggcucaccacaaccuccgccucccagguucaagugauucuccugccucagccucccaaguagcugagacuacaggcgcacauaaccaugcucagcuaauuguuguauuuuuaguagagauggaguuucacuauguuggccagguuggucucgaacucccgaccuugugaucugccugcgucagccucccaaagugcugggauuacaggcgugagccaccaugcccagccuaauuaauaucuauucuuauuuccuuugcaaugcuauuucucuuucuuuucuuuucuuuucuuuuuuuuuuugagacagggucuggcccuguugcccagacugcagugcaauggcauggucauggcucacugcagccucuaccuccuggucucaagugauccuuccaccucagcaccccccaaguagcugggacuacagaugugggccaccaugcccgucucauuuuuuaauuauuuuguaaagacagaguuuugucauguugcucagcguggucucgaacuccugggcucaagcgaucugccugcauuggccucucaaaguguuggguuuacaggugugaggcacugcaccuggccacaaugccauuuuuuuuaaaggguuccugugauuuccucuucacuuaacuuuuuccuuguuauaggucaccauuacaaauuugaaauaaagcauacguuuggauuugggaguuagagaacuagaaguacaagguuguuaacaagaauagacuuuauaggcaauauuuguuuauauaguuaaugauaucagcaaaacuuaagagcuaguuauggcugggcgugguggcucacgccuguaaucccagcacuuugggaggccgagguggguggaucaccugaggucaggaguucgagaccagccuggccaacauggugaaacccugucucuacuaaaaauacaaaaauuagccagacgugguggcgugcaccuguaaucccagcuauucgggaggcugaggcaggagaaucgcuugaauccgggagguggaguggagauugugccacugcacuccagccugggugacagagcgagacugucucaaaaaaaaaaaaaaaaaggaguuaguuauauucccacuuuuauuacuaaagauuuagauuuauucacagaagaaaaugcucacaaggcugggcgcagugccucacaccuguaaucccugcacuuugggaggccaaaguggguggaucaccugagaucaggaguuggagaccagccuggccaacauggugaaaccccgucucuacuaaaacuacaaaaaauuagcugggugugguggcaggagccuguaaucccagcuauuugggaggcugaggcaggagaaucgcuugaacccaggaggcggagguugcagugagccaagauggcgccauugcauuccagccugggcuacaagaaugaaacuguuucaggaaaaaaaaaagaaagaaagaaaaagaaaaugcucacaaagcaaaaaagccaaaauucaaauucacuugcaccuucaaaaaaucauguuauuucagugguuuuuuuuuccuuugaaagaaaauaaauaauuuaaaaauauagucagucuuugacuuuggaacugcugaccaguaaacaauucuuuuagaaaaauuagugguugguagauucucccaaucuuucccacuuuccagucagugcuuuaaaaagaaaaaaauccaaguaggguuuucagauauagagucccuaggaucauggcugucuuugauuuuucuucacaugcuucugaauaucuuucccucucuuguuauuacaucuuucccucugugacagccuucuucucuccuagauuugucauacccaccccuccucaccucccuaccccaaaauaaaaguuaaaauuuacauuuauagcaagguaucuaugcuuuuauucauggagugggaauuguuuucccaugaguacuuuuaaauacaggcuguuauaggcgagacuaauugaagauauuuaugcagaaauuucuugaaaguuggcugggugugguggcucccaccuguaaucccagcacuuugggaggcagaagcauugcuuccaggaguuugagaccagccugggcaacaaacguagugguaccucaucucuacaaaaaauacaaaaauuagcuggucaugguggcaugccucuguaguucuaggugcucuguagccucaggugggaggacugcuugagccugggagguugauuuggcaagugagccuuuuuuuuuuuuuuuuuuuugagauggagucuugcucuuguugcccaggcuggagugcaguggcacaaucucggcucacuguaaccuccgucucccgaguucaagcgauucuccugccuuagccuccugaguagcugggaucgcaggcacccgccaccacgccuggcugauuuuuguaauuuuaguagagaggggcgguuucgccauguuggccaggcuggucuugaacuccugguguugugauccgccugucucagccucccaaagggcugggauuacaagugugaccuaccgugcccagucucggcagugagucuuaauugugccacuacacuccugugaaacugagcaagacccuaucucagaaaaacccaaagcaacaccuccaacaacaaaaauucuuaaaagugaaaagaaaggcugggcacgguggcucacgccuguaaucccagaacuuugggagaccgagauggguggaucacagggucaggaguucaagaccagccuggccaacauagugaaaccccgucucuacuaaaaauuacaaaaaauaagccaagcaugguggcggacgccuguaauccgagcuacucgggaagcugaggcgggagaauggugcgaacccgggaggcgaagguugcagugagcugagauuauaccauugcacuccagccugggcaauacugugagacugugucucaaaaauaaauaaauaaauaaauaaaaaagugaaaaaaaaauugacuggggaccagguguggugucuuguaccuguaauuuugcacuuuuggaggcugaggaaugaguauuacuugaggccaggaguuugagaucagucauauuuuuuauaugucucuaaaauaaauauuuacauauauauguauauaugaaaaaaaugaagacuuucaaauauauucauagcccuuuauuugguaauucguuaauuuauucaagaaauguauauuaaauguauauacugcacucuagguacuugagguggugguacagcauuuaacagccacauuugaugucgucaauugaguuuaaagucuaucaagagaaagagguaauaaauaauuaacuacaaugguaguaaguuaggccuugauuuuuggggccuacccaauuaauuggcacauaacgcucaguaaaaucuagcugguuuuacuagaaaaacaucugauccagacaguuaauucauauucauguguuccagacuuuccuuuguaaaauauuucuuuuuuuugggacggagucucgcucugucacccaggcaggagugcaguggcaggaucucagcucacuauaagcucugccuccuggguucaugccauucuccugccucagccucccgaguagcugggacuacaggugccugccaccacgcccggcuaauuuuuuuguauuuuuaguagagacgggauuucacaacguuagccaggauggucuugauauccugaccucgugaucugcccgccucggccucccgaagcgcugggauuacaggcaugagccacugcgcccggccuguaaaguauuuuguugacugaaaaccagaaaaugaaaccuccaaaagcagaaauuuugcagguaauaauuaggagaaugcagguuguggcaucagauuguguaaguuugaauuauuguuccauuauuaguugaacauucuugggcaguucuuaaacucaggccuguaaucacaauauugucacgagguaauucauguagacacggugucucacacggugucuuggacauuguaagugcuuguuguucucauuuguuguuguuuuaccuuuuaagcauacauuucuguauguuuuaauguuaauuuagggaaagagaacaaccaccacguuuugcucaaccugggacauuugaauuugaguaugcaucucgauggaaggcucuugaugaaauggaaaagcagcagcgugagcagguugauagaaacaucagagaagccaaagagaaacuggaggcagaaauggaagcagcuaggcaugaacaccaauuaaugcuaaugaggcaagguaaauauggauuuucauguacaugugguaugauuuuuuuuuucccuuaaguguguguaccauucauguacuacuguguaaagugccauuuaggaguuuagagguaaaguuggaacucaacauauuaggugugaaaaucucccuuuucccagauaacuucccuuaaaaaaaagaacacaacuuacuaaaaguuaguuuuacuugacgggcgcgguggcucacgccuguaaucccagcacuuuggggggccaaggcagauggaucaccugaggucgggaguucgagaccugccugaccaaccuggagaaaccccaucucuacuaaaaauacaaaauuagccagccgugguggugcgcaccuguaaucccagcuaguugggaggcugaggcaggagaauugcuugaacccgggagguagagguugcugugagcugagaucgcaucauugugcuccagccugggcaacaagagcaaaacugucucaaaaaaaaaauuaaaaaguuaguuuuacuuaugcaagcaguaguguuggagguaauuugcggguauuaaauugugccaguaucaaauacaugauucucuuggcaaacagaaacauagcaggcaaauuuugguagguagacauggcacauacaggauuuuuuguuugaugagaagaauuuggacaaaugcuggcuauuuaagauuauuauuacauguuugaaagaguacagauggauaaucugguagagaugaaaaagauucauuuguacacauugauauggggauuuaggaaaaguuaguaauugguaaguguauauauauauauauauuuuuguuuguuuguuuuuuguuuuuuuugagauggagucuugcucuguugcccaggcuggagugcaguggcgccauauugucucccugcagccuccaccaccuggguucaagcaauucuccugccucagccucccgaguagcugggauuacaggcacacaccacaauguccggcuaguuuuuuuguauuuaccuucucuuggcuguccccagagaucaagguaccacagcugccugucugaauuucugcaguagcauuccugcugaacguuucugccaucuaaucuuggcuuucuuuaaaccguucuguguacuagauucaguauuuuucuuagcaggugaaauuuugaucauucuucucuaaauccuuuuggguaaauucucacuugcuuuagaaugaaguguagguuuuuuuguuauguguguucuaguauuucguacaucacuauucaguaaauguuuauugagcacuuaugaugaagucauugaguaacugugcugaugccacauacguuaaaacaaaaucgagcccagcaaaccauagaaacuaguuagguguuuugguuuaauuuggacccuaagcuugguaguucuauaaguucacuuuucuaacaaaauugaauucauuuauaucuuagaguagauuuaaagguaaacugucauuagccagaugugguggcgggcgccuguaaucccagcuacuugggaggcagggaauuacuugaacccaggagguggagguugcgguaagccgagaucacgccacugcacuccagccugggcgacagacagagcgagacuccauuucaaaaaaaaaaaaaaagauaaacugucuuuuauuuuguggaaaaugugcaaguuguuauuugagauaaagguacugaaucauucauuagcuguuagaucuggaagagagauuuuuuuuuuuuuuuuugagacagaaucucacucugucgcccagccuggagugcaguggcaugaucucggcacacugcaacuuccgccucccauguugaggcaauucucgugccucacccucccuaguacacccucccugggacuacaggugcgugcuaccacgcccagcuaauuuuuuugcuuuuuuaaaauuugagauggagucucacuguugucgcccaggcuggagugcauuggugugaucuuagcucacugcaaccuccaccucggggguucaaguaauccuccugccuccgccuccuaaguggcugggauuacaaguguaugccucuacacucggcuaauuuuuuguauuuuuaguagagaugggguuuuaccauguuggccaggcugcucuugaacuccugaccucaggugauccgcccgccucggccucccaaagugcugggauugcaggcaugagccacugugccuggccaguuuuuuuguauuuuuaguagagaugggauuucuccauguuggccaagcuggucuugaacuccuagccucgagugaucuacccaccuuggccucccauagugcugggauuacagauaugagccaccgugcccagccaagagaucuuaaaguuuguccaguccagugguuuugaaauuuuauuacccauuagaaucaucuuggaaauuuuugaaauuucguuuccugggcucugugguuacccuagcccuucuguucaauaugaauuguuuucucuuagccugcuaggcacuucucugccauuuuguuucccaccuaccuacaguugugcccuaguuagauaacaauguugauuagauguggaagcaucuguacuaaagauuuguguugaugcuacgaacagugguauaacauucacuaauuuagcacaucuuuaaugucaguuaugggagacaugucugagguacugaggauauauugauggcaaagaacauuuccuuagacuucaguuuuuucuugagcucuuagaaaacuuugccugaagguauuuugauguuugaaguagaguaauuuugcaguuauuucccaugaguuuuuuuguuguuuaucguguguguucauuuaaagccucuguuaacaauaucuuaguuuauaauauuagaaaaucacauugcuuguugaauccuacucccugcuucuggguucacuugugccgaaguacuuguacuuauuugauccaaagucugcaauugguaaauuucaguuguaguuuguuuaaaaauuuaaaaaguuacaacuuucucccauuuguucuacaauuuuguauuucuuuuuuuuuuucuuuuuuugagacagacucuugcucuucgcccaagcuggagugcaguggugcaacuucagcucauuguagaccuaccucuugccuucugaguucaagcgauucuccugccucagcaucccaaguagcuaggauuacagguguacaccaccacgcccagcuaauuuuguauuuuuaguagagaugggguuucaucauguuggucaagcugguuucgaacuccugaccucaagugaucuaccugccuugaccucccacagugcugggauuacaggcauaagccacuguacccggccuacaauuuuguauuucauccagcauuucuaaggauguauucagguugaggagagacuguaauuaaucuuaguugugugguuccgcagaaacauguaucaugacauaucauggaaggagaaaucucaaacaauacagaaaaauugucccccuauuuacuaccuucugcuuuuuuguaggaaucacuuuuuguauuuuaagucucuuuuguauucuuuaaugaaaaaaaauuugcauaugucauuagauguuuuuguguauuuguaagcaaaaaacccaaaaaucguaacaacaaaacaaacuggcuggguguaguggcucaugccuguaauucuagcacugggaagcugaggugggaggauugcuugaguccagcaguucaagacuaaccucaguaacacagugagaccccgucucuaccaaaaguacagaaauuagcugggcaugguggcaugugucuguaguugcagcuacuugggaaggcuuaggugggaggaucacuugagccugggagcuugaggcuguagugagcuguaauuaugccacuguacuccagccuggaugacagaacgagacucugucucuaaaaaaaagcuguuuaccuuuucuguaccuuuuuuacuuucuacaugaauauauauguaaauauccgccuuauauuuuuaaugguuguaugauauucuuuuauauggguacaauuaguuuaguucauccucuuucgauaacaauuucucuuuucaguuuguuuuuaaaagcagugcugcaaagaauauauaugcauguaucagaaaauuuuuguaaauguugauuuuuuuuuauuuuuuugagacggaguuucacucuuguugcccaggcuggagugaaauggcgccaucucggcauacugcaaccuccaccuccuggguucaagcgagucuccugccucagccucuugaguagcugggauuacaggcaugcgccaccacgccuggcuaauuuuguauuuuaguagagaugggguuucuccauguuggucaggcuggucucgaacuccugaccucaagugauccauccgccucagccucccaagguguugggguuacaggcgugagccaccacacccagccguaaauguugauucuuauugaacacauggguaccuuacaauaauaauuguuugauuuauacuuuacugauaauuauuuaguccuuucuagauucaacucccauuacauuaaaaaaaaauuuuuuuuugagauggagucucacucuguugcccaggcugguguucaguggcacaaucucagcucacuacaaccuccgguucccggguucaagugauucuccucccucaggcaugagccaccauacccggcuaauuuuuguauuuuugguagagacagggcuuugccauguuggccaggcuggccucaaacuccuggccucaagugaucugcccgccucagccucccaaagugucaggauuacaggcgugagccacugcgccuggcuccauuacauuuauuuuuuuuuaacauuuauuuauuuauuuagagacggagucucgcucuguugcccaggcuggagugcaguggcgcaaucucggcuugcugcaaccucugccucuguguuucaagugauucuccugccucagccucuugaguagccuggauuacaggugcaugccaccacagucggcuaauuuuuguauuaguaguagagaugggguuucaccauguuggucaggcugaucuugaacuccugaccucgugauccgcccaccucagccucccaaagugcuaggauuauaggugugagcugcucggguagcugaggcaggagaauugcuugaacuagggagucggagguugcagugagccaagaucgcaccaccgcacuccagccuggcgacagagcgagacuccgucucaaaaaaaaaaaaaaacaaaaaacaaaacaaauauguugcugugagcccuucuuaaagaaaucaacagaggauaaacaucacauaagugaagaacagaacagucaugccugaaccuacuugagauauuaggauuuaaauacaugugagguuuaugauuaaagaacauuaaugccgacaggagaucgagaccauccuggcuaacauggugaaaccccaucucuauuggaaauacgaaaaauuagccaggccugguggcaugcgccuguagucccagcuacuugggaggcugaggcgggagaauugcuugaacccaggagguggagguugcagugagccgagaucacgccacugcacuccagccagggcgacagagcgagacucccaucucaaaaaaaaaaaaaaaaauuaauucagugucauaaaucuggacagaucagcgguaaaauaaaaacugaaagaaaaauaaagagacuaguauuuuuagaaaauaaaauuguuagaucagaaguuauacauucaguuuucaugacuugugcaauuuuaaauugagaaaacacugucuuacagucuagcaaaucaaaauuuuaguuuguuuauauuccuuuuuucuguaccuguauuuaugauacauugaaauuauagcauauaauuucauguaauuuuaucauuaaauuuguuaggacagcauuuuaauuaauuaauuaauuugagacagucuugcugugucacccaggcuggacugcguuggcauaaucucugcucacugcaaccugugccucccagguucaagugauucuucugccucauccuccuugaguagcugggacuacaggcgugugccaccaugcccggcuuauuuuuguaguuuuaauagagacaguauuuugccauguuggccaggcaggucucaaacuccugaccucaagugauccacccgccucagccucccaaagugcugggauuacuuucggaggccgaggcagccucccacuuugguaagccacugugcccagccaggaaagcauuucaaaguguuauuugguuuaguaaguaauaaguaauacgguagaugaugccuucaugacuguagauggcuuuauuuuauuaagaaaaauuccugaguguaauuuccuggaucaaaagauaaagacaucucuaguugggccgggcgcgguggcucacgccuuuaaucccagcacuuuggaaggccaaggcggguggaucacaagguuacgaguucaagaccagccuggccaagauggugaaaccucaucucuacuaaaaauacaaaaauuagcugggcgcgguugugggcgccuauaaucccagcuacuugggaggcugaggcaggagaauugcuugaaccugguaggcagagguugcagugagccgagaccucgccauugcauuccagccugggcaacaaagcgagacucugucucaaaaaaaagaaaaaaaagaaaaaaaaagacaucucuaguuauguacuuuuuacaguuuuuuccccuagaaagauauuaucauggcaguguacagauguauaagcuuuagugaaauaucaggaacuuuggguauuaggaacuuuaaaaaauauauaauuuagucaacauaaaaugguaguuuuaaguuuauaguucuuuuaaguauuagguaauugugcuuauuugauaauuucauuguuggagccuuugagcuaauuauaccaguguuacaaguaaggugauaagaucugagagguuaaaagccugucaguccuggcuguuggggagacugaggugggaagaucucuugagcccagguuuuugaggcuguagugagcuaccaucaugccacucuacuccagccugggugccagagugagacccugucucugagagaaaaaacaaaaaagguauuuaaguaauuuuuuuguuuuugagauggaguuucgcucuuguugcccaggcuggagugcaauggugugaccucagcccacugcagccuccgccucccggguucaagugauucuccugccuaagccuccugaguagcucugauuacaggcaugcgccaccacgccuggcuaauuuuuguguuuuuaguagagacgggguuucuccauguuggucaggcuggccuccaacucccgaccucaggugauccgccugccucagccucccaaagugcugggauuacaggugugagccauuacuuaaauacuggucagguauuuaaguaauucuaaugaguauuuaagguugagaauuauguuauaaagguucgaaauaauugcggucauguuuaacauuuuucagauaaucaaguguuuucucuaugggccuauuaugagaacuaccugggcccugucucauauaccaaaacagacuuuucuuagcaacauccccaaaugcauauuuuuaaguuuuccaauugagucugaucaacuagguuuggcauacuuuuuugaaagagcuuuggaauaaggagagguuuggccuggcaucccaguugaaucauguaauagcuggagcaacuuuauaaucugucugaauccuuuuuuuuugcauaauuuauaaaugucuguuuuuaaucuguaaaauggggagaacaauauuuaccuuguuaugguuaugaugccugucuugcuauuguuaugaaguuuggguuauugguaccuuagauuaacuuuagcuguaguauuauaugagucaacucuugaguacagguguuuauuaagaaacauucaguugagguaauuuguucacuuuagacauuucagauauaaagagaaaaggaaaauaaaagcaaccagcaauugugccauccagaguauuuuaacauuuuauuauuuuaaaauauaugcauauauacauacauaauuuuauacaaaaucacacacaaagauuuuuagcuuuggagauuuuuaacguggaaaguuuauacacuacuucuuagaugugcaauacaaauguacuuuucauuaucuuacucuggaacccccccauucuugauauggcagggauuggugauaguggaaaugcuuuuuuguuguugaaaagucuuguuuauaucagcauuuaucuuugcuuucuucuuugaagaauugucuccucacucuucuucguaagacauuggcuuaguuagggaggaauuucaugcuaaucguguugcgagggagguuccuuggguuuuaugucaugauuccuguuuggucugguucuuaagugcucucugcuggugucucugaaggcauguguuggggcuuugcauuugcugcugaaaacaauuacaauuuguuauuuuauuuuagagacaguucugcugugcaacccaggcuggagugcaguggcgcaauuuuggcucacugcaaccuccgccucccauauucaagugauucuccugucucaaucucccgaguagcuggaauuacaggcgugcaccuccauacccagcuaauuuuuguauuuuuaguagagaugggguugcgccauguuggccaugcuggucucgaacucccaaccucaggugauccgccugccuuggccucccaaaguguugagauuccaccugugaggcaccacaccuggcccugauuuuuguauuuuuuguagacaggguuucacuguguuacucaggcuggucucgaacuccucggccgaagugauccgccugccucggccucccaaagugcugggauuacaggcacaagccagccuaccuauuuuaauuucuugacguaaagaugaauuuuuauuuauuuauuuguuuguuuuuuuuuuuuuuuugagauugagucaucucacucuguugcccaccugggcuucccaaaguguugggauuauaaggcgugagccaccgcgcccagccaagaugaguuuauuacguguuuuuccccuaacaaugaacuuguuuuugagauggagucuugcucugucauucaggcuggagugcaguggcacaaucucaacucauugcauccuccaccucccggguucaagugauucuccugccucagccuucugaguagcugggacuacaggcgcgcgccaccaugcccagcuaauuuuuguaguuuugguagaguugggguuuugccuuguuggccaggcuggucucaaacuccuggccucgagugauacgccugccuuggccucccaaauuacugggauuguaggcgugggccaccgcaccuggccaagaaugaacuugaauacucuuuuuuauauacgugaagaaacgugcucagaaaggauauuuauuuaauuacccagcuuacauuauuauaaaaugaguaauauaccaauauauugccagugauagagaacuucuaugcuuauugguauaaaaauauggaaagggaaacuaaaaauauuaaugugcagucauuauuuuauagaucuaaugaggcgucaagaagaacucagacgcuuggaagaacucagaaaccaagaguugcaaaaacggaagcaaauacaacuaagguaaaagaagaucauuuuaagaaacaugaauuguaugucuuauuaauaaaaacuccccacaaccuguuacaaguuguauaaguugaguaucacaggaaaaauagaaaaauugcccauuuuaaccacauacagugaauuacuucauaauguagcauaauucuuugcugguuuuuagcugguuaagggcacuuugaaugcuaaacuuugaaguuaaacaaggguuuuagguauuauuauauguaauuuauuauaagaauaugcugugaauauccauuuuuccagagauggauauauuugcguugcucuuauuuauuuuguuauguguaaaacucuacuaugaauaucuuuauguaacuuugugcuucugauaaucuuuaaacaagauuucugaggcugggggcaguagcucaugccuguaauuccagcacuuugggaggcugaggugggcagaucacaugaggucaggaguucgagaccagcuuggccaacauggugaaacccugucucuacuaaaacuaaaaaauuagcuggcugugguggcacgcgccuguaaucccagcuacucagggcguugaggcaggagaaucgcuugaauccaggaggcggagguugcagugaucugagaucuugccacugcacuccagccugggcuacacagugagacuccaucucaaaaaaaaaaaaaagauuucuggaaguugacuccguguuaaaagggguuauggggacuuaaaaucucaguacauaauagacaaucgugauggucagcuugaaaucuuuuagguuuaaguaagcauguuugagagagugguuaauucaagauauauaaacccacauugauagcucaccuugugccugugguguuuaauugcaaaauauaaugguauaaacauuacucuucaaagguucaaaaaucauacuaguuaggaaauauuauaaacaaagcuaugauaguuaaagcaaauguagaaaucuguuuuugaaaauaguauuugcuuuaaaaauguaaggugcuugugauaagaaaauaagguguucauggggaaguaaaaguaaagaaaaaagugaaaaaccgugaacaaauuugaagcuucucuggucuacagauaggugauauucuguauauuuugauguauuucuucaaacuuuguaccugaguuuaucaauuuauaaauauuucuaugugauuuuacucuacccaauucauucuuuuuuuuuuuugagagggaguuucgcucuuguugcccaggcuggagugcaauggcgcgaucucggcucacagcaaccuccgccucccggguucaagccauucuccugccucagccucccgaguagcugggauuacaggcaugugccaccaugcucggcuaauuuuguacuuuuaguagagacgggguuucuccauguuggucaggcuggucucgaacuccggaccucaggugauccgccugccucggccucccaaagugcugggauuacaggcgugagccaccgugcccggccccaauucauucuuaaaucauauucccuggacagacagcauuaacauuucaccuagggaacuguuaggaauguagucucaagccucccugcagaacuacugaaugagaaacaauaguggugaggcccagccaccuggaauccuccagcauucagauagaucugaaagcuugagaacuacuguuuuuuuuuuuuuuuuuuuaaacaacucucaacaucaugaaugugccuuccucaggaaccuuuuuuaaaacuuuucuuuuuuccuuuuuauauagacauguucaaaucucuucuacuuuuuuuuuaaauuuuauuuuggagacggaguuucgcucuugcugcccaggcuugaaugcaauggugcgaucuuggcucacuguaaccucugccucccaggucccagugauucuccugccucagcuuccuagcugggauuacaggcuugcgccaccaugcccaccuuauuuuguauuuuuaguagagauggggcuucaccauguuggccaggcuggucuugaacucccguccucaggugaucuaccugccucggccucccaaagugcugggauuacaggugugagccaccacgcccggccagaucuuuucuauuuuuaacaaagacaacgaaaccuccucuccccuaacauaaaggcuuaccugaaucuagcuuuuuccucuuaaaacuuagagaugacagcuaggcuuuuugaaauuauaccuaccccucauguaagcaaaaaauaaaucauuaaaaccaaacaauaugagggguggauuccaaaauaggauacaaaaauacaagaaauuaaccuaauugucuuacaaaugaauaacaucaucacauugaaaggggguagggaagaaaacaaggaaccuaaauaacuggaaaauaguguguugacuggauaucauaauacuaaugauaagaaccauacauaaauucuguaagcuaguuaggcauaugggcuaguaguucugaaaccacuuuguguguauacguuacaugaacagauuaguaccuacagucuuuuguaucuguggguucuacaucuauggauucagccaacuguggauugauaauaucuggggaaaaauuguguauauacuaacauuaacagacuuuuuaaacuugucauucucuuuuuuuuuuuuuuuugagauggagucucgcucugucgcccaggcuggagugcaguggcgcaaucucggcucacugcaagcuucgccuccgaguucacgccauucuccugccucagccucccaaguagcugggacuauagacgcgugccaccaugccuggcuauuuuuuuguauuuuuaguagagacgggguuucaccguguuagccaggauggucucgaacucgugaccuugugauccucccgccucagccucccaaagugcugggauuacaggcgugagccacugcacccggcuaacuugucauucucuaaaccgugcaguauaacaacuauuuacauagccuuuauauuguguuagguauuauaaguaaucuagagaugcuuuuaaguguguaggaggacuuuuuguuacuugucguucucuguaaacagugcuguuuacauagucuuuacauuguauuagguauuauaaguagagaugcuuuuaaguguguaggaggaugugcauagguuauaugcgaauacuacaccauaugucagggaguugagcaucaguggauucugguaucugggggagguucuggaaccaauccccugcacauaccaagguaugacuguauauuguggauaaugagacucaaauuucucaucauuagagaaagaugaacggcuaaacuuaaaauccugugugagugugauuugaaucagagguaugaacucugugguguuuaauauugacaaauacaugcagaaauauagauguguguuuauguauggguuaauauguauacauauacuguauuuuauuuuuaauuuaaaaaaauuauuuaagagacaaggucuugcccugucacucaggcugaagugcagugucucaaucauagcugacuguaaccucgaacuccugagcucaaacaauccugccuuagccucccaaguagcugggacuauagguguuuaccaccacacccagcuaauuuuuuaauuuuuauuuuuuuauagagaugggauuaugcuauguugcuuaggcugguaucaaacuccuggccucaagugaucuuuccugccucagccuccgaaagcgcugauauuacaggcaugugccaccaugccugccccauaugcuguauuuuauggcuuuuucuacugagaggcccuagaagcuucaguaacaaugaacauaacuggugccucgaucuuuaauaauaauugcuacagacaagcuuuuuugauggauaccaaaguuggugggcaaaacuugagaaacaggguuuuugcauagucucaaauuuguauacaaaaggaaaaaauauuaaauuuaaagggagaaacccaguagacaccaccauaaccaaacacuaaauuucauaucaccuguaauaagacaguuaacaucaggagccccuugauaugauucacugaaugggauauaacauuauuucugugauauucuuaccagauaugcauaaucauuccaguuaugagaaaaaacaaacccaaauucaaggacauucuacaaaauaaucaguucucuuuaauagugucagguucaugaaagauagaaagacugaacuguuacagacuguuggagacuaaggagaaauaacgacuaaaugcaaugugggauucuggauaagguauuggaacagaagaaagguguuagugggccuguggucccagcuacuuaggaggcugaggugggcggauugcuugaacccaggaguucugggcuguaaugcacuaugucgauuggauguccgcauuaaguuuggcaucaauauggugaccuucugggagcaggggacuaccagguuaccuaaggaggggugaacuggcccaagucagaaauggaguagguaaaaacucccgugcugauuaguagugggauagcgccugugaauagccacugcacuccagccucagaaacauagcaagacccugucucuuaaaacaaauaaacaagcaagcaaacaaacaaaaaacauaggaagacccuaucucuuuaaaaaaagauuagugaggaaacuggugaaauuuuaguaaugucuauaguuaauuauaauauugugccaguauucauuccugguuuucauaauuuuguacuaugguuauacaagggguuaauauuaggggaagcucgugaggcacauagaggauacguugcugauuuaaucauaggcugagauguggaauacuuguugcagauguaauuuuuuauuuuauuuuauuuauuuuuucgagacggagucucacucugucgcccaggcuggagugcaguggcgcgaucucggcucacugcaagcucugccucccagguucaugccauucuccugccucagccuccggaguagcuaggauuacaggcgccugucaccacaccuggcuaauuuuuuguauuuuuaguagagaugggguuucacuguguuagccaggauggucucgaucugcugaccuugugauccgcccgccucggccucccaaagugcugggauuacaggcuugagccacugugcguggccugaagauguaauuuuuuauugcgugauuuuuuuuauuauguaaucucaguauacaggggcaucagauuuaaucuaaaauucaauuaacugaaaauaucucaauauaaggugauaauuugacggguaaccuuuauguuugaccaaauucuaguaaauacaggcaguaauaaaucuguuacaaucuuaguuuuuccugguggcuggggaguuucuuuugaaauuagcuguaagaaucuugauuuaagaagugugaacaacuugccuuaaaauugaguaguuuuuggccgggcgcgguggcucaugccuguaaucccagcacuuugggaggccgaggcaggcggaucacaaggucaggagaucgagaccauccuagcuaacacggugaaacccugucuuuacuaaaaauacaaaaaauuagccggacgugguggcgggcgccuguagucccagcuacucagagucugaggcaggagaauggcuugaacccaggaggcguagcuugcagugagcagagauggcgccacugcacuccagccugggugacagaggggacugcgucucaaaaaaaaaauuuuuuuuuugaguaguuuugcaguauguauaaaggaaagaaaaaaagauuaugucugggaacucauauauauuugcaagauggagcaaaugaagaaaauugucacaauuaaauugaagagauuuaucuggcugaggcugcugccaaguaagauagcuuuauuuguuaacaagccaaauagucugaauucugccuuugugcuuuacuuuaguuggaagauagaaaaacuggccuaggacaguacauuuugggagaaauguauuuggaguacacaaguuucugguuuuacuuucaaugcuauaaauaaauuauuuaguuuuucauagguaacuuaauucuucagagguuguggcagguaccaaaggaagaccaggaugaggggcuuacaugaacugguucagucugugacuugaccacuuaguaguuauuccuuuguuuuguuuguucacuuauuccuucauuccuucucuuuccacccauuuacucaccuacccacuucguuucuuugguuuguuuuuugagacagaguuucguucuugucgcccaggcuggagugcgguggcgcgaucucggucgcugcaaccucugccucuucgguucaagugauucuccugccucagccucccgaguagcugggauuauaggcgcccaccacccugccuggcuaauuuuuguauuuuuagucgagacgugguuuuaccauguuggccaagcuggucgcaaacccuugaccucagaugaucagcccaccuuguccucccaaagcgcugggauuacaagcaugagccaccgcacccggccccacuuccuuccuuucuuuguuuuuuuuguuuguuuguuuguuugauuuuuugagacggagucucgcucugucgcucaggcuguaaugcaguggugugaucucggcucacggcaaccuccacuucccagguucaagugauucuccugccucggccuccugaguagcuggaauuaaaagugcacgccaccacgcccggcuaauuuuuauauucuuauuauuuuuuuuuugagaaggaaucuugcucuuucgcccaggcuggaguacaguggugcaaucuugacucacuguaaccucugccucccggguucaagagauucugcugccuuagccucccaaguaacugggauuacaggcaccugccaccacgccaggcuaguuuuuguaguuguaguagagacaggguuucaccauguuggccaggcucgucucgaacuccugaccucaggugaucugccggccuuggccucccaaagugcugggauuacaggcgugagccagugcgccuggcccccacuuccuuucuuaagucauuuagcgaauuauuauaaagcccuucuucugucuugggcucuguguuggauguggagccauagugcugaacaauaacagcaaggagguuucauccaguaggcgucuuucagaauccugcaagaauauuugagaccuguaaauaauuaaugggccucaaaauaaaacaaauuguaaaauugaaauuuuauuaguuuucaauuaaauguaacgugaagguuuaaaauuugucauaauuacuaguucuccucuccuuaguaguuccauuugugaauauaaccuagaaagcaauccuugaccugaagagguaauuuguauaauuauaaagguggucauuaaagcauuuguggaguagaaauaauugaaagcaaacauauauggacaacaggaauguuucuguaugcugucauuaaauuuagauuauagaaucuucugugugguauaaucguaagggcaaugcuccuguuccccuaaucauuuccaaugugguauauaaacuuuuucauacccucuucuaugguuuuaaaaaucauuuuuauuuuauuuuuuagacagaaucucacucugucacccagaauggagugcaguggugugaucacggcuccccgcagucucaccuuaugggguucaagugaucuucccaccuuagccucccuaguagcagggacuacaagcgugugccaccauaccugccuaauauauauauauauauauuuuuuuuucuuuuuucuuguuuuugaaauggagccuugcucugucacccaggcugcagugcaguggcaugaucucagcucacugcaaccuccgccucccagguuccagcgauucuccugccucauccuccugaguagcugggauuacaggugugcgccaacacaccuggguaauuuuuuuguauuuuuaguagagaugggguuuuaccauguggaccaggcuggucuugaacugcugaccucaagugaucugcccgucucggccucccagagugcuaggauuacagacaugagucacugugcauggccguggcuaauauuuucuauuuuucguggagagaggcugucacucaagugauccucccaccuucgcuucugccuccaccucccaaaguaaucccaguaauccugggauuacaggugugagccaccaaauucggccauaaaaaugguuuuuaaaagcaguaauagcaauaccauucuuuuacuugcccuuuuuccugacauuugcaucgcagacauucuuucaugccaguagauaguaauccaccucuguaacagauguguuucuugucucccaaggugucagugaaccuugucucccauuuauaacugauuaauguguccuugaucuuuugcuuuuauaaauaaugccacaauauauaucuguguauacauaugucccugcacauuugugcguacauuucuguuuacuggaaauaggcuuguucauuuaaaauuaugugguagaagugggcccccaacaaggucacugugucuacuguauugucuuuguaauucggaagcuuugagacuaaaaaguugguguuuuuuuuuucuuuuucuuuuucuuuuuuuuuugagauggagucucgcuguauugugcaagcuggagugcaguggcgcagucucagcucucugcaaccuccgccuccugggcucaagcgauucuccugcgucagccucccgaguagcugggauuacaugcacgugccaccgcguccagcaaauuuuuguauuuuuaguagagacaggguuuuaccauguugcccaggcuagucuugaacuccugaccucaggugauucaccugccucaggcucccaaagugugggauuacaggcgugagccaccgcgcccugccaaaaguuuuucuauguauccucauucagguggcaaucugacgugaauccauuugauggcaaaaguugaucugaacuccuguuaugugaaaccuuuauuaccuccagagugugaauguuuuaucuuacugcagaaauauuaaugugguugauuauggggugcugccccagaucccacugagcauauaaguauauuauuaguauauugacucuuuuuauaaguaguauugguauauuaugaguauauugacccuuuuuuaaaugagaaaaacugaauuucaacacauuugaccuuuauuggaucuucccaucgccacccacacccaugaaugugaaguacuuucuucacaguaaaauauaugaaauguguuaauauccaggaaauggauuaaccaguuuacuuaaagauuauuuuuaaggauuauacuaagaguuguauagagaguaagacaacaaucuuaaaauaguccagauuuugcgugaaaucccuuaggaacauuuuuguucauguugucugacaugaaguucugaguuuuuucucugguaauagaagaaaucaccauaucuuugaauuaguggacucagauuuagcgggaguguugugcaacaaacaagaacaagguaucuugaaauuugaggauuugcaauucuaaauguaggaaaaguacguuauaagaguaaucuggaaaacgagaccuaauaauggggcaucagcuuuauauagccuucacuauauaaauuacuuuugcaguuuuauugguggagggcauacaccuugaguauccauuaugggacauguuuaacaccagaauaaguauuuuggauuuuuucacauuuucaguauuugcauuguguuuaccaggugagcauccuaaaucugaaaugccccagugagcauuuuuuuaaacaucauguuggcuaucaggaaguuccagccgggguguuggggcucacgccuguaaucccagcacuuugggagauugaggcaggcagaccacuugagcccaggaguuuaagaccagucugggcaacauggcaagacccugucucuacaaaaguacaaaacauuaucuggacauaguggcacgugcccguagucccagcuacuugggaggcuaagauuggaggauugcuugagccugggaggucaaggcugcagugagcugagcugagauugggacacuccagcaugggugacagaguaagacccugucucaacaacaacaacaacaacaacaaauccagauuuuggagcauuucagguuuagaaagauucaagaaugcuuucagauuuuugguuuagggaaacucaaccuguguauauuugaauuugcauugguuuaaaugccaauauaaugugagucuguuacuucaauauuacuauauagauuuuuccucuuaaaaguaaccauagacaguaauguaaauguuuaugcuauaacacguaauuucuaaaagcagauuguggacugacaccugcuucaggggauuucuuucaguggguugaugaauauggggagggaggaguugguaaggcuuccuuuuggaaauaggauuuuugucuaggcauugugguuuuuugagguggcuuaucucuggauauguucugaguggcuuuaagaacugugcagugccagugauagaucaguagaucucagacuuuuucuguuuuuuuuuuuuuuguuuuuuuguuuuuuuuuucugagacagggucucacuguugcccagucuggagugcaggggcgcgaucuccgcucacugcaaccucugccuccugaguucaaccuauucuggugccucagccucucgaguagcugggauuauaacacaccuggcuaauuuuuguauuuuuaguagagauaggguuucaccauguuggccaggcaggucuugaauucccgaccucaggugauguacucgccucaaccucccaaagugcugggauuacaggugugagccaccauggcuggcugagauuuuuuccuuucuauaguaagagaguacauguuucagcuuuuuuugacucucaauuucuugaauauacgcaaauaacuauccuaguuaugauuuuacuuuguuuuucugguuuaccuuagcuaaguuacuuuauuucuuuggcuuuuuugauuuauuaaaggcuuggagugacauagaaggaagguaaauuuaggaugccguggucagucgugauuacagguuuggcauaauaugauugcauaaaugauuucauuuuacaugaaguaaaauguccaauggcagcccacauguuaugaugcugaaauuuuuauuugaaaaauuuucagacaugaagaggagcaucggcggcgugaggaagaaaugauccgacacagagaacaggaggaacugaggcgacagcaagagggcuuuaagccaaacuacauggaaaauguaaguaaacuacuaguuaacuaaaaugauuuuauauuuucagguuuaugaugcauauuuagaaugcuuuagauuuugguuuauacaguagucuuuucuaaucuuucuaaauucaucauguuugauaaauuagugauuuucuuaaccucucauaggugguaaaguaaaauuaguuucugaagauaucuauguuuuaugaaguggauguuauauuuuuuccuauuauuuugguugaucuuuaaaaaaacauaugcuauuaaguuagaaaucuugauauauacaucauuuccacuugacugauuuucaccacauacuaauauugaaacaucucuauuuuggaagauuucagacauguacagaagaauuguagugaacacuuauaaacauauggccaaucuuuuacaucuuuaaguauaaccacuuuauuucccaauuuauguuauuugaaauaccugauuucauauaauuuuauuuucaguauguaucucuaaaagaugaggacuuuuuaaaaaaaucuuuaucauauuuuaaaaauggucagcucuuucaucuuaacuaauuaaagcccagauuugcacaggucuuaauuuuuuuuuuuuuaaacauuugguuucuuugaauugacuguuauauccagccucuuuuagucuauagguuuucucuuccugucuuuaauauuuuaguaaccuuuuuuuuuuuuuugagacggaaucuugcucugucaaccaggcuggagugcaguggcacaaucucagcucacugcaaccucugccucccagguucaagcgauucuccugccucagucucccaaguagcugggauuacaggugcgcaccaccacaccuggcuaauuuuuguauuuuuaguagagacgggguuucacuauauuggccaggcuggugucgaacucuuuaccucaagugaucugcccaccucagccuccaaaagugcugggauuacaggugucagccaccaugcccagccgacauuucuaaaauagaucaucuauuguuucauaagauuaugcuuauagaaaagcauuaggugacaauauaccuucuuuucuaguaguuacuuaaaguauguaucgcauacuugaagcaucaugauaaaauuaauuuggcuagaguguaaguuggcaagcucuagccugggacuacugccugguuuuuauuacuccaccacagagauacugauggugcuucuguuuuuaaaggguuauugcaaaagaaagaagaauauuagaaaugauuugugacucgcaauaacuuaaaauauuuuuuucugaccuuuuuauagugucuguggaaaccugggcuggaauauuuauguuuuuuaaaaaauuuuaaaauuaguauuuaugguagauagaccacaaaguuacuaugcucuuaacuuuuugggauauccguauuucaaauaguauguaaaugagguaugauaauuguguaacacugacuaguguucuauaaguuuauuugugauuagaagugauaugaaucuacacaaguuuuucauuauuuuggugucaguuuuauuugguuccaagcuucacagugccucuuacuacugcaaacuuaagcacuaaaagcaauaugaaugaaagcucuaccuaucucaaauauuuuguguuaaugggaguauauuaauaggaaagcauuguauuaagaaugcauugaggccauucuggcaguuguucuucauuuacuuugaaaacugucuuuggagaaaauuguuaaacaauuuuaaugcuguguguguguguguguguguguguguguguguguguguguguguguuuaagcuuugaaauuaggcccucuuaugugcuuucucuuuauuucacuguucaguuuaaagggaggaaucaaaugguaaguguucaacuuguccaaguaaugaguaaaguugauuuucuuuguuaauuuuaagaugccaccucucucuucuugccuuccuaauagaaauauuccaacaaaacuaagaguuaugggacuuuuaaguauaaaauaaauauugauuuacauauuucacauuuuaaauaauaauuucauguaacaaagaaagagugaaaacacuugucauaucuggucaucuuuuuguuugucagccuucaacuugaucauaauuuuaugacacaugggaauauauuuuuaagaguuucaaggauguaagccaguacuucaucaauaucaguugucaguuuuauuuaauacuugauuuuuccuuagaagacaaacuuuuugauaauuacuguuguaacuauaaauuaaacaacauuuuuuacucauuuaggauaacauucaacugccuuaagaauguauacauuuuaauaauaugucuuaauugcauuuagguuugucuuuaccauaauauagaguguauucaauuuuuuuccaggcaguauuuacuaaguggaaauuuucuacuuaucacaauuuuuggacacauuaaaagcuauuauucuggaagcaaugagaauuuuaugagauuguuuuuuauaauugucuugugauuguuuucauauuagguuacuccaccaacuguagauuaaguaguuuaaacacuucaguacuuaccagucuuuaugggaaaaaucugcauuggacuaaaugacagauuuuaguucuagcauuugguugaugcaguuucuuggaguaaacauugcuucuugggaaaauguuaaugucauaaaaauauccaaacguccaucuuauuuuagcuuuaguuauuguaucauguaguuaugaaauauuuggguuaggaaaauuggggugauguuuaaauuguauguuacuugguuuuaaaauuugagaaguuucuuuuuuuuuuuauuuauuuauugaggcagaguuucacucuugucguucaggcuggagugcaaugggaugaucucagcucacugcaaccucugccuccuggguucaagcgacucuccugccuuagccucccgaguagcugggauuacaggugccugccaccaugcccagcuaauuuuuguauuuuugguagagaugggguuucaccauguuggccaggauagucucgaacuccugaccucaggugaucugcccgccuuggcuucccaaaaugcugggauuacaggcaugagccaccacacccagcugagaaguuucuuuuucuuguaugguacauauuaauguuugccuuuucaauaaagaaaagaauaauucuucauacccuuuucagguuuccugcauugaacuaaauauauaccugacuuacuauuaaagcuuauuagucccauuugaguaguugggaauagcccuagguguuucaacacaguuuauucaacacacauaauaaacuugagaauaaagguauguuguaugcuaaggcaacaguuugacucaguuguauuucuuugcuugucagaggcauuccauuguagcacccgagggacugugaggccagaaugauuaagggaauguuggcagaggcuagcaguguagugcuucuuccaaggacaauguaaaacauuuuuuuucuuuuagagauggggucuugauauguugcccaggcugggcucaagcaguccucuuuccucauccuccugaguggcugagacaacaagcacaugccacugugcccagcagaacaguguuuuuccaauguacguaauaaacacucaaggagcuuuuaaaaaauguggguucuuagaucauacuacuaauaauugauuuguuuugugauccagguagauuguaauacauugaucuuugaucacauuuuuuugcuaaauccaguaguuuucaaccuugcaauauauuuguggaacuuaaggaaaaaugccugagauucaguccuccaaguauuuugauucagugugucuagguugguaccaggagauauacguguuaaagaaaacucuacaccuugcuuauuucuuuuugguagcgaagauucaaaacuacuggccuuguauugaaaugagacauacugaaaugaaaauaguugaauuuuucauggauccugggaguguuaguggaaggcaugcuugaugugguucaacaugguguaagauuuauauaggaugcaauuuauuuauuuauugaugguaucuugcuguguugcccaggcuggagugcaguggcuauugacaagugugauuauagcacacuacagccucaaacuccugggcuuaagugaaucuuccugccucagccucccaaguagcugggagaguaggcaugcugcuguacccaucuuucuucauuuuuuucuuucuuuugauugggucucccuguguuacccaggcuggucuugaccuccugaagcuauccuccugucucagucuccugaauagugggacuacaguugccuaccacugcauaugguuauauauccaucuuuagaacacgguucaaacaguaugacauucuacgugaauaguacccugcagaauuuggguguggcaaccuugauuugggcuuucagacuauaugugcaggacauauuaucucaaacuaugcauuaauuuugcgugcauaguucuaauaauuuuaauugucucauccagucgagggguugacagacuagaacagaccaggcucaguucacaugcugccuauuuuuguaacacuuuuuuuuguuuguuuuguuuuguuuuguuuauuuugcccuacaaaaacugauuugaguaguugugacacaacuaugugagacuguauugagacuacauggccugccaagccuaaaaaauauuuacaccugacccuuuaccugaaauguuugcugaccucugaauccgagaguugaagggaaucuauaaaaguggcucauauuaccaaacucguagagcuugugaagaauaaugcaaaucuauucauuuauauauucuuuuccaguguuuuuagaaggcucacugagcacaguaccucauauuccagauccaaggauuccugaggaauccaaauuaguauccagaagguucauugguagucaugguuauaaaccagagcaaaaguuaaugggaagaaaugguaaagagucacugcauugcagcugacaccugggauuuuaaaaucuuuuuuucguuuuugagauggagucuugcucugucgcuuaggcuggaguucaguggcgugaucuuggcucacugcaaccucugccucccaggugcaaguguuucuccugccucagccuuccgaguaucugggauuacaggcacgcgccaccacgauuggcuaauuuuuuauuuuuauuuuuauuuuuauuuuugagacggagucuugcugucucgccaggcuggagugcagugacaugauuucggcccacuccaacccccgccucccagguucaagugauucuccugccucagccucccaaauagcugggacuacaggcgugcgccaccacgccuggguaauuuuuguauuuuuaguagagaugugguuucaccauguuggccaggauggucucgaucucuugaccucaggugauccgcccgcucggccucccaaaguggugggauuacauguaugagccaccacgcccggcccacgcucggcaaaguuuuuguauuuuugguagagaugggguuucaccauguuggucaggcuggucucgaacuccugaccucgugacccgcccaccuuggcuucccagaguguugggauuacaggugugagccaccguacccggccaaaaucccuuuaguucuagucaguagaggaauaaagcacuguucuuucaaaugugaaccccucuugaucaguauuguccaaucuggccuguucuuuaaccagucagccucuuuuccugccucuugcaugggcuuuuuguuguuguuucuuuguuuguucaucuaucaucucuugcuuuaaucauaaccuaacuuucccugauguggcacguguaaaacugaaaaacagaaacucuaucugguaaaaaaaaaaauuccauuaauuuaugcugucagagaagagugauccuguuguuauuuacuaaugaauagauacaaauuuauuuucugaaaugguuugugaagauuccagagcagaaguuacaguuuugugguuuccacauggcugucccucuuuuucuacaguuuuuaaagcucuaaugaggaauuuauguugcuuaagaagauuuguuuuuugaagucuaaacuucugaagcauucaaacaaaagacacauuuuacaagggauuuuuauggccucuucauuaaguuauggaaauaacuaaagaauuauuugcugaaggauuugaugucagauuuaagugugaccugcuggacugguaggcuuauuuaugguauaaugauggccuagucccagugguuuggacauguuggugaaaaucaaaauggauaauaacagacauugcaauggucucauauguaauguucuaguugugacuaguuucgguuguuaauguuuuuacuuauucauuaaaauaauuuauuacaagccaaggauuuuucucaauauuuggcacgguacauaauuguaacuuaacuuagacuuuugugaucaaauaaaaacaaacauauauauaaguuuguaauguuuacacauauucuuagaauugauuuguaggauuuugcugauuugggauaauugguugaagguaugugucaguuuuaaccagguguugaguuauuugaucacuccuccaaagauuauuuaauaguuucaauaauaucuaaugaugugugggaaaccguagaauuuuucauacaaacugggacaaaugaacaugcauacuauuaaaauacuuccuacaauaggcauaaaaugggcuuucuuaggugaaccaggagguauaguuagccuaaucauaugcuaugauuauuaguaaugguuuucuguguuuuaucauucauauuuguaaaucuuuuuugaaugacuacuuggaaaugaugacugaaucucauacuguguacacacuucaucagaggacacuuaauuguauugauuaacauuuuuuugaucuuaccuucuguuagaguuucagagagguucauaauccagaaaaauuaucauguuuucuuuuuuccuuuuggagaauaucuguucagacucaggucauguguuucuucugauuccucaccccagcugucaucuuuuucauuaaaauaauuuaaaauuaaaaauugguuuuaaggagggagucuugcucuguugcccaggcuggagugcaguggcgugaucuugacucacugcaaccucugccuccuggguucaagugauucuugugccucagccuuccaaguagcugagauuacaggugcucgccacuacauccggcuaauuuuuguauuuuuuaguagagaugggguuucaccauguuggccaggcugcucuugaacucuuuaccucaagugauccaccugccuuggccucccaaagugcugggauuacaggcaugagucacugugccuggccagaaaauuuuuuuguuuuuguuuuuguuuucuugaggcgguguuuugcucuugucauccaggcuggaguacaguggcgcgaucucagcucauggcaaccuccgccucccagguucaagugauucuucugcuucacccucccgaguagcugggaugacaggcacccgccaccaugcccagcuaauuuuuguauuuuugguagagacgggguuucaccguguuggccaggcuggucucgaaccccuguccucaggugauccaccuaccucagccucccaaaguguugggauuacaggagugagccacuacaccuggccgaaaauuuuuuuaagacaggcucucgcugugucacccagacuggaguucaguggcacgaucauagcgcccugugaccuugaacuccucagcuuaagugauccuccugccucagccucccauguaguugggacugcaggugugugacaccagccccuccuaauuaaaaacauuuuuuuuguagaguuggagucucacuguguucccuagguugaucucaaacuccugggcuaaagcaauccuccugccucugccucccaaagugcugggauuacaggugugagccacugcaccugguccuuuuuauguucaauauaguuuauucuuuauauuuaccaaguuguauucuaauuuuuuucugacuuuguugucuacuaauuguguucucugaauuuuucgaggucacgaauuuuauguuugucauauuauaguuacuuagauguaaacugagagaauuaaguagcuguuugaagucuuguuuuucaaaugccaaugcagcucaguuaugguuuucagucuguauggaucacuagaccuuggcauuuauugaauauuaaugccucagauauuacacauuuggcacuuuggaaaacauagguggcauugagguacaacugcugauacauuuuuauagacuucauacgugauuaaguaaugaagaguauuuuuaaaagcagccaaagaaacaauuuuuuuuugcuugguuuucaacacaccuaacuuuuuacuucagaguauuagacuuacaggucgucugggagguuuccauuuuggaagaaaaauuuguucacuguuuccuguauucaaaacauagugcugagcacuguggaggauacagaggauguuagaggacuuuaggugcugaguacuuauacagaguaauguuaaaagaaacagcucaaacguucugagaauuuagaaaaugaaauucucuacugagagugucauuaaauagucuugguacuuuuguguguguauaugucuguguuuauaaaaugaugugauuuguuuauuauuccugcuguguuguagguauaccucaugucuuuucauuugaaaugguaaguucuaauaauuuuugguucagaaugguaagauuuuuuagcuaauguuaacucuuuuuugagcaaucggagaagaggagagucaagaccggcaaauagacaugguuaacuaauguaaacauaucuugugcauugucuaguguauaauauaacuaauaauaauuuuaauuauuaguuugaauuaguaacagaagauccucagaaggcauaaaaauuuaacuuguuacuucugcuuugugacuuguuuaauguauuuggagccaccuuacagugcuuguucuacauagugacgguaaauuauauuuuaggcuagucaguaucuaagaucuucuauacuucauauugaggauaguaucucuguaguaucaucuaaaauguuagaauuuuguacuaaaacuaaaaaauuauaaugucuauguucaguauuaaguaacaacuagugagauguaggcuguaggaacucugguuuguaagcaucugaugagaugcaguuaugaguuagauugguaauuauuauaauuauaaacuuucaaaggcuuuuacuuauuugaguuagauugauaauuauaauuacaaacuuucaaagacuuuuacaauucaaaguaacugaaaguuuauggguaaguuuguuucuuuucuuaaugguaucuuauacuauauugugcacuaugugucaaacccuggcuuuucugguuguuuuaccauaguuuucuuaagauaacuucuucauuugauuuauucuuguuuuuucuauauaugauuuuaaccaauugauaugauuguuacaguaguuuguuuuauaauggcaaauuuuaaauaacuuugauuuuuauuuugguaccacuuaaauguguaaaaaaugacuauguauuuaaaccuguagcuuugaguuaguuacuuagaagaaaauauguacuaacaucacaauuucaaggccucugguaaauuauuaagaugauuuaucuaaugccgacuaucacaaacagaaauggauacucuccuguauaaaauguguacuuaacucauacguuggccaucuaugccuuguuuuccucuuuucugcuuuuuucuguugacgggaccaauuuggaacugcugcuugugcaguuuauauuuguucuuuucuuucaccuuucauaccuugaccuggccaguuaugaugguuuuacuuugguaaggaaaugcacuggauaagaaagagguuuuggaucaagaagugcaaaccagucaccaguauuaugugaacuuugguaagauuuuauugcuaguauuguuugucuuacagcugguauccuugcucauuguuuuuuuuaggaguucuggguaaaauaacuaaauuugaagaauaauuaaauacuauuaaucaauuuuagguuuuaaaagcaccucuucagagugaguuuacaccugacaauugaaacugguaaucuugaaaaugcucucagguguaugcauuacaaauaaaauucuuaggagcaguguugugugccuuguagucccagcuacuugggaggcugaggugggaggaucaauugagcucaggaauucaaggccagcucgggcaacauagugagaggcccgucucuuaaaaucucagccaaauagaagcuucuuuaacaauuaauuuauguaaaauacuuauuuccuucugucccuugaugugugcuagauuguguuuacauuuaauugaucuucgguuagaaagccacccuauguauuaaaaaacagccauuaauuuugcuacacauucaguugaauuugacaguaauaucagagcaaucuauucacucaauuaccugaccgaggcuuucaaaauacauuguugaauguauuugguuuaagaggcacaugucaaguuaaugaacacaguaaguuucccuacuucuauuugucguugccuccauuucugauuuaguauuuaacaaguaacaacuacuuuuuguuucgugacuaaaccuugcaguauaaauuaagauguaauuagcugggugcgguggcaugacuguaguuccagcuacuagggagccugaggcaggaggauccguugagcccagugaguauaaguccagccugggcaacauagugagacucaucuugauuuauuauuauuauuuuuaauguaauugauuauucaaaaggauucauuuuaaaguuucaauauuuuaguagccuuuuucaaaagagcuuuagguccacagcaagauuauguggaagguacagagauuucccgucuaccccgugccacaugccuacagcuucuccugcuaucaaaguguuuuaccagaaugauacacuuauaacaauugcugaagcuacauugacacgugcuuaucaaccaaagucuaucguuuaccuuuagauuugcucuggguguacauucugaggguuuugacaaaucuaugacaugaaccuaugauuauagcaucauacagaguauuuucaccuccuuaaaaaucugugcucugcuucucuaucccuuccaccuaacccuuggcaaccacugauccuucuaucgucuccauaguuuaguuuuuuccagaaugucauauaguuggaaucauacaguauacagccucuucagauuggcuucuagucaccuggcaaugugcauuuaaauuuccucuaugucuuuucauggguugauagcucauuucuuuuuagcacugaauaauauuuugguuguaccacaguucacccauucauauacuaaaggacaucuuaguugcuuccagguuuuagcaauuaugaaucaagcugcuauaaacauucauguguagguuuuuguguagacauaaguuugcaccuccuugggguaaaaugcaaagagugauauugcuguaucagaugguaagaguauguuuaauuuuaucagaaacugccagacugucuugcaaaaugguuacaccuguuuguauucccuucagcaauacguugaaguucuuguugcaucgcaucuuggccagcauuuguuuuugucaguguuucggauugucaccauucuaguagguuuuguagugcugucucauuuuaauuugcaguuccgucaauguaauuugcaauucuaucaauggcauacgauguaaaguuucauuuuaacaaucauauaucugaagaauauuuucccagauauucaugggugaagauauuuaggaaugcauguauugaggggagaaaacuuggguauauauauauaaagagauugucuuauauuuuuuaaacuaccccucacuaacuagcagcgaauaacauauauuggaaauuguuguuuuuaauugccugaauuucaaauguuaaguuuuccaagcauucacuauugauuagguuggaaaguuuacaugcuauugaguuguaucaauagaaacguauauuuuuuuccuuuucauuuuaaaacguuuaaaaauuuuuuuggagugaggucucauucugucacccaggcuggagugcagugacgcaaucauaggucaccauaccucuaauuccugaccucaagggauccuccugcguuggucccccaaaacccugagauuacaggcacuggacaccaugccugacccuuauuuacuuuuuuuuuuuuaaaguggagucucccucugucgcccacgcuggagugcaguggcacgaucucagcucacugcaaacucugucuccugaucaagugauucuccugucucagccuucuaaguagcugggauacaggggugcaccaccaugcccggcuaacuuuuuuuuuuuuuuuuuuuuuuugagacagagucuuucucuguugcccaggcuagagagcagugguguuaucauggcucauugcagccuccaccuucugguuucaagcgauuuuccugccucagccucccgaguagcugggacuacaggugcccaccaccacaccuggcugauuuuuuguguuuuuaauagagauggguuucaccauguugaccaggcuggucucaaacuccugaccucaggugaucugcccgcuucggccucccaaacugcuuggauuacaggcuugagccaccgugcuuggccuuaauuucuuuuguauuuuuaguauuuaugggguuucaccauguuggccaggcuggucccuaacuccugaccucaagugaucugccugccucagccucccauagugcugggauuacaagugugagccaccauguccggcccaguuuacuuuuauuagaaaagauucauuugcugauguauauuguucaguaucuuaauacuuuuuucaugaguuaauacuuucuuggcaaagaggccuaauaucuugagguuuuuaaaaauacccaugaauauuucauguaagugauuuuugcuucauucuuugugucuacaauuuguuaucuaauauuucuggcuccuaacgauuuucuuuuuuguuuuuuuugagaugcagucuugcugugucgccaagcuuuucauagagaugggguuucaccaucauggccaggcuggucucgauccccugaccucaggugaucugccugccucagccccccaaagugcugagguuacaggagugagccaccgcgccuggccaacaguucuuauuuaaucuuucucaugaaaguuuaauugguuauaaccuuauuguucuguuauguaaccuucuuuagugaaggaaaagguaauagaauauaguuugcucacacuaaaauauuuucaauugcuaaauauaguuuuuuuuagggaauuuauuuuuaggaauauuuagauauuccuaauugauuaaaaaggcugaauccuguugucagaacuuacuauauuuuucucuagaauuauauauuuuuuaguggauuuaaauguucuacauuauuuuagcauuuucguuuuuugagacauagaaccuaaauagcauguggugauuccuggacaauucuuaaagcuuuuuuugagauaaacaugagaggucuuuaucaauaaagaauuuugacugugaccuaaaaaagaguauugauugugcccauuaagauugcauucacucaaacaagaguuauauugauaaaguguuagaugaauaccucucgucauugaucauuaaaugguguuccaguugacacaguuaaagcaguuuuuauuuaguucagugaguguauccccaaguuuagguggucauacuacacuuuagcuuuaccugaguacuguguuaagucauuccuuuaaauuagguuauugguaauacacacacacauauacacccacaaaauauacguguugaguaucccuuaucuaaaauguuugggacuagaaguguauuggaauuuggauuuuuuugaauuuugaaacauuuguguauuauguaaugagauaucuuggggaugggacccagauccaaauaugaaauucacuuauguuucauauaugucuuauauacauagccugaagguaacuucauagaauuuaauuuuuuuauuuuuuauuuuuuauuuuuuugagacggagucuugcuguaucgcccagucuggagugcaguggcgugaucuuggcucacugcaagcuccgccucccggguucaugccauucuccugccucagccucccgaguagcugggacuacaggugcccuccaccaugcccagcuaauuuuuuuguauuuuuaguagagacgggguuucaccguguuagcuaggauggucuugaucucuugaccucgugauccauccgccucagccucccaaagugcugggauuaugugucuguccaaaaaaaauuuuuuuuaagagacagugucucacugugugacacaggcuugucuugaauuccugggcucgagcaauuggcaucucagccucccaaagugcugggauuauaggcaugaaccacuaugccuggcucaguagaauauuuuaaguaauuuugugcgugaaaguuuugccuacauuuugacuuagacccaucacaugaggucaaguauggaaucuuccacuuugggcaucguguugguguuuaaaaaguuuuggauuuuggagcacuugggguuuuggaugguuaugcuaaccuuguuucaugauagcccaaguacuaaauauuaaaggaaaaauauccauguucugcacaaaaagugccaugugccaguaguggcauguuuaccaugccacuuuggaaaauauuuguuagguuaauuuaccuuacuuagugcaagcuuccuguucuauauuuucaugaaagaaaacugacugcgauuuuaaaaauauugcuucucaaaccuuuuggcuuccauauuucuuuaauuuuccauaucacuauuaaaaauuauugagggugccaaaguccugcuaaaggauuauaucaauauuuaccauauuauaagccaaagcgagguuuuaaagaaaacguuacagaguuaagagucgcuuucuuguacauuuuugcaaaugucuuuuaauguucccuuuaguguagugggaagaaugguguuguuuuauguuuuguaaauuuguuuugcucuauaaaaaaugguuggcuucccacguuugcuuuugcaguccaucuauugcagaaagcuuuuuaauuaaaacgcaucaaagaagaccugacuuuauacggagaagugauaagggaggaguauguuaauaaccuuuaaagauaauuguggauuuuuuugauacuacuguaaaacuuaaaaguacucuuacaucgaaauuaauuggguuggcugggcaugguggcucacaccuguaaucacagcacuuugggggguugaggcagguggaucacuugagcucaggaguucaagaccaucccaaguaacaugguaaaaccccauuucuacaaaaaacacaaaaauuaucugggcgugaugguaucugccuauaguuccagcuacccuugaggcugaggcaggaggauugcuugaaucugggagucagaggcugcaugaguugagaucacgccauugcaccccagccugggcaacagagugagacugacaaaggaaaaaaaaaaaaaaaaagaaauccgcugggcugcuuugaauuuugaauggauuuuuuacccaugcaugauuuuuuaguguuauguaccaaucagaagaaaaauacugaugcauuggccuaagcagauuauccaaaaugcuaauguauuuauuuuacaaaauuaaaaagaaguuacaugucuucauauugaucucauagaaaauauccgccaaauacucaagccaauaauuauagugucucuuauaaaaaccuuguucugugaaaaaaguauuucauucaacaugcaccucaauuaugaaugcuuuuucuuaaaauaaccauccuacuucagaaugcagcagauguacuuuguggacaaauccuguuuuauugugaagaacaugaaaaaagcauguacccauggauagagauuuaauaaaauuaacuuugacugcuuccuccagguauucauaguuuaaaauuuuaaacuacaguuuuauccaugugacaaaugcagugguuacuaguaaaaauugggcccaagucucuuggcuugugcuauagugcugggacuuuuccuagccauuacuuucgcaccauuaaauguagugaauguugauacagagaaaagucugaugauaguacuauaacuaacuguaucuuagugcugggaaaacaugaaauaguugugacugugcacuuccugaguuuuggggacucuuaguguacuccaugaccuacacguuaagaaccgcugcaaugauggaaugcucuuuugacaugugguucugggaauuagucauacuuugccuccuuuuuuggucaucuguuaauuuaaguacacuugaauucgaagcuuucaggaauacauauguauaauucuuuccauggaaaggcauacaaucuuauaaauaccgcaaagauaaguuaaaaucuugccuuuuguuaggcuucgacuguuggaauucuuuuuuuuuuuuuuuuuuuuggcugucugggacauggagauauguuggaauuuuugaagaaugaaaguaucucgugaacgucaaaaauuuugugaacuccauuucaguagaaucguauagguuagcucagccacuuacuauccauaugaccuugacuaaguuauucaacagcuuugugccucaguuucauuaugucuaaaaugagguaacaguaggccuacuucauagaguugaaucaauaauguaaaacugaguuuucaucauagguuuauuuuagcgcacugcagucuuuugagauguugguuacaaauaaguuguuuuggcuuaaacaacaacucuuaauuuuuuguaauguaauaaagcauuauuaaaauuuguaaaaauaucacguauacgcacugguucuaacuuaaauucuaauuugaaguguuauuaaaagucauucauagagggaaguaaggguuuuguguauugcuuguugggugggcacacaguugugaauuuccucaagugauucuuauuaauauuugauagauuuaguguuagugaagaaugcuguauuucauuuuacaaaaucauccuaaucucuaccucuuuugcauuuuacuagaaguuuguagcggugguuuucuagaaaguaacagccugaagacaugacuaggaagcugaaaauuucuuuugccccuucuaagauaguuacaaaaugaugccaucaaauuauacucuuuuuucuuaagagcaaagcuguguaaaauaguauucaguaaucaucuuuaagauauugucaacauuacuaaguacaaguauauauauauauauuuagugaaaaaugcuguaaugugccucaugaauugguauuuuaauacaguaauaugcuaugguagcauggaguauucuaagauauucugauuaucucauuuagagaaagguauuuuagaacuuguaccaauuuauaauauaccaccagaaggggaauguucauguuuaauaguuaacuuaaaaccauagauauuuuugguacauugauacauuucccgugaaauuuucuuaaugacaauggauuuaauaauaaaagaagguacuuugugaauaauaaagcuugcacuauucuagaaaguuauucuagaaagugauacauagagcugaaaauacaaagagacaauaaaaaagauuguuuaugcccuuuuuuccugccagugaaucauaggccaauaguuaagguauuaggguauauaagggguaguugaaaauugaaaucucaagcagugagacuguaaacaauuacccuauauuagugguuagauauugaauuccuaaccuuucauagugaagacaaauucaaaaguaaaaauauaaauugaaauccuguccuccccaaaagucaugacuaugaaauccauguauuuuacucgauggugcugguguguaaccagcuucugaacaacgaaaugucuacuauauuugcuuguuacagauacuuaucuagauacuauagauauuauuuuuauagcuagaagauuuuggguguuuugaagcauucuuaaguuuuaucaguagguucuaagaaccuaucaguaguuucuaaguagugauaaggaaauggcaauuugguuugguuuauugaaaguagugauaacagaagcuuuauuuuaaaauaguuuucuaaauauaaugcuugaugaguagcaauuuuauauuacagucuagcuuuuuuuuuuuuugagacagaguuuugcucuuguuacccaggcuggagugcaauagugcaaucuugguucauugcaacccccgccuccuggguucaagcgauucuccuaccgcagccuccugaggagguaggauuacaggcaugugccacuacugcccagcuaauuuuuuuguauuauuaguagagaugggguuucuuuuuuuuuuuuuuuuuuuuuuaugagacggagucucucuuuguugcccaggcuggaguacaguggugcgaucucggcucacugcaaccucugccuccuggguucccgcaauucuccugccucagccucccgaauaguugggacuacgggcgccugccaccacaccuggcuaauuuuuuuuguauuuuuaguagaaacgggguuucaccguguuagccaggauggucucaaucuccugaccucaugauccgcccaucucggccucccaaagugcugggauuacaggcgugagccaccgcgcccaaccuagagacagguuucaccauguuugccaggcuggucuugaacuccugaccucagaugaucugccugccucagccucccaaaguguugggauuacuggcgugagccacugcaccccgccucagucuagcuuuuuuugcaggucagcaauaguauccauuaauggucacaaauuuuaugaugagaaauuuuuaggaaaguuaaaacauggcuuuuagggcugggcauugcgguucacguuuguaaucccagcacauugcgagcgugaggcaggaggauugcuugagcccaggaguuagauaccagccugguugacauagcgagacccuaucucuacaaaaaaaaauucaaaaauucaccaggcaugauggugcaugcuugucaucccaucuauucgggaagcugaggcaggaggaucacuugagcccaggaguucgaggcugcagugagcuaucaugacgccacugcacugcagccagggcaacagagcgaggaucucugggaaaaaaaaaaaaauuaagcuuuuuagaaagauugguauuuaaaucuucuaaauaaugugagaaagcauuuuaucucuucaugaugguguuuuuguuguaccguagcuucauucauuguaccguagcuucauuaggauuaccuuuggacaucuccauuuaaguuaggcaguuuuuuuaaggagccacuuguggcuuaauggcaauuacguuuccaucauaggcuuuuauuuuauuuccagcuuuauaggugcuuuucaacagucuuucguauuauaaaauggaacuuuaaaugaacauuuagauuuuaauaagauugcuuuucaaaaguacaguaauuaugcuuucuuuaaacauugcugcauuugucucauaauggaauguuuuucaugauugcuacauuuaacaguuuucugugauuggaaauggucaucaagucaaagugaaaauugcaauuuuccuauguuaucuugagaaauuucacuuagagauuucauugaaguuaauucuaugucacuauuguugguaaaugaacagcuuuuaggaagcaguuucuguaaugaaauuucaaauguucugaauauuucuguuuuauaguuaacuguguaauacuuucauucagguuuucaaauaaaauuacugcgcaguuaaaggaaagcaauguuaugucgagcuuucaguaauugcuugugugggcuaucuauagucccuggauggaauaaugcuugaguagaugaauacaaauacaugaaugaauuauaauauuuagacaaugaagauuguaaccuuauuuuuagcauaauucccuaaagcuauuuguguuauauguucaaauacauuucaacaugaacuugguaacagucauuucuauuuuaagacuucagugaccugggaggagaaaauaauuggcucuggugguuaucauuacuagauuuuccuuugcuuggaaucuaggcaugugucuuucaucuguuggaauaaaaacauuaaaaauaauuugugauauauuuuauauaaucugauucauuaguaaucuaaucuugcaauauaaacuggaugcauuaagcauuuguaguauauuaagccugggagacugaaguuucuuuucagcauucuuauuaaguuuaugaugauggaaacuuuucaaaauuuuuaaugaaaaaugaugucccaauucacucuuuucuuuuugauuuuagaugggaaauguaaagucauaagaucgauagguugacugugacaacuauguuuacuuacagagagaacaggaaaugagaaugggugauauggguccccguggagcaauaaacaugggagguagggauuugaagcaaaaggcuuuuguaauuuaucauuuuuggggggacuguuuaugcuguuugugguaucuacauaucaguaagaaacuaaaauacagaaccaacauuucuaaaggugaaaucucuuacauccauuaaacuggaauacaauacaauuauauuaaaaauauaugucugggaagaaaauucucauuuuguuuuuguuugaaggcuaaaagauguguuauacauucauaggcuuaaugaaagaaacauauaaaccagguugcaauacagccugaagguaguuuagucauugcauuguguaauacagcucugucuuugcaguuuuaaaaucaaauuuuaugccuucuauuuggcuuuuuuuuuuuuuuuuuuuuugaggcaggaccucacucuguugcccaggcuggaguacaguggcacaaacuuggcuugcugaaaccucgacuuccugggcucaagugguccuuccaucuuaccaaguagcugggacuacaggcaugugccaccacgccuggcuuauuuuuuguauuuuuaguagagacaggauuucgcuuuguugcccaggauggucucgaacuccugggcucaagcaguuuacccccaucagcuucccaaagugcugauauuccaggcaugagccaccucgccuguccuaauugaacacuggaaauugauaguuuccgaguuggaaauugauaguuucugaguuguguuuuuagguggagagcguuuuauacauuucuaucuuaaacuagcuuuuuguguaacuuugaagcuguuuuccuucacuuuaaugaauauugaacuuuuuuccuuuaaccuacaguguugugcacagaagugcacucaguguuuguagucuauaacucaucaagggaauuaugugugucgccaaugcauguuuuagaguugacuaagcuuuuaagaaagcauauuagcaacuuuaguauggauuugcucguauagccaaguugcaagggaaauaaugccaaguaaauaaccugaaggaaaagcaaguguggcauaucguaggccuuacuaaauuugaaauuugaaaugucauacauuuaaaaguuggauaaggaauuaaauuuuauuaaauuaauugucccacaaaagcugucccacauuaaauugucccacaaaagguguuaugaagcuaaaaaucuuuauauaacuuaaaaguacauaguuucaaagauuacacuaccauggcaaacaauguacuuaacaugcacacccauuuacaaaaucaaguguguucucagcauauauagucuaucaaaugaaacuuaagucauguguggaaugaacauuuuccaugaucagcuuuuuuuucuuaaacuucuguugccaguuuuucaauacuacuaaucagauaauguagagucauauauugcuguuuuacuuggucacuuuuuaccaacaaguaguuagugaauaucucugauauaugcaggaagcaagaaacauggcccucgcccauaaagaacuuaauugugaaauuacugcaguggauacgugaaauaauuaaugaaccaagaguguucuaaauuaugaagcauaauugaguauaaugauguccaagugguccaauauuuaugucuuuuuuuaagaguaaaugcuggggugcuauuuaauauaauccauguaauuuuaaggauuuuaggaauaagguuauuguagauuauaggcaguuuaaaaggcuguuaucauuauuagaaugacauuaacaucagagcuaaacuuuaaaauaguauaaaacuuaaaaccauuucugauggugcagagauacucugcaauuuuaucagaagaaauaucagaauaugccuuuagaguccuuauuuaguuaggaauugaagauaacuuaaaauuuuugugacauuuuauucaccagaggacuuacuuacauuuuagcacuuaacucuccuaaagcccaguuuaucuaauuuucucuucagucuucauucaaugugagacuucaucauaaugguuuuguagagcuauuaaucauuaucauccaguuggguuguugagaaguuaaaacugucauaacucaucaaguuacauugauggaaaguggcagcagauuuucugguguaucacuaguguguauaaccaaacgaaaccuacauuauaaugcuaccuuucuaguaaucagauaaugcuaacauuuuuuauaucuuuaaauuuauuuauagcuaugugguggaagaugugaauacuaaaaguaaggcucuaaguuaacugcuguuaguuggaaauauuauuuuugauuuuuuauacccauaguuguauaguuauauucugaacccaccauuguuaaauuacauucuauuaaagagaaagagaggaaaaagaaaacuuccgaacccaccauuguaaaauuacauuccauuaaagagaaagagaggaaaaagaaacuuaguuuguuuucugggggauuguugagguaagacgccucuuagauacuguucuuauauucucuucaugucuagauuguagaaauuauuaaaaauagcuauuuagggcuauacugagggagcggaaauauucuugguuaaagucuguuuaucggcaagagcauuuggggaugaaggaaauaauuccuuccuaugaauuugcuagguuucuggggauuggauucaaagagcagaaguaugaugccaggggcugguaaggacucagccauauagagauuucagcugcauuauaauguauauuugagaaauugaguucuuauuaucagaaaauugaccuauguaaugaaauacuagaagaaaacucuaaauuagaauggcuuuguuaugaauuuuuaaugauaaguacuaacacuuaaaagggaaaaaauuuuucaaagaaaaugccuaaaaauguguuguaucugagaucaucauauauguaguauuacagugcaaacacuauuaauguuaaugagguagguggauuuuuuuaaugaaaaaacuugaaauauuaucagguuguccccauuuauggaauuuaagcuugucagaaagauccagauagcuauauuaauauuuuaucuguauuugguugcgguugcuuuuaaaaauaaguuuucuuauaagucauuucaauuuuuugguuuagaguccauauuucaaaauaaaaaguuaaaaaaagaguaccuuauguaauuuagcaagguauuccauaaacucagggaggaaaaaaaaaaaacuaagaugagaggcuaguuauaaugaucuuuauuuauauauugcaggaaaugauuuccucucucacaacuuagcauaauuuacugcuaauauuuuuagccauggguugaaaaaaauuaagugguuuuguaagugcuaauccuuuguuacucauuuaaacugguaaaauguaguccccauuguuagggauucuuugguuuaaaagccugcuauuacaaaauaauagugaugucucaaagcuugcaaacuguuagucucaaaugcccuaaaaugauugauaguuuccuccuugauuuuauguacguuuggcuuggggaugaaaauucuaauucuagaguguagguaauacccuauuacagaguagauaacgcauaucgcauucuuaaggagcgaaaauaauuuugauaauggucuugguauauagauugcauaaauauuguuaaauuguuaauguuuacuaaacuaagauaggacagcucuaaguauagauuguuuuacauagaugcguuuagcccagccccugcugguaaccaagguccuccuccaaugauggguaugaauaugaacaacagagcaacuauaccuggcccaccaauggguccugguccugccaugggaccagaaggagccgcaaauaugggaacuccaaugaugccagauaauggagcagugguaauguaucauaaacauuauuuugauuauauucaguaauguacacuucugcaucaaggauaacuucacacuuaauauaauuugguaucauuuguuuuggcagccaaugaagaagaaaauuuugugacaucauauguugauguguuacagauaguuuuuuuuuuuuuugagacagagagucucgcacuauugccgaggcuggugugcauggcacgaucuuggcuugcugcaaccuccaccuucuagguucaagcaauucuccugccucagccucccgaguaguuggggcuacaggcgugcgccaccacgccaggcuaauuuuuguauuuuuaguagagacaggguuucacuauguuggccaggcuggucucaaacuccugaccucgugauccgcccgccucggccucccaaagugcugggauuacaggcgugagccaccgcguccagcugagauaguuuuuaaguaguccaagaauuaggauuacugucuguggcaugcugugguaccucaguauauagcaaaugcauauguuaauuacagauauuuuucugugcuuuuuaauuuguuuccaucuuuuaccagcauucuaacguucaagcauuuuaugauaguguucuuuuccuguguggacuccuuauauuugauggggacaaaaguccaauauguaugaacacacaguuuucaguaaauauuuuugauaaaaauauuaccugucaugauuuauugcaaagaauuuggcuguaaauuaacauuaaaguuuuuguguauuuccaaaccaccauuguggcauucuuuucacagaauuuuaaauuauauuuaguaaauuuaaaguagacaguuuuuugucuugaucugagagugugaagauaucuuuguguggauuaaauacuaugaaaacaagguuuuucaguuguaauuuuuauuauauuuaaauauauuaguagcaagaaugauaccuuuuaucauuucuauuaaagucugucacuauauaaaucggacuuuaggcaaaccguuuucucauuuaguguuuguuaaugcuuguuguaaauaacauuuugaaagggaaauuguuugguuaucuauuuugaaaaggcaguuuaguuuugaaacuacuguaugaaaucuugaggcgccaaugcugcuaagaaagaaagaaagcacugccuguuagacucagaccugucaucaguuguaaauccaccgugaucagagacguuaaaagcaaugcauuguaugucuuagaguugaaugcagcauuuaucauuauuuuauuugcuucaagaauuuggagaaauuggacaugcuggcaguuggauuuuuuaaaaugauaguuuauacagggagaugaggcagugcacggcuacuaugaacagauggcgcuuaacacagugauugcauuuauuuccuucaguagaggcuuuauuuuauagugauauguuugaaagcuaguaaaaacuuauacuacuuugguuaaguuuuuguguggcauauaaucaucaauagaaacauagaaguaacauuaacugucccauuuuuuuauugucucccugaaauuguaaacuuuauuuaaauaucacccuuggucuguuuugcacugacauuuuacugcuacacuucagggaguucuauccaaccuuucagauuaauauguaugauuauugugaaguuuuucaaaauacuuaauucagauguuuaaaugugcuuauuagugcauguuauuacauuaauuuuuaaaacuauuuucccaugauaaucuuucaaggaaaacacucucagaaguuuccauacugaaaucauaauucuuuguguauguuuguauuagugcuuucuaucuucaaggaauugaugugaagauuuuuuuuuagaauguuuacuuuuaaaaaaccgaauugaugcugcuccccaguuuuauuucucugauuuuuuuaagaacguauuuuucuuacauagcguaguuucaugcaauauaaacuuuugaaaaaaggaaucagagauuuauuauaauauuguuuaggcuuaagauuacauuugcuucugucacgaaaucaguucuuuguucuuuaaauuggggcauagcauuagcaauauguaaaucuucagaugcugcauuuuuuuaaaaaaaacauaguaacuaauuaaauugcuccuuucuuccuucuaugugugauccugauucugcuggacuuucugccgaacuucaugacaccaccacuugggauuuugccaauuuuucuugucacuuauauuuggcguguuccaaauggacuucauauucuauuccuuauugugugguaucauagcacaaugacagauuuccucaaggaccaccaucucagauggguucaccuauggggaguagaacagguucugaaaccccucaagcaccaaugagugguguagguccugugaguggugguccugguggcuuugguagaggaagucaagggggcaacuuugaaggcccuaauaagcgucguagauauuaaacauucguucauuccuggcuaucuagaaaaaaaaaagucagugguaugccuuuauacuuuuaccuguuaucuggaagaaaugguuuuauuguuaauguauguagacuuaaaaguuuuuuuuuuuuuguaaaacuugagguuuuuguauuuuucuuuauucaugagcuuuguagauuagaaugguaaugaugcucaucauuuugaauguugaaauguguuugugacuuuagcuaaauauaaguauuccauaguacugugaaaucuauguaguuaaucucaauaaagaaaucauuuuggauaauuuaa

SEQ ID NO: 192497 - RNA, 26184 nt, Homo sapiens
cgcgaaaagccgggacuggaccucgcggaguugugcuugucgccgaagcggggugggcuuguucguuccgcgcagccgcagccagaaccgggugacgcuuauccccgcugucuuuccaguccagggccgcugagaguggggguggcugggagcagcgcagccuccggaggaggaggcggaggccgaggugaguggggaggcggagaugggugagagcagccuccggaggcucccaccgacccgggauuaauaccccgcggcgcggccgccgucgccguugccgcuucggggccucgagggcagcucggggcugcccuccugucaccggcgcuuuugcguccggccugaggggcugggagagugcgagcgaggccgggaggguugggugaggcggucgccagcggcggaggucgcggggccggcggggaggcgggguggcggggcggguugccggccgcccggggaggucgcggggcauuuuucuuucucuccugccgcauaguggcggggggcggguugggcgagggaggggcgccccggccgggucuucgcugucaggaccgcgcugccacccugccgccggagccgagguccccagguuuuucgggcgagggcuucugccucugccccgcuggguccccuccuucgcucaucuuuucccaggcgcugcgcggcuuuuacucuuugcugcugaucugggcgaguuuaauggcggaucuggggcccugucgucgacugcuggggccccagggcaacuucuugaggcaacugugggcccagaggugaugcgcgccgcccguuaccucugaaauggugcuuggagugacagagaugacgcugggugggcaaauuuaggagggaauacaaaucccuugcuggcgucgagacgacguuuacccuucccucucccguccugggagcaggccucggauccccgagcccacugcauccccaguacugcaguuggacgaagcacuuuuagcuuugucucgucguugcgguuccuauaguucuuuuuuuucaacuuaguuucucgguaacauuagggugggggaggguagcagagcccaggaacuccuuggccucuuaccccuuugccaccucacgguguugaguugguugugcauccagauugguuguaccgaaauugguuuucaauucucauucuaggaccaggaaucaccuucaagccuaugucgugaggcuuuggcagaaauuaagaaggaaauaucuccauugugaguuguuuuuuuuuuuuuaccccgcuuugcugucuaauauaauuagugcaguaguaggguguucuuccugagggauuugccuuuguguuaucuugaaggccuuggccuucaagcuaauugcuugggugccccuguccccagagccaagccaugguagucccugggaaggcacggggagugcugacauuuauaccacuggaacucucucaaguuccagaacaagauuuaaaguuagcucucuuuuaagugccuugaauuuaacaauuuuuucuuuuccaguagauuggaaaaacuuuuuuacuguuggauuaaaaagaaacacuacugaauaaucuguuguuuugacguugauauuugccuuguauuugaggaagacuguuauuuauguacccugacaguccuccagcuagcaucacacgaggagauaacauaaacuaguugucaaacuauuccuaauucuaagauugaccaccgaaucugaguggccugaucucucucuguuaggaaguuaauguuuguuuuuguuuuuucggguuuuuuuuuuuugcuacuagacagugaucuauguguucauuuugguacaguacaaaugcccuuucucugucagcuauucacuuaaugcuuuuaacaccaauccuugugugaauaauuucauuaggagugacaaaaugauuuuuuuuucuuuaacaagcuuuacuucuauuuuuauuaucugggauucaguucuugccaauuuuguccuuucaacccugaucaaacaguuuuccauugcucaucaaaaacaaacuugugauuagcuuaucucccauaguaguauuccugccuuccuuuuacccuaguugcuuucuacuaacuuauuugcucuuauuuucuuacauuucacagcauaucucuuuaauuaguuaaacuuaggacuguggcaggaugugguagguagguaaaguggcugggcacaguggcucaugccugucauccaaccacuuugggaggcugagguggguggauagcuugagagcuugagcccaggaguuccaguguggacaacauggcaaaacucuuucucuacaaaaaauacaaaaauuagcugagcaugguggcacaugccuguagucccagcuacucagaaagcugaggugggaggaucgcuugaguucaggagguugaagcugcagugagcagugaucacaccacuauacuccagccugggcaacaaagagagagucugucucaaaaaaaauggguaaaguggcucugggcacugugacucacuccuguaaucccagcacucugagaggccaagcugggaggauuguuugagcccaggggguugagucugcagugaacuguguuugugccauagcauuccaggcugggcgacagagccauacccugucuuaagaaaaaaaaaaaagccugguccauaagguuugagacacacacacacacacacacacacacacgugcgcauauacaugcauauaguuagugggagauacaauucccccccccccaccugagauauaauccuuauccucuuuauuuuuuccuuuauuucuugagauuuuucucagcuuuaucuuucaauucuuauugcugaauuuuuccuuuuugccacuaagcuuuuaauuuccagcaguucuuuuuauauuagaaguguuggcugggcaugguggcucacaccuguaaucccagcacuuugggaggccgagguggguggaucaccugaggucagaaguucgagacuagccuggucaacauggugaaaccccgucucuacuaaaaauacaaaaaugggcugggcauggugacucacaccuggaaucucaguacuuugggaggccaaggcaggcagaucaccugaggucgagaguucaagaccagccugaccaacauggagaaacccugucacuacaaaaaaaaaaauacacacacacacacacacacacauacacacacacacacacaaaauuagccgggccugguggcacaugccuguaauaccagcuacuugagaggcagagguuauggugagccgagauugugccauugcacuccagucugggcaacaagagcaaaacucugucucaaaaaaaaaaaaaaaaauuaaacgggugugcuggugggugccugucauuccaacuacucaggaggcugagccaggagaaucacuugaacccaggaggcggagguugcagugagccaagaucacaccacugcacuccagccugggcgacagagugagacuccaucuauaauucuuuuuuuuuccucuuuuuuuuuuuuuuuuuuuuuuugagacagucuugcccugucacccaggcuggagugcaauggcgugaucuaggcucacugcaaccucugccuccugggcucaagcgauucuugugccucagccuccugaguagcugagacuauagguacaugccaccacguuggcuaauuguuguauuuuuaguagagacaagggacugaccauguuggccaggcuggucucgaacuccugaccuaagugauccgcccgccuuggccucccaaagugcugggaugauaggcacccacuaccacacccggccuguguaauuaguuuuuuaaaaauuuuuauuuaaaauuuuuguggguacauaguagguguuacauauauugcauaauucuugacuguuuuauuuaugauuaagaauugggaacuaaaggccgggcacaguagcucacaccuguaaucccagcacuuugggaggccaaggugggcagaucaugaggucaggagauugagaccauccuggcuaacacggugaaaccccaucuuuacaaaaaauacaaaaaaaaaaaucagcugggcaugguggcaggugccuguagucccagcuacucaggaggcugaggcaggaggauggcgugaaccugggagguggagcuugcagugagccaagaucgcgccacugcacuccagccugggugacagagcgagacuccgucucaaaaacaaacaaacaaacaaacaaacaaaaaacgggaacuaaaaagcaaauuggaagagugagagugggguuuccaacuugaagcuugcgggugaucuucuggccaauugauggggaaccccauagguuaauauuuuuaggacuuuccuuuuuugcugauucuuaguuccgcagggaagagucuugcucagaaagaaagccuccagaaaagaguuugcugccuggaaaauagaagucuggaugccagcucucugggaaucaaguaggagaggggacauuuuuuuuuuugagauggaguuuugcucuuguugcccaggcuggaaugcaguggcgugaucucggcucacugcaaccucugccuccuggguucaagcaauggagaggagauauuucaugguauugaaacauuccccagugcuuggugaacccaagacuuagaucuuauguucuaucuuaucaaagaaaaaauuuuuagaaucugugcuaggauggggaaaggccugucaccaucaacuugaugggagggaagauaucucucaaccucuuuucuuagcaucugcccauucuguuccagggauauguggugcuacagauuucugagccuacaguggaaaucagaauguuucuuggcuuuuuauucacuguuuuagacucuggcuaucucagguuggcaguuaaccauucauccaucuguucuuuggcuuauaaaaucauauugcuuuuguuucuuauucuuccuuuccuugugguaguccuguuuaggggaguuuuggaagggaacgaaguuaguuguaugugaucaaucggccaucuuuuuuuuuuuuuuuuuuuuuuugaaacagcgucucucagucugucacccaggcuggagugcaguggcccaucucggcucacugcagccucuaucucccaggcucaaacaagcugccugccucaguuucccaaguagcugggaccacaaccaugugccacuaugccuggcuaauuuuuguauuuuuuguagagacaagguuucgccauguugccuaggcuggucuugaacuccuggacucaagcgauccaccugccuaggccucccaaagcgcugggauuacaggggcauuauacugcaccuggcccacuuuacugucuuaaucccugcugggcuagugauuucuaggcagaguuguuuuuucuguuuguuuuuugucuuugugguuuuuuuguuuuuuuuuuuuaauuuuuagagacaggucuaacucuguugcccagacuuuagugcugugguguggucauagcucacugcagcccugaacuccugggcucaagugauucuccugccucagucucccaaguagcuggggauuacaggcgugcaccaccaugcccagcuaauuauuuuauuuuauuauauuuauuuuuuauuuuugagacagggucuugcucuguugcccaggcuggagugcaguggugugaucauggcucacugcaacuuugacccccugggcucaagccauccuuccaccucagccucccaaguagcagcgacuacaggcguaugccaccauguuggacuuuuuaaauuuuuguagagaggggucucucugcauugcccaggcuggucuugaacuccugggcucaagcuauccucccaucuuauucagccucccaaagugcucagauuauaggcaugagccacuguaccuggccuuuauuuuuuuguagagaugaguucucaguuuguugcccaaguuggucuugaacuccuggccucaagugauccuccugccuuggccucccuaaguguuaggauuauaggugugaggcaccaggcccaauuuagauaguaauuuuguaccuaguuccugcaguaauucucuugcuauuugugguaguaguucaguugacucuucuuuuuucugaucucauuacuuuugugaguaccuucagagucaugguacaccuuuauaucugauuuuaaauaggugugcuuauauacucaacugugaagugucucugaaaguagucuacaagaagagcuaaauaggucaaaguacauuuauucauuucuuuguuuuauguuaacccuuaucuuuacaccuaaauaucccguuaaauuuacguuguuucccauucucuagagauaguuuacauguaagcauuuugcuaguguuauaauuuguguaugaauaagauaccacaagaagacuaguuaaauguuuaaaauuagacaguugcugaaaucccagcauguagcaauguagcauaguauuugccuaaauaccuuuuuaugguaagggauuuuuuguuuuuguuuuuguuuuuguuuucguuuugagacggagucucgcucugucgcccaggcuggagugcaguggcgggaucucggcucacugcaagcuccgccucccggguucacgccauucuccugccucagccucccgaguagcugggacuacaggcgcccaccaccacacccggcuaauuuuuuguauuuuuaguagaggcgggguuucacuguguuagccaggcuggucucgaucuccugaccucaugaucugcccgccucugccucccaaagugcugggauuacaggcgugagccacugcgcccggccuuuuuguuuguuuucgagacagagucucauuuuguuacccagguuggagugcaguggcauggucucaacucacugcaacuucuaccucccggguucaagcgauucucuugccucagucuccugaguggcugggacuccaggugcaugccaccacgcgugaaucaauuuuuuuuuuuuuucuucugagacagaguuucgcccuuguugcccaggcuggaguuuaauggcaugaucucaggucaccucaaccucugccucccggguucaggcgauucuccugucucagccuccugaguagcugggauuacgggcaugcaucaccacgcuuggcuaauuuuguauuuuuaguagaggugggguuucuccauguuggucaggcuggucucgaacucccaaccucaggugauccaccugccucagccucccaaagugcugggauuacagacaugagccaucuggccggucauaauuugauguuuuuugcacucucugauauggaccaggccauaugccagggauuugcauguccacucaccucauuaaaaagcuuaaagcuauauguuaucccuguucacaguuuaggaaacuaaaacucaggugacauaauuugcccacugccacauagcuaauuggcuauacagcaucuuuuucucuguuuuuagacaauauuuuagaaauauucaaaauuuucuuauggucuuguguuuuuagaauuaaaguuuuucaugguuaaguuauaaacacaauggcuuuuaguaguuuuguuguuguuguuguuuguuuguuuuuuguuuuuuuuuuguuuuugagauggaaucucgcucugucucccaggcuggagugugcaguggcgccaucucugcucauugcaagcuccgccuccuggguucacaccauucuccugccucagccucccgaguagcugggauuacagguuccugccaccaugcccggcuaauuuuuuuuuguauuuuuuuaguagagauggguuuucaccguguuagccaggauggucucaaucuccugaccucaugauccacccaccuuggccccccaaagugcugggauuacaggcaugagccacugcaccuggccuuuaguaguguuuuaacuuauuuauaaucugggauuuaagcaucagugaauacuuaaucuuuuuuuaaagguagaugacugcagugaacugaguauaaagaguaugcuguguauuauuuucugugagaaaaguaaaauagaaccuagcagacauaagaagauacugugggccgggcgcgguggcucaugccuguaaucccagcacuuugagaggcccaggcggguggaucacaaagucaggagauugagaccauccuggcuaacacggugaaaccccgucucuacuaaaaauacaaaaaauuagccagguguggugacaggcaccuguagucccagcuacuugggaggcugaggaaggagaauggcgugaaccuggcaggcggagcuugcaguaagccuagauugugccacugcacuccagccugggcgacagagcgagacuccaucuuaaaaaaaaaaaagaagauacuguggagucaguuauaacucuuuuccagaaauuauuuuccuuuuuuaucauuauuuuuaaacauuuuuaguagagauggaaucucaccauguugcccaggcuggucucaaacuccugggcucaagcaauucucccacuuggcccccaaaagugcugggauuagcaggcaugagccaacauuccuggcccccaaucuuuuucauuucuuuacaaaccuuauuuuaaacugguuccuuaaauuuguuauuuaucuuugaaacagccuuauguaaauguuaauuuuguuauuguaaugaauuggcucaucuuaauaaaagauaaguaauuuuuaacaauuguuuuccacaugcauugcauauaauauacuggcuaagaaauagguuuuagagucagauuucuuggauuugaauccugacuaccuuuuucagcaauggugaguuaggcagguuacuuaucuccuggcucuuaauuuccuaauuggcaaaaugggaaaaguaauaguuccuuccucacuuaaguaaucauuaacugaguuaauauauauaauagcauaauacauauuaagaauaaauguuaccuauuucaugacuauauggauuauagauuacauugagguuuuuuuuuuuuuuuuuugagacgaagucuuauuguguugcccaggcuagagugcaguggcacaaucucagcucacuguaaccuccucugccucccggguucaagcgauucucuugccucagacuccugaguagcugggauuacaggcgccugccaccacgacugacuaauuuuuguauuuuuaguagagaugggguuucaccacguugaccaggcugaucucaaacuccugaccucaagugaucugcccaccucagccucucaaaguacugggauuacaggugugagccaccacgcccagcagggaaauuuuuagaguaaaaauguuagcauauuuuggccgggcgcaguggcuuacaccucuuaucccagcacuuugggaggccgagguggguggaucacgaggucaagagaucaagaccaugcuggccaacuuggugaaaccccguaucuacuaaaaauacaaaaauuagcugggcaugguggcgcacgccuguacucccagcuacuugggaggcugaggcagaagaaucacuggaacccaggaggcggagguugcagugagccgagguugcaccacugcacucuggccuggcgauagagugagacucugucuccaauaaaaaagcauguuucaauaugagauguuuaaaauaaaauggagugaugacugccuuaugaaguguguuuucuuaaucauucaacaccuguaaaauucccaccccuuucacucucaaguuucuacucagaaaauugaggccagaggccaggccugguagcucacaccuauaaucccaacacuuugggaggcugaggcaggcggaucaucugagcucagaaguucgagaccacccugggcaacauggcgaaacccugucgcuagcaaaaauacaaaaaauaguagccaggcaugcuacucaggaaguuaaagccgggggaucacuugagccugggagguggggguugcagugagcugaaauggcgccacuguaccugagugacagagugagacaggacaaaaaaaaaaaagaaagaaaaaaaaaacugaggccacgccuguugugguggcucauuccuguaaucccagcacuuugaaagguccaggugggagaaucacuugagcucagggguucgagaccagccugggcaacauagugagaccucacaucuacuaaaagaaaaaaaaaauugaaaauugaggccagcauguauaaucccauguauuguuucugcauaccuacauaacauuccaauuauacuuacuuuugccuucuuucaguugagauagaggugauccuuauacgugaucaauuucauuaccaccugugcacauguccuuaucucucaucugcuuaagagccccccauguuucaucaguuauucacuuccagauuuuucaacuauugucucugcuagauuauuucugucaucauagcuuagugcauaguaaguauacaaaagguugaguguuaacaaguuaagaauuuggggcuaggccaaguaccauggcucaugccuguaaucccagcauuuuggggagccaaggcaggaggauugcuugaggccaggaguuugagaugagccugggcaauguagugagaccuccucucuccaagaacuuuauggaacauuagcugggcugugauggcaagagccuguaguccuaccuacuugggaggcugaggugggaggauugcuugaacccaggcauuuaaggcugcagugagccaggauggcacaacugcacuccagccuggacaacagagccagacccucucucaaaagaaaacgaauuuuuagagcccugaguuuaagucuuacucccaguguuauguggaacaauuuaguuagcuucccuaggccucaguuucuugaacuauaagaguaaauuauagcuacuaucauggaguuuugauaauuuuauuuucuguaaaaagcccauugcauaauaucuggcauaaauggacuuaaugcuuucuguacaaggacaaaaaagaugcauaaagauaauuacauaauuauuuuggaagaagugauuuuggaaagaaaacaauggcaggagacacuugggaaauagggccauaucauaaaugcuguaguagguaaaagcauauggaauauaagugauuauauuaggacccuaaguuauugguauuuaauuuaauuauuuuguuacuauuuucuaauucaaaggaaggcaggcauuuuuucacuauaaagagugaauaaagugaguacuauaaauugauuagaauuuuuuaaaggacuaccaaaauuauauaauuaauuuccaucaagcucugaaguaaacauuaguuaacaguagaggaaaaacaaaauggauaucagguaucacaaaaaauaauuugaaaaauuugcuugugcuauuuuauuguaguaaaaugcaaaaaccauaacauacuagaacuuuuuuuuuucuuuucugucucuacagguucauuggcauggaaaaauguucagugggaggauuagaguugacugaacagacuccugcuuuauuagggaauauggccauggcaacuagucucauggacauaggggauucauuuggucauccagcuuguccuuuagucaguagaucuaggaacucaccaguggaagaugaugaugaugaugaugauguuguguuuauugaaucuauacaaccuccuucaauuucugcuccagcaauagcugaucaaagaaacuucauauuugcaucaucaaaaaaugaaaagccucaaggaaauuauucuguaauuccuccuucuucaagagauuuggcaucucagaaaggaaauauaagugagacaauuguuauugaugaugaagaggacauagaaacaaauggaggagcagagaaaaagucuuccuguuuuaucgaauggggacuuccuggaacuaaaaacaaaaccaacgauuuggauuucuccacuuccagucuuucaagaaguaagguaaaugcaggaauggguaauagugguaucacuacagaauugacucugaaauacauuauuacuaauguuacaaccuuagaaacagguauaagcucugugaaugcugggcaagaugugaacauaauuauuacauauaaaacaucacuauagaauaccaacuugggagaugucgcuaaaggacuucagucaaguaauuuugguguuaauauacaaacguacaccccaucuuuaacuccacagaccaagacuggaguaagaccuuuuaacccugguagaaugaauguggcaggagacuuauuucagaauggagaauuugcaacucaucauaguccugguaagcaguaagugauacuguuucuaccucaaguaaauaagccuuuggcuguucuuuuuaguaaagcucauaucuauuuuauucacauucuguggcuuugcuuuuuuuguuugcuuguuuguuuguuuguuuuuggagaccgaguuucgcucuucucacccaggcuggcuggaguacaauggcgcaaucucagcucauugcaaccuccgccucccagguucaagcgauuuuuuuuuuccugccugagccuccugaguagaugggauuacaggcgccugccaccacacucggcuaguuuuuguguuuuuaguagagauaggguuucaccauguugaccaagcugaucucgaacuccuaaccucaagugauccaccugucuuggcuucccaaaguguuggaauuacaggcgugagccaccacucccggccuuugacuuucauauuaagauagaauauuuuacuuaauaaaacuguacggucuacuuggucucugaaauuuugggauuuuaaucuauuuuauccaguaagauuuacaucuaaaauauuuuaauugaaauacuuuaccuucuuuacuuucuuuauauaaaaaucaaaggauaaagauacaguguaaugaaagaacaaaguaauauauaaugauuggauuuuauuuuauuuauaauuauuuaaaauuucaauuuuugcuuaagcuuuuaauuuuaggcuguuuuuaucccugauuuuaguuuuuauuuauuuauuuauuuauuuauuugagacagaguuuugcucuuuuugcccaggcuggagugcaauggcgucaucucggcucacugcagccccucccucccggguucaacugauucuccugccucagccucccagguagcugggauuacaagcacgcccgucuccaugccuggcuaauuuugucuuuuuaguagagacaggguuucuccauguuggccaggcuggucucaaacuccuaaccucaggugaucugcccaccucagccuccccaagugcugggauuacaggugugagccacugcgacuggccugauuuuaguuuuuaaaucggcguuuuauuagucgcuuaauucugaaaguuggaaaacuuucuugccuuuaaaucaaggaacuguauuuuuagaacuuauauagauaguccuauucugauauaauuaaaacauaacaagugauuuuuuaaauagcaaugccuuuuuguugcuuuuaugugacuugugagggguuugggggagaguugguauuguuuuuuugaccauuuuaguguuuauagccuguugaauuuuaggaaaguacugaaaaguaacgagaaccugagaaccuaaucauguuguugccuucaggaaaauagugcuuuuucccuuuuuuuuuuuugagacagagucucugucacccaggcuggaaugcaguggcacgaucucggcucacugcaaccucugccuccuggguucaagugauccccgggccucagccuuccgaguagcugggauugcaggcgugugccaucacgccuagcuaauuuuuuguauucuuaguagagaugggguuucacuauguuggccaggcuggucucaaacuccugaccucaagugauucacccgccucagccucccaaagugcugggauuacaggccugagccaccgcgcccggccaacuuuuuuccuuauuuuuaaaauuaauuuuaucuucugguuacgaaauacuaugugauuauuauagaauauuuagaaaaaaaucauagaaaucagaaaauaugucuccuuaccccaguaacuagaaauaaugugaccacugugaagaauuugguuuguuugcuuucaaucuuugguuuuuaaaaauauaauuuagagcacuuuuuauauuguuuuguauccugcugauuuacuuaaucuaaaugcuaauauuuuaugucaucauaaaaauauaggcugggugcaguggcacaccccuguaaugucaucgcuuugugaggccaaggaagaaggaucacuugaggccaggaguuugaacccagccucaguaacguagcgaagaccucaucucuauaaaaaguaaaaaaaaauuagccaggcgccaugaugugcaccuguaaacucagcacuuaaggaagcugcgaugggucaguugagaccuggaguuuggggucacauugcgcuuuaauccuaccgcugcacuccagccuaggcaacagagugggacucugucucuaaaaauauguauauauaaguuuuaguaaccacaaaauauuugucugaaguacucauuccccuauguauuuuuuucaucauuuacaugcuuuuucauuguuuugaagcuacaauaaauacguauguuuacauuuuuuauuuuuuccauaggguacuuauucucaauuuuuuuggucucagauucacucuuaaaaugaagaccccaaagguuucuuuuauuucuauuauuagauauauuaaaaauuaaagcuuuagccagguauaguggcgugcaccuguagucccagcuauucaagaggcugagguggggcugggcaugguggcuuacaccuguaaucccagcacuuugggaggccaaggcagguggaucacuugaagucaggauuuugagaccacccuggccaacguggugaaaccccaucucuacuaaaaaaauuaaaaaguagccaggcaugguggcauguaccuguagccccaguuacucaggaggcugaggcaggaaaaucacuugaaccugggaggcagagguugcagugagcccagaucacuccacugcacuccagccugggcgacaaagugagacuugucucaaaaaaaaacaaagaggcugaggugggagggucaccugagcccaggaguuugaguccagucugggcaacauagcaagaccuaaugucuuuaaaaaauaauaauaauggauggacguaguagcucacaucuguaauugcagcacuuuucguaggcugaggcaggaggaucacuugagccgaggaguuugaggcuacagugagccaugaucacaacacuacacuccauccuggguaauagagugagacccggucucaaaaaauaauaauuaccugggugugguggcucucaccuguaauccuagcauuuucagaggccaaggcugucggaucaccugaggucaggaguucaagaccagccuggccaacauggugaaaccccgucucuuacaaaaauacaaaaaacaacaaaaaaaaauuagcuggguaugguggcaugcuccugcagucacagcuacuugggaggcugaggcaugagaauugcuugaucucaggaugcugagguugcagugagcugagaucaugccacugcacuccagccugggcgacagaaauuuuuuuguuucaaaaaauaagauaaaaucuuaagaaaaauuaaaacuaguccgggcgcaguggcucacgccuguaaucccagcacuuugggaggccgaggugggcggaucacgaggucaggagaucgagaccauucuggcuaacacagugaaacccgucucuacuaaaaauacaaaaaaaaaaaaaaaaaaaaaaaauuagccgggcaugguggcaggugccuguagucccagcuacucgggaggcugaggcaggagaaugaccugaacccgggagguugcagugagccaagaucacgccacugcacuccagcaugggcgacagagugagacuccaucucacagaaaaaaaaaaaaaagaaaaauuaaaacuauucauuucacaauaauuacccauuauauaacauaaauaacauuuguaaugaaaaauaacuauuuucaaagaaauuuagugaaaaguaacauugucuuacauuuuugcaaaucucuuuaaaaucuggcuuaauagaagacagguauaucuggcuucucauauguauuucuguauugagucuguuguaguauuuuguuuugcuugaaguauaagaagaaaaucuggccucacauagauaggugguuggagaagggaggacuauuuuccacgucuuuuuagauguggauaguuuucuuuugaugcagcaccaaaacuugacaauuaguaguuuucgagguuguuacaaugugggauuuguaaccguauaauuaaguuuucaucaccaggcgcaguggcucaugccuauaaucccagcacuuuuugaggccaaggcaggcggaucacuugaggcugggaguucgagaccagccuggccaacaugacaaaaccccaucucuauuaaaaaugcaaaaaauuagcugggugugguugugcaugccuguaguccuagcuacuggggaggcugagacacaagaaucacuugaaccugggaggccuagguugcagugaguugagaucaugccauugcacuccagccugggcagcagagcgagacugucucaaaaaaauuuuuuucauacuguuuauuuuuaauuuuuuuaugugucagcaucccacucuguuucccagacuagagugcagugccaugaucauagcucacugcagccucaaacuucugggcucaaguuauccucccaccucagccuccuaaguagcugagacuacaagugcaugccauaacacccugcuaguuuuuuuuuuccuuaaaaaaaagggggggacuguauuugguacagacuggucuauuaguuuaaaaucuauugauuuugaauggauuuuuaaccuuuguauuaauaacauugugcauugguuauuuggaaaauauugguucacucagauccuaaauguugacacuuuaggaagcugucaaguucauggugguggauacaggcuuccaaaaauucgccuuuuuuuuuuggcuagugacacagcccucaggagguccugagaacaugugccccaaguuuucaaaaauucugauuuuucacuugaaagcucauauuuucucaucagcaacaaauacucuguuuucuugaagugaugaacucuuuugaguuauuuuuaagaaaaugucuccaauagucauaguuugucauuuuuuucaaguaaaaaugguauuccaugaaaaauggcuaguucagcuuauaguccagcaacugugcaagcacuuuucugcuuuucaguaagauaaccuuuguacuuugguaugaaacaaauacuuuaugcauacuacccaguuugucauacagaaaauuaagaugucaaaggcuaaacuuuaaugaaauuauuaauaacuuuuacuguuucaccaaagacaucuguaguaaaaauuauuuuugucccugguuccuggaagagagacucuaaauccuuaaaauuuccaaguaucuuuguuauauucauaagcuccuuggaucauaccugaauuuacgccaagagaugagaugacucacaguggagucuaaacaccagaaagaugaacuauaggauugaaacuugggucuuugagccagcccaaagucugggagaggaggggaucuggagcugaguucagucauaugaccaaugagucaugccuacguaaugaaacccaaauaaaacuacucuagauuuugaagcucagugcagccuuuugguuggugaacacaucagugugccaggcaggugaugcuacugcuuccacugaaagcuggcccagaaauucugcauuugggacccucccagaccuugccuuaugagcuucuucauuuggcuguuucugauuuguauccuuuguuuaaaaaaacaacaaacaacuaaauguaaauauagagcuuuuccagaguucugugagucuuucuaacaaauuauccaaccuugggagccccucccagauuuguggccaguugauuagaagugcagcugguaucugaagugagggcagucuugcugagaaccaggccuuuaaacuuguggggucucaugcuaacucugaguacauuagcaucagaauuguuuuccauauauaccaguugguguuaggauaacauucauaagugaaggugaccaaaugcauacuagugaaaacugcuaguacgguuuagugccauugccagagguuuugcauuuccaucauuaaugcaaaugccacauaauacaaaaagcaauaaaucuugguauuacuauggaaauaguugacuucacacauucccuuuuguuucuuuuucuaauacaaggcugaauacaaguagacuauaaaaccuuauuuuguucuugaccucagggaagcauuggacauaucauuauauuauuagaucauauuaaauauaauuaucuguuaauguuuauaugucauuuaguaguuuguuauuugggguaguuucuacuguuugcaauuacaaacuguuucucauaaacaucucuaaguuuggcacccuuauuuucuugaaaaguuuuuagaaguagauuugcauucaagaugucaacauauuuuuaaagcaugugaugguuaauacaaaauucccccaccaccaaauuguguuacuuuucuugcagcauaagaguuucagcggggugcgauggcugacgccuauaaucccagcacuuugggaggccgaagcggguggaucacuugaggucaggaguuucagaccagccuggccaacaugaugaaaccccgucucugcuaaaaauauaaaaaauuugcuuggcguggugacggccaccuguaaucccagcugcucaggagacugaagcaggaggguugcuugaacccuggaggcagagauugcagugagccgauauugcgccacugcacuccagccuggcaacaagagcgaaacuccaucucaaaaagaaagaguucuuuuucuguacuguaaacacuccuuaacaguagguguuauuacuuaaagcuugcuaaacugaaaggugguaucaucauaauuugcaugucauugaccauugacaaauauauuugaaauuuuuaaugaauuuucucaaauucacaucugucacccauuuauuacuauguacaugucuuauuaauaguuaaaccugagacaacauagaacucuugcaaucucuagguuguguuaaaagcaaugaaggugucaaagacuuugaaauaauguccauugaaaaucauccuuuugagucuacuuuuacuuauuuauuuuuugaaacaaggucuggcucuuucgcucaggcuggagugcaguggcacauucucggcucacugcaaccuccaccucccgggcucaagccauccacccaccuuagccucccaaguagcuaggauuacagguaugcauaccaccacaccuagcuaauuuuuuuuuuuuuuuuuuuuugagacggagucucacucugucacccaggcuggagugcaguggggcgaucucggcucacugaaagcucugccucccggguucaugccauucuccugccucagccucccgaauagcugggacuacaggcgccugccaccacguccaccuaaauuuuuaaguauuuuuuggaagagacaggguuucaccauguuauagccaggaugguccgauccccugaccuugugauccaccugccucagccucccaaagugcugggauuacaggcgugagccaccgcaccuggcccccuuuuuuuuuuuuuugagacagagucucacucugucacccaggacggagugcaauagcgcaaucucagcucacuacaaccuccgccucccagguucaagccguucucccaccucagccucccuaguagcugggauuacaggcgugugccacugugcccagcuaauuuuuguauuuuuuguagagacaggguuucuccauguugcccggacuggucucgaacuugugagcucaagccauccaccugcuuuggccucccaagugcugggauuauaggcaugagccaccacacugugccuguuuauuucuuucacucuuuauuuguuuuauaauacuuucuuacauuuuagauauuuauugcuuguuuuagaugucauucauguuuauauaagcaugaauuccaucuuauauaaauaaaagcucuuucauggaaacuagaagccuugcuauauauucuuuuuuuuuuuuuuuuuuuuuuuuuuugcuggagugcaguggcgcaaucucggcucacugcaaccucuaccucugcucuaccucuaccccgucucugcuaaaaauacaaaaauuagcugggcaugguggcgcaugccuguaaucccagcuacuugggagacugaggcacgagaaucacuucaaccugggagguggagguugcagugagccaagaucacacuccagccucggugacggagugagacucuaucucaaaaaagaaaaaaaaaaacuguuaaaucugcuggaugcaguggcucacgccuguaauugcagcacuuugggaggccgaugcaggaggauugcuugaucccagaaauuugagaccagacugggcaacauagcgaaacuccauguccauguaaaaaaacuuuuuuuuuuuuuuuuuuuuuuuuuugagauggaguuuggcucuugucucccaggccggagugcaguggcaugauguuggcucacugcaaccucugccucccagauucaagcgauucugcugccucagccucccgaguagcugggauuacaggcaccugccaccaugcccagcuaauuuuuguacuuuuaguagagaugggguuucgccauguuggccaggcuggccucgaacuccugaccucaggugaucugccugccuuggccucccaaaguguugggauuacaggugugagccacugcgcccagccaagaaaccuuuuuuuuuuuuuuaauuaaaaaaaaaaagcuuaagucaucugucaaaaggauagucuuuuuguaguuguugcuauuuuuacucuuuaacuugacauagcauagauaaaagaaguccguuuuuaguauuaaccuuaaauuuucuuuuuacuugcugucagcauuaguacaacaaauuagguuuuaccaggaagcuuuaagaauaagaugacauugauuauauuauuauguuguuguuugaagucaaaguuccuccagaauguguuacuuuaguugcuguguauuucccauguagauaaauugaagguuuuguaguacaagagaaaaaacgggcaaggauuucuggaguugaauuguauuuaaauuuaggucuuauggguuuaaauuucaucauauaaaacuggcucuugacagcccccugcgggaaagggucuggccagcccaugggguagguggguugguggaaggaagcuggcagcaccaaaaggaaaaccaauacaacuggcucuucauaaaguacacguaaaacugcauuccguuuuaugaaaauaggauuggccaggcgcaguggcucaugccuguaaucccagcacuuuggaaggccaaggcgagcagaucacgaggucaggagaucgagaccauccuggcuaacauggugaaaccccaucucuacuaaaaauacaaaaauuagcugggcgugguggugggcgccuguauucccagcuacucaggaggcugacgcaggagaauggugcaaacccaggaggcagagcuugcagugagcugagaucacgccccugcacuccagccugggcagcagagcaagacucugucucaaaaaagaaaaaaaaaauaggauuauauuuguuagaaaggaccauuuaauucuuucuuuaacuuuuaggguacacuauguuucagugaaaguucuccaguucccacauacuuuuguauaaacaguacaaaaaaaaaaaagcucaugagagaaaauaccuaaauuuagaauuugcucuuacaucuuuuguauuuuuguugcauuauaaacauuucugaccaugauacugacucuagggaguuucauuucugauaccuagguaacuccuaucccucuugcugagaauaauuagggaaaaaaugacaaaauguauaaaguaucagacaucaagagcuacaaauaacaaauggaaaaacuaagguuccaagaucugagagaagaauuggggcuguuuuucccuauugaauauguguucaauuccagaaaaggcugcagagaagcuaaauggaguuuucaguagacacugaggaccugcaaagaggaguacugauaaaaacccccuuccaaccuauggauuaaaaugcuaacaucauccagagccucacagauuguuguaauuuuucauauaaaaauaggucaggcccaguggcucacgccuguaaucccagcacuuuggaggcugaggcgggcagaucacgaggucaggaguucaagaccagccugaccaacauggugaaaccccaucucuacuaaaaauacaaaaauuagccaggugugguggcgugcuccuguaaucccagcuacuugggagccugaggcaaggagaaucccuugaaccugggaggcggagguugcagugagcgugccagugcaagacucugucucaaaaaaaaaaaaaaaaguaaaaaguggccaggugggccgggcgcgguggcucaggccuguaaucccagcacuuuggggggccaaggcggguggaucaugaggucaggagaucaagaccauccuggcuaauacggugaaaccccgucucuacuaaaaauacaaaaaauuagccgggcaugguggcgggugcuuguagucccagcuacucaggaggcuugagguaggagaauggcaugaacccaggagguggagcuugcagugagccgagaucgcaccacugcacuccagccugggcgacagagcgagacuccgucucaaaaaauuaaaaaaaaaaaguggccagguguggugguucaugccuauaauuuuagcacuuugggagagcgaggcaggaagaucgcuugaguccaggaguucaagaucagccugggcaacauagugagaccuugccucuacaaaaaauaaaaaaauuagccaggugugauggcaugugccuguugucccagcuacucaagaagcugagaugggaggaucgcuugagcccaggaguucaaggcugcaguaagcugugaucaugccacugcacuucagacugggcaacagagugagaagcugggacugcaagcgagcgccaccacacccagcuaauuuuauuuuuuguagagaugggguuuugccuuguuaccuaggcugguuucaaacucacuggcuuccagugucccaaagugcuggaauuacaggcaugagccauugcacccugccuaggcugagucuuaaaccucuggccucaagugauccucccgccuuagccucccaaagugcugggauuauaggcaugagccaccucaccuguccaaaagcuguuuuugaagauagauuacaaaauaauucuuuaucauagaaccuuguuucucaaagcuucaccaucaucugagaguugguuagaaaugcagaguaucagauuucuucucagaccuacuaauuuagaaucuccauuuaaacaagauucccaagugauuuaauaugcacaauaaaguuugagaaggaucucgccuauaaguaauacuguaccuuuugaagcuaacaguaauuuaugauacugcaguugcuauguaagguuaggaaagcugaguuuuuccugaguaauccacaaucuauauuaaugccugauaaguaauauuuuagaaggcugggaaauaauaauagauuuauauuaaacuacugcgucuaaaguauuuugaaaguaaguguacuaaugucuacaauuuacuugaaauacauagaaagagauggauugauuguuuagugguaugaguagacagaaagaugugauuaggcugggagugguggcucacgccuguaaugccagcacuuugggaggcugaggcagguggauuacuugaggccaggaguccgugaccagccuggccaacauagugaaacacccucucuacuaaaaauagaaaaaaaaauuuagcuggguaaucccagcuacucgggaggcugaggcaggaaaaucgcuugaaccuggggggcagagguagcagugaaccgagauugugccauugcacuccggucugggagaaagagcgagauucugucucaaaaaaaaaaaaaguagcuaauauuuuuugagugugccugugugccaggcauuacuuuuaugucauguguucuucauagcacucugaugaguuagguaucaucaauuaguauauuuguauaauauuacauucaggagaucuuugaaccuggagucugacuuaagagccgauggcuaccacauuacacaauuccagacgccaacauuuacuuuauuauuauuguuggcacaguggaguaucauucacuugagauacaaaguggauagucccccugggauugugcaucaagaguguuuggccuuaaccacauguuuauacgccugccccacuugucucuuaaacucuuaaaugaaaaugcaaguuauuuuucugauguacauuuugauuuguuccaugauuuuuuucuuguuucauuuuuaagauucuuggaucucccagucagcuucauuucccaguaaucagaaacagccagggguggauucuuuaucaccaguggccuuacuucguaagcagaauuuccagccuacagcccaacaacaacuuacuaaaccagcuaaaaucacuugugcaaauugcaaaaagccuuuacagaagggacagacagcuuaucaacgaaaaggaucagcucaccucuuuugcucuaccaccugccuuucuuccuucucucauaaacguacucaaaacacacgaagcauaauauguaaaaaguaagcaguaccuuucaacauuucuccacauaguugaauacuaaugguauaaauaaguacucaauauaacugcagagcuggauagauuuauggguagaauuguugcaggagugucuucaaguuuauugagcuugagcuccuagaauauauccaagcuguggacucguaugugcuguauuuacucucggcagaaaaauggaacauagguuuggaaaucaauugccccucucccugcuacuacauuugccuccccugcucccccaucuuaacaccuuaguucuaugaauuuauuaccagcauuuugguuuguugguuuguuuuugagacggagucucacucuguugcccaggcuggagugcaguggcacgauuuccacucacugcaacuuccaccucccagguucaagcgauucuccugccucagccucccgaguagcugggauuacaggugcgcgccaccacgcccagcuaauuuuuuguauuuuuaguagagacaggguuucaucauuuuggccaggcuggucucgaacuccugaccucaagugaucugcccacuucagccucccaaagugcuggaauuacaggugugagcuacugugcccagccuauuaccagcauuuuugaaugcaucuaaaaaucuuaaaaacuuguggcaagguucuugugcuacgaaagauuuuuaucucugacucuucucuuucuguaucauuuaagaacucuuggcaauaaagccaaaaguggauuugcugcaucuaaaaguuauacuugauuucuaguauuaaaucauaagaaaaugaaaaauggcaauuauuauuaauauauuugacuuguauuaaaauucaguguucuuaaauuaugugucuaucccuucuguuucagagaugcaucuacaaagaaggcuaaugucauucuuccaguagaaucaagcaaauccuuccaagaauuuuauaguacaucuuguuugucucccugugaaaacaacuggaaucuuaaaaaaggaguuuuuaauaagucaagauguacaauuuguaguaaauuagcagaggucuggauuuuuauaccuaaguuguuguuuaggcuaacagugauaauuuuaacuuuuaagugcuauuauguacucuuucaucuacauaaugcacguguucuggauguauaacaugaagcugaaaggaagaauaaggauauguuagaacuaucuuaugggauauuuuauaaauaaaauuccauuugcauagcauggaaaguaca

SEQ ID NO: 192498 - RNA, 2849 nt, Homo sapiens
uugacuauuuuuauuauauucugaaagcgaacaucuucaacugguaaauuacaugguauauuaaauuauuuucaaaaaagauauuuuuauuuauauuauuauauguauuuuuugagauggugucucacucccgucaugcaggcuggagagcaguggcacgaucucagcucacugcaaccuccaccaccuggguucaagcaauucuccuuccucagccuucccaguagcuaggauuacaggcaugcaugaccaagccuggcuaaauuuuuuuugcugauuuuuauauuuuuaguagagaugggguuucaccauauuggccaggcuggucucgaacuccugaccuugugauccgcccaccuuggccucccaaagugcugggauuacaggcguaagccaccacgcccggcuaauuuuuguauuuuuaguagagaugggguuucgccauguuggccaggcuggucuggaacuccugaucucaggugauccuucugccuaagccucccaaagugaugggauuacagaagugagccaccgugugggccucagccauacaacuuugacaaaguucuuugugugucuucccagucaauagugguuucuccuuuauuccuguucccacagacgcaauucugauuuuuuuccccaccuaaauuuucuuuuucugucgcccaggcuagagugcagugacacaaucucgacuuacugcagccuccaccuccugggugcaagcgauucuccugccucagccuccugaguagcugggauuacaggccucaccacugcacccggcuaauuuuauguauuuucaguggagacaggguuucaccauguugguugggcuggucuugaacuccuggccucaagugaucugcccgccucagccucccaaagugcugggauuacaggcgugagccaucccgccuggccauauauuauuguuauuuuagauagggucucgcuauguugcccaagcuggacucaagcaauauuccugaauagcugggacuacaugcaagcaccacagcacccugccaaaauagcuaaaaaauacaccuuccuguaacagcucugauaaauaucuuuuacuucguuuauuuuucuuuuuugagaugcagucucccaggcuggagugcagcggcaugcucucggcucacugcaaccuccgcuucauugcaaccucugccucugagguucaggcgauccucccaccucagcgucccaaguagcugggauugcaagccugcaccaacauacccagcuaauuuuuuuuguauuaguagagacggguuuuaucaccuuggccaagcuggucuugaacuccugaccucaagugauccgcccgccuuggacuccuaaaguguugggauuacaggcgugagccaccgcacccggccucuuuuacuucgcuuaaauguccaauuuuaguaguaaaaucccggaaaauguuuuuaggaguauguuuaacugaaaagcucauauuuucuuucauuuuugggcaauucuuaagguaagcaaacuaauguugcaugauaaagcccccaucaaguaucucauacuuaagcaaagaccucaaaucauuguggcuuuauugcagcuuuccuucaaaauaucaucugugacugaggaaaucccuaucuuccuaucagacuaaugaaaccacaggacagcaauuagacuuuuaaguauuggggguuuagagcucuagauauucgauaugcagacuacucauguuuguuuguuuuaauaaagacugguccaaaggcucauuuucacacaagcuacaguuuuucaguuccaggaccagguaaagauggucagcuccgugauccauaaaauccaagggugacgacucaggauuaggaccauuucuuggugacauugagauggucgagcugguccgcaaugaaucuaugcggggggaacuuggaaguggcggccgccuuuauggccucgaaggccucccuccugcgcaccgcggcguggccgcgcuccugcucccgggucauguagggcaugcucagccaguaaugguucuccgccucgaucuccaggcggcggaucauguucugcuuggcgcgcaacgacacgaaccgcggccgccggugcuucccgauccacugacggccgggaaugcggccgcgccagaggagcgcagucaggaacauggugccugcggaagagagggacgggcuuugcggaggcgaacuggcgcggccggaccuggagagagcagcgggcgcgcgcuccagcucacgccuacgggaguucccgcaccgccuccccuccagagaagcggggagcccagguaaggccagcaggcgaagaaggagcucccuagagaaccgaauucgcacagcuacucaccugccgcgcugcucaagacucugcgucuccgcggccgccagcagacgccguggcguaagcgcacccgucucgcggggucuccuggggccucggcgagagacuucggcucucgcgagagaggacugcgccugcgcagagccgaggacgcguccggcgccgagauucaaacuaguggcgggaggcugugagcugagcgguggggucugcguacgccuggaguccuuccccgcugugcucagcauggacccuauccggagcuucugcgggaagcugcggucucuggccagcacgcuggacugcgagacggcccggcugcagcgagcgcuggacggagaggaaagcggugcgugaggcgggcggccagggcacggugcguggggugcgccgcgggcggaggggcguggcgaguggacgguaugucccacgggaaccgccaggcacugacggcguggacggcugccaccgaggcgcagggcgggugcugc

SEQ ID NO: 192499 - RNA, 5574 nt, Homo sapiens
cacccaagucugaguugcuaaaaaauggagcugucacugggccuugcucugccaggaccugcagagccggggaccucucuguggcaagcccagcaagaugacugcucugaggcgcccuagggcugagggaggggccgugacaccagccccgccccccagccaccugggaaaaggaagcacaaaaaggagaagcagcaacggcugcucugcuuccuucccaucucgcucuugggucaugccuggccagcagaaagcagcuccauaggggaggagagccacgcaggaucucacagcugcagucuaauaguaacacagagguaauuuuaacuuuuuacuuuucuacccuugggaguagggaugaguagaggcuuaccuccuuccagaggcagcucauauccccccacccccauucccggaaguugagaugucucuucucuguuccacgcaggcaucgucuaaguugggaacaggucuuaugucuuaaaauuugggauucuuuaaaaacauauguggcugggcacaguggcucacgccuguaaucccagcacuuugggaggccgggcagguggauaauuugaggucaggaguucaauaccagccaggccaacauggugaaaccucgucucuaauauaaauacaaaaaguagcugggugguaguaguagcuguaaucccagguacucgggaggcugaggcaggagaaucccuugaaccuaggaggcggagguugcagggaggcagagguugugaugagccaagauugcaccacugcacuccagucugggugacacagugagacccugucucaaaacaacaacaaaaaugugugauggcacaugcccauagucccagcuacuggggaggcugaggugggaggauggcuugagccugggaagucgaggcugcagugagcugugaucaugccacugcaguccagccugggcgacagagugagacccugucucaaaacaaaacaaaacaaaacaaaacaaaaaaacccaaaaacaaacaaaaaagcacauguggaguguuguagaagucauugaccuugguaagacaguggaggaaacugcuuugcucugacucauaaauuugcccccaguaaacaguauuuauaaauagccccagucaggcacugcaugaagacauuucagucaacgacagaccacauauacaacgguggucccauaagauuauaacagagcugaaaaauuccuauuuuucagcuuaguguuguggugcaaccacuaccuuuucuauguuuagauacacgaauacuuagcacuguguuacaauagccuacaguacccauuacaggaaugcuguaccgguguguagcccaggagcaaugggccauaccauauagccuagguguggaguagacuagaccauccacguuuguguaauuacaaucuaugauuuuguaaaaugaugaaauugccuaaugaagcauuucucagaauguguccccgucauuaagugacaccucacuguguuuccaagacauaguacugguccuugggaagcucuaaagagaggucaccgugagcugaaccauccuucucacucugugcauggaacccagcuuagcuuccauuucagcauuuaggcuuauaggaggagaagagguuagaagccacagaccagcaagaauugaagacaucguucuguaauuucuacugaaccagcucugucugacuggaacuucauuuugccucuuugcuuuaacuccucaggaaugucuuccaggaggccccugaucuucucugcucagggaccacucuuaucugacccagagacagguuagcugauggugacucacacauccucacuuccuucaaagcccaggcaucuguuuaaaaucugacccugugaagacuuuuccuguuuuggaaaaacucuuccguuguuugccugcacagauuugugcuccauuuuuaauuucaauuuuuguagagaaggcggguccuugcuuuguugccucggcuuguuugaaacuccugggcucaagugauccuccugccuuggccucccacagugcugggauuacaggugugagccacugcaccaggauggauuugucuuccuucagaagacaguagcugaugugugcccuggccuuucuccccuaggauucagcaguggccaccauggguucugugaauuccagaggucacaaggcggaagcccagguggugaugaugggccuggacucggcgggcaagaccacgcuccuuuacaagcugaagggccaccagcugguggagacccugcccacuguugguuucaacguggagccucugaaagcuccugggcacgugucacugacucucugggacguuggggggcaggccccgcucagagccagcuggaaggacuaucuggaaggcacagauauccucguguacgugcuggacagcacagaugaagcccgcuuacccgagucggcggcugagcucacagaaguccugaacgaccccaacauggcuggcguccccuucuuggugcuggccaacaagcaggaggcaccugaugcacuuccgcugcuuaagaucagaaacaggcugagucuagagagauuccaggaccacugcugggagcuccggggcugcagugcccucacuggggaggggcugcccgaggcccugcagagccuguggagccuccugaaaucucgcagcugcaugugucugcaggcgagagcccauggggcugagcgcggagacagcaagagaucuugauccagacagagcagcauaucuuugcucauacaaacuagaagaaccagcugauccuugagaaauuuacgcuuagucuaucaaacaagaaaugcuggcuuggcccgguggcucaugccuguaaucccagcacugugggagaccacggugggggaaucccuugagcccaggaguuggagagcaacaucacaacaccccauuucuacuaauaaucaaaaaauuggccgggcaugguggcaugugccuguagucccagcuacuugggaggcugaggcaggagaaucgcuugagcccaagagguagagguugcagugagccaagaucgcgccacugcacuccagucugggcaacagagugagacccugucucaauaauaauaauaauaauaaugaugauacucuaagaaaaaaaucucaacauacuucauuuaauagcucguuaccaagugugaaugaagcaauaugucauaauagaguagccacugguugcauaauaauagagaccuaaauucucaaauagggaaagagguuuuaaaaucaaauuugaggccaggugcaguggcucaugggcggaggagggcagauuacuugaggcuaggaguucaagaccagccuggccaacauggugaaaccccaucucuacugaaaauacaaaaauuaggcauaguggugcacgccugcagucccagcuacucaggagguugaggcagaagaaucgcuugaacccaggaaguggagguugcagugagccgagauugugcugcugcacuccagccugggugaaaaagacaggcugugucuccaaaaagaaaaaaaaaagucaaauucaaauaucaucuggacaugucacaauggaucgcggauccuuaugagugauuuuccccaguggccccuggggaugugccacugucacucagaagggcaagcuaggcagggcccauacaacagcaggggucugcagguuagacguucccugcccugggacgcucaccccugggcaagaggcuggaaguucacaccauccaaaauuuauccuuguuuuuuuucugaugcuaauuagccucucccgauuuuaugacaucuuguguugaucuuuuucaaaaacucauuuucuuuuuuuuccuucucuuuucuccuucuuguagcacauaucuuucguuaaagaucagaucaauaaaauauuuuauuuauucauuaauuuaacaaaaaaaacagagcauuuaguuuguggcaaaaacacugagcuuucgaauaugaaucaugugcuuuaggugggaauugugaauucugaagauacagaugacagugacgaaugccuucugucucaugauugacagggaaaaggaagguugaccauagcauccuagaaggcucaucaggugaucauuaccuagcauccaugaagcaccugaaauuauuugcaaaauguuacgcuuuggaccauuuuuccggggaaggagauccagaacuuuuuaccagauuuucaaagacaucugugacucccaaaaguuaacaaucacugaugugguuguuguaucccucauccaaccccagaacacuuucuguaaucugaguuuuuuaauggcaaguggccuauauuuagcaccuguucucauguuaaacagcucugaauguuagauauucuuucuuauccuggacugguucucucuaucucuggaguaaugcaguauaaauuggccaucaguacccuccuaaaaucugagaucugccaggccccucuucuaacaccagguuaggcaugcuugguuauuuccaguacuugucagucaacauguuucaagacgcuguguuagacacuagggaugcaaagaugaaugagauaaggccucaggccucauggaaggugagacaguaaagacauuacucccauaaaaaugugaggagagagacucaguucagcaacuguuuauucuguuuauugagcacuuacuuggaccaagcacuguggucuugguguuuuacauagacugucucuaauucucacaacucugcaaaauauauauauucccauuuuauaaaacuacaaacugaggcucagagaaggugugaccucuuguugcuugaggcacagaguuauaaaguaacauaucuggaauuugaaaucagaucuguuuagggcuaaugcugcauuuuucuacaacaucaugccucuagaagguuuaagcuagguaggcuuucagccagcagacaugauggggagagccuucuaauaagagggaagagacugcuuggaagcaugaagggagguguaagaaagauaaguaagucaguguacuugcaacagaggcuugggaugaagggugggugaaguugacaucacgauagaaaacaaaacuggaaugggaguuuagguccaauuugggcaagguuguuugaauuucaauaaucagggguuugggucaaggaagaaaaaucaugggacuugccauuuaggaggauaauuuugugguaguguggaggugaaauaaagagaaaagggaaccuuggagcugggaaggcaggaaaccggcuagaugaccaucacacagcaaaggagggaguggaagagagaugagaaaauugagagcuauuauuaagaaaaacaguugagagaggaagaauuugaagagggcucaagauuuugaguccacaugacagaaggacuggaaugccaugaacuggagaaggugagcgcugaagaaccaggaugggacggggcuggaacagcuggguucagcuuuugcaggguggguacguguuugguuauagcugcuuucagauuguuccauuaucuguacucccaacaacccugccggauauauuuguuggcuuucacuc

SEQ ID NO: 192500 - RNA, 30814 nt, Homo sapiens
cguuucucucccugcuuuccucugccgcaugguccugggccguuggcgucggaagccugaagcaugggcgcugagugggagcugggggccgaggcuggcgguucgcugcugcugugcgccgcgcugcuggcggcgggcugcgcccugggccugcgccugggccgcgggcagggggcggcggaccgcggggcgcucaucuggcucugcuacgacgcgcuggugcacuucgcgcugguaagugccaucgccuagacccugcacuccccaucccagagagugggagcgggggcggcaaggcggggugaggggguccugcggcuuuuugcagcgagcuggccgccccucccccugcugcaggaagucuguuagcugagaggcgccuggaggccgcggcggccggaguucugauucccaggucugugaacagagcgcagcuuaccuugugcugccgauuccuccaccaaacuuuaaaaaaauucuguacgugcuauguuaguuuagaagauaccucagcuuccucggcuuuguaaccugcacguaacuguugaacuggacauaauugagaguagaauugaggucauuuuuaaaugccccagagggggcaaggagagaugcuugcuccggaggcagcaaggcuauugucgcaaaacccgaagccuuugccaagacaaacgaaacacccgugucuaaugugugccaggcgcauuacugaguuuaaaauuucagaucuuuacagcauccauaaauuaguuauuauuguuccccauuuuacagaggugaagguaggcgcugcaaaauuaggugacuuuccagugccacacagcuggcaugauucugaggcagucuagucuggcucccaaguuugcacucuguguaucagucgaggucuuaggaaauauguguccuuagagauucaacccauuuuauaaaauagccaggaagguuguguuuaaggcauuuauauugaaaugccccgccccccaccacacacgcgcacgcacacacacacacacacuuuuaaguuuuuuuuaaacuaugcccaaguaucaguuuguuuuuuuuuuuuuuuguaaaguugaccuuguuuaacucuagacacaccuguggcuaaugugaagccaaagucaguaguauugagaaagcaagccgaguuuuggguaaucaucgaguucuguaaauguuuacggguuggcuuugugcccaugacugauguugcuggaauucuuuuuauucugauaaucaacauguagagauaagggacagugaauguuucucucaacuccuuuauuuauagaauucuuuuuuuuuuuuuuugucuuuuuuuuuguuguuguucuugagacagagucuaacacuguugcccaggcuggaguguaguggcacuaucucggcucacugcaaccuccgccccuuggguuaaagcuauucuccugccucagccucccgaguagcugggauuacgggcgcccgucaccacgcccagcuaauuuuuguguuuuuaguagagaugagguuucacuauguuggccagacuggucucaaaccccuaacaucagaugaucugcccaccuuggccucccaaagugcugggaugacaggcgugagccaccgccaccgccaccagccgagaauugauuuuuaagcuaucacuugaacacaagguuucccacagaacaagggagauaaagcagauugcuaggcccgguuagaaaaaauguauaacaaaauguauaacauaacaaaaauguugcuaggcccagugagagaaaacuguguaacauauuggcuggguauaacuguauauagcauaucagaauguauauauauaaaaauguauaacauaucggacacaguggcucaugccuguaaucccagcauuuugggaggcugaggcggguggaucacgaggucaggaguucaagaccagccuggccaacauggugaaaccccgucuguacuaaauauacaaaaauuagccagguguggugacggugcccauaaucucagcuacccggguggcugaggcaggagaauugcuugaaccuggaagguggagguuguagugagccaugaucaagccacugcacuccagccugggcaacagagcaagacucuaucuugggaaaaaaaagaaaaauguuuaacauaccuuagacaaacaaaaagcuguaaaaauacuuaaacuauaugcguguguucaccacuugguuuaagacuguuuacuuuucaagcucagguuguuacagguaacacgacacacaccuccuuuugugccauuaccuaccccagcugcaaaguaguccacugugugaauacaccauaccuuaguucuccaagucuaagacccacauuuuuucacauauuagaagaaucaacuacaucauguaacuacuguaggccauuugauugauauuuuaaugucucuaaauugggauguaucuuauauuugaugaauacgaucacuuaaccagcccauauuaguggacacauuuuucugucauuacaaacaaugcaucuaccaacgucuuuguacaugugucucagagaucaguggggagagcacuugaauuaagcaguugaggcugcaagaaaauacaugcccauguugucuuugcuugggaguuuauugcaagaauacccagaagugugggacaagcuaagacuaagauguagagcuuaggggagaaccaaaauuaaaacucacuuguucacuagaagaugaguugccucuccuuaacccgacacuucuuuuuuuuuuuuuuuuuuuuugagacggagucucgcucuauuacccagacuggagugcaguggcgcaaucucggcucgcugcaagcuccgccucucggguucacgccauucuccugccucagccuccugaguagcugggacuacaggcacccgccaccacgcccggcuaauuuuuuguauuuuuuguagagacgggguuucaccauauuagccaggauggucucgaucuccugaccucgugaucuaccugccucggccuuccaaagugcugggauuacaggcgugagccacugcgccuggccacccccugacacuucuuaaagagaggagcucuguagguuuuuuggcugccaucaaauugaaagcuauccuguuggacaguuucaagccaagcauucccaggggcaguucauuucccagauguccaaccagagugcagucaccuugggccccagcacuggucaucaguucagcucguuaugacuacagcagagggcaggcugacuucccaucagccuaccuggaaggagccauggcaacauacuagaagaaggaaaugguggggucaccauucugaggucgcugugggcagccuaggcacuggugcuucauggauaaaauuuuaucucuucugcaaucuauguauagcauucaggcauggccagaaacaugaggcaagauaugaaugccuguguauggaacacauccuguaguccagauugacaggagcacaggguuuacauaagaagugggaggaccagcuggaaaggugacagguaagaauuguauucuguagugagaagccacugaaggauuucaagcagggaagucacguggccaaagcagaucuucauaaagauaauuuaguggugauguguuaagucagaaacucuagcguccgagauuuuacccaacuuagaaguuaacaagguaguccaguuugauuccccaaggcccaaaccccacaggacaacauaaugaaggccagauguuacugccuguacaugcagugggaugcguuacaagaaaggaacuccagaacuacgcguccaucuuauugugagcuggugguggccuguccauacuucucucuggagagaccuuaucuuaggaauguaaaccucugaggaggagaaggugaggucuugaucuuuaccacccuagaaccucucuggagggagcugucucccagguuuacuacucuggaaaggcucauuauagaaacauucuuaaaauugauauaaaugucuuugcucagagacccagacagugcaggaugugagauauucauggagaauugucucucaacauggugcagguuggauuggaaaggauggaguugaggggcaagaagagcaacaaaaagcaacugcuguaguguggggagucauuuaaaaaaaagagagaggcaagcugaggugguguuggaacuuaaaauggggaggaaagcuaacugugagagacuuuccaggggagaaugugguaagucaaaguggccacuuguagauuggggguggacaugaucuuggggcuuaggcccugagcaacauggguaauggugaucauguuaacuaagacagcaaaaucuggcuuuagaacuaugagucggggguccucgugugcaguuaagagagaauagugcugggcaguggcucacaccuguaauaagcacuuugggaggccgaggcaggauugcuugaggcuaggaguugcgagaccagccuugcuaacauagugaggccuugcuaacauagugaagccucaucucuacgaaaaauuagcuggguguggugcugcaugccugugaucccagcuacucagaaggcugaaguaggaggaucacuugaacccaggagauugaggcugcagugagauaugauuacgccacugcacuccagccuaggugacagagugagaccccaucucaaaaagaagagagagagaauggccagaaggcaauugaaaaauguaaauugaguuggagagacagagucagggcagaagagagagugcugggaauucuuuucugaguugggggagauagcacgaagccccagguaugacugcuuuugcugagcuagagagaacagaagggugaaagagcugaggaauaagagcagaaucuuuuaaaauaucuauccuaggagagagugggaaagaccacgaaccaggagagugcugggguccugggauccacagaauggaauuucaagaacacugauaaauugcuguagcaccauuaaaaaaaaagaaagaaaauaaaaggugaggcaccuggcaaccaggaagucaauggugagagugggauugaugggagggaggcuccagaagccaaaggcuuauaggccagguagaggagaagcugggcaguagaugaaagcccugcaggagguuugguggugggcggaggaagagcaggaggguagcuccagaggcaccucagggcaggcugggggcucuugguucuuuugaagaugaaggucugggcgagaggauggccgaagaaggguaaaagugcagacgcggcaggcagcucucgcugucugaugugugcuuggccauggagguugaccuguuuccuaauaaaccucugccugguuguugcuuccacacuuuugucaugguguagucugauuagccuuguccugcagggugaagcacagcugucacagaaaaccugggccuuggcuggcucuccaugcaucccaccuaacaccugugaaugguuuuucguugagaaaucuugaggcccaguggcugugccacgcccucucugaagcugggcauuacccuucuccaguucacaucaccgucuguuccucacugcccacugccacaauuccagucucuaauucuugucccuuuuuuuuuuuuucucucucucucucgcccaggcuggagugcaguagcgugaucuuggcucacugcaaccucugccucccagauucaagcaauucuucugcuucagccucccgaguagcugguacuacaggcacgugccaccaugcccagcuaauuuuuguauuuuuaguagagacacgguuucaccauguuggucaggcugguuucgaacuccugaccucgugauccgccugucucagccucccaaagugcugagauuacaggcgugagccaccaugaccagcugccuucaguuuucuugaaggaggacugcuuugcuguuuuggugcuaggcuuugggacgagauucuggggcguagaucuugggauccuccuucuauagccuguuuuucaauggggauguuugucuuuuccuuaaugaucuauaaaagguguucauauauuaguacaaacaauuucacccacacuuuauuacgcuuuuggggagaaagggcaagaaaguguugucagccccauuuauugacuaauccauucuuuccccacuuauuugagaugccagcuuuaucauauacuaaaguauuuuauauguauggauauguuuggggauuuuugaauuuaguucuguuucaggaaucuuuugguuccaguucuagccacuguuuuaauaauuucagcacuauaauguaguucaauaucugauaaagcaaacuucuccccacuauucuuuuucaaacacuuuaaaauuaugaucuauccuuccagauguacuuuuaaauucacuuugcugaccaggugcguacaaaaauuagccaggcgugguagcaugcaccugcagucccagcuauucaggaggcugaggcaggagaaucguuugagccccggaggcagaguuugcagugagcugagaucacaccacugcacuccagccugggcgacagagcaagauccugucucaaaaauaaaaaauaauuucacuuugccaaguucuaauacucgguauuuugauugugguuuucuuaacuuuauagauuaguuugagauuaaaugauaucuuuauaauacagucugccuucuaagaacuggguaggucucaauuuguuuaaaucuucuguuacagucucuuaaaguuuauuucaaaacauuuuauauuuucauugcuacuguauuucuccuuuguauuuuguuuaauuuaauuuuauuuuuugagacagucucacucuguucgcccaggcuggagugcaguggcgcgaucucagcucgccacagccucugccuccuggguucaagcaguucuccugccucagccucccaaauagcugggaugacaggcacgugccaccgugcucagcuauuuuuaguguguguuucuaguagagaugggguuucaccauguugcccaggcuggucucaaacuccuggccucaagugauccagcugccucggccucccggagugcugggauuacaggcaugagccacuacgccuggccucucuccuuuguauuuggacugauuauuguuauuauagugaaagcuguugagauauaccuauauuuguaugguuaucagccacuuuucuaaauuccccuuuuccucccuccagcuuuauuguuauaauuuauguauaauaaaacccauucuguguacaguuuggugaauuugggugauuguguagaguuguguaaccacccuugcaaucguaguauagaacguuuccaucacgcuucuaguaaaaguuuucucaugucccuuugaagaugaucccagugcccaucaccagccccaacaaacacccgucugccuucugucuuuaaaguuuugcuguccuauaauuucauaaaaaugaaaucauacauacauagucuucauuuaacguaaguugcugaguaguauuccagucauggauguauuucaauucauuuauccauuuaucaguuaaugaacaaauggguuauuccuaguuuuuuacuauuacaaauaaugcugcuaauagauaucugcauccaagucugugugggcauauuuuucuuucuccuaggccgaggccuuggaaugggauucuuucaguuuaguagaaacugccauccugcuuuccacggcggcuguacuguugugcauucccacuagcauugugugcgaguuccuguugccccacagccucaccaaaacuuagcauuuuuguguuuuuuacuuuuguuuuuagucauucugauagauguauaugacuaaaacuugucacccucauacaugccacagguugcauuuucaaaugcaguaccagaucgggugcaguggcucaggcuuguuuuuuguuuuuguuuuuguuuuuuuuguuuguuuguuuguuuuugagacagagucucgcucucugguccaggcuggagugcaguggugcgaucggcucacugcaagcuccgccucccggguucacaccauucuccugccucagccucccaaguagcugggacuauacaggugccugcccccaugcccagcuaauuuuuuuuguauuuuuaguagagacgagguuucaccguguuagccagggauggucuccaucuccugaccucaugaucugcccgccucggccucccaaggugcugggauuacaggcgugagcucaggcuuguaaucucagcacuuugggaggcugaggcgggcggaucaccugagguugggaguucgagaccagccuggccaacaugaugaaaccccgucucuacuaaaaaugcaaaaaauuagccaggcguggcagugcacaccuguaaucccagcuacuugggaggcugaggcgugagaauagcuugaaccugggagguggagguugcagugagccaagauggcgccacugcacuccagccugggugacagagggagacucuagcucaauaaauucauggaugaaugaaugaaagaaugaaugcaguaucaguuccuaaacacgguucuagguggagucugaccaucauccaaggagccuggggcggugggggaagguggaaagaacaagggccuuugggaugcagcagaugcacccuugaaugccagcuuucccgaugaccagcucagaaacuugggcaugccccuuuccccugcaaauccuuucuguaaugaggaggaaaagaaggaaggaaauuuucuuaguuuucuuaccugugaaguauggaaauaauguuuucuucaaacggcugugagaauuaaauaaagccuuauaacuuagcguagugcuucucaagcuuggccaugcacacaaaucauccagggaucauccaagauucuguauugguaaccagcucccaagugagugccaggcugugguucaugaaccguguuugaauggcaaagauguaaggcaccuggcacuugccagaguucaguaaauguaauucucuucucuguccucuuagugugaauccuccuugccauauuccauacccggauuagcauuugucaucccaucccuguauacuaaagugaugauguauauguccaauuaagaugagccuuggaagguuuccuuucacaucuuuaaucugagaaguaacaaccuucuggcagagaaggguauauucuuaaaaagggagaaauaugauucaaguccuaaaucaaacaguauacugccauguuguaggaaccauagaacucgugugacuguuugauccugguaguucugaaagagaccaguguggucuccugugaauguuaggugacaacuggcugcugggcagguucaaucaaguggaaaucaucgucuaauuaagcgggcagcagcugggcagcauacauuuauggagucauuaaagccuugucaccaaaggacaguaggaggcugccgcagcugaucccuccagaaacaauguuguaugcuguugucaugacaugcaaaaauccagucugauuaggcugagguuuugugagucagauuugcaaaugcuaauaaauguugacaggauuuauguacugauucuauuccugcuccacuucauucucucacucuugaaagugaauguugccauguuuucucuaggucuucauucaaacauacaacaaaaaaacagauacauucaaauauaaacucagccucaguauguguucuuuuuauuucuuuaaggacuuuuucugcuaaauuuuucuuuaaggauuaaaaugaguaaauugagcaugcucuuuaaauuggauauuaucaauggaaauagcuggcauaacuuaaucauuuguuugaucugagcuuugacuuauagcugucuuuaagucuauaaaauacguuguuaaaacccuuauaugccugggcugggugugguggcucacgccuguaaucccugcauuuugggaggcugaggugagcagaucaccugaggucaggaguucaagaccagccuggccaacauggugaaaaccugucucuacuaaaaauaccaaaauuagccaggcgugguggcgugugccuguaaucucagcuacucaggaggcugaggcagaagaauugcuugaaccugggaggcagagguuguagugagccgagaucgcaccacugcauuccagccugagcgacagagcgagaccaucuuaaaaaaagaaaaaaauuucaugccugggacaucuuaagagaaaaaugagacuggccuuucuuuauuugcuauaauacauuuuaauuuuuaagcugauuuuguuagcagcucaauuaaauauaguucaguuauauuuuauaacauauguccaguaggaacuuuacuguauuuuuuaaaccaaauuuuuugauauacagaacuuaaauaaguauuaugaaauuuuccucaucacccucuggguuaauaauagaaaaauucauagcagggagaaaauauuuuaaauauuuauaacugcuuauuaauauaaaccugaaaaauucuugaaggcuaccauggaacuuaacaguggucaucucugggaaacgugauugggagucaggagggagagaggcuuuuauccuuugcuuuguaccuuuuuauaauuuuuuuuuaacuuuaacauguaucacauauauuuuuuuuguuuguuuuguauuuuguuuuguuuuuugagacggaaucucgcucugucaccaggcuggagugcaauggcacaaucuuggcacacugcaaccuccgccucccugguucaagcaauucuccugccucagccuccugaguagcugggacuacagucgcgugccaccacgcgcagcuaauuuuuguauuuuuaguagaguggggguuucaccaugauggccaggauggucucgaucuccugacauugugaucuguccaccucggccucccaaagugcugggauuacaggcauaagccuauguaucuuuuuaaaauuaaguuuuacagugaacaauuucaaacauucacaaauguagagagacuaguacaguaucagugagcagauucagcauuuucaaguuuugcugcacuugcccaucugucacuuuuucuucuguuuuuguccuucucucccucccuuuuucauuguuacugcugaaguacuggaaagugaucuggaccucaugucacuuuacguuuauguacugaguaagucugucucuaaaaagucaggucuucuucagggacaggugccugccuuucauguuaucauagaaaugacaguacaggaguccucgaagaccucaucauguccagucagggaucuacccugguggucgcugugagcuugacuucccuguggcucgugggucuuggcagguguagaacucauggcucaugcccacuggaagugcuggugcugaagcaggccccucccaccaaccuggcccucugcugacagacacuaccugggccuccgcuuaggguccucaccauccucucaguaagcaacaugcaucuuccaagugcugugcucaaggcuggaaauuggugagcgacucugucaaaagguggagaugcagauccagccugccucuccuuauuacuuauucauucacuagacauauauugacuaauauauauauauagcuugacucuauuuuuuucuugguuaggaaauuuaagcccggagaggugaaaguagccaugaaugucagaaauacaaucucggccaggcaugguggcucacaccuguaauccuggcacuuugggaagcugagggaggaggcgcuugagccaaggaguucuagaccaaccucaaccacauaacgagaccccgucucuacaauuaaaaaaagaaaaaucagccuggcaugauggugcacaccuauggucccagcuacuuuggaggcugagacaggaggauugcuugaacccaggagucugagaggcugcagugagccgugauaacaccacuggauuccagccugggugacagaacaagaaaaaaagaaagaaauacaaucuguuguacuugcuuuugcucaagcuuaaccauaucacgccugacaccuaguggagcccugccuucccaauuacagcaacauccugcauguggcccuuugcuguugaccaggcaccuuucaucugauccuuagauccucagugcuuguugagcucaaacaugaaucuuaguuccagauggcuggaucucuaucauacguugugguuaaagacuuuggagcugauaaccuuccauguuuauuugguuauuuaacauaaacuucaugccccagagucuaaaaacaauuuuaagggagaagaaagaaaguacuguacaguucauuuaauauaaagcaugaauucacaggaggaacuauaacugucuccauucucuacaauuccacagauaauuuuggugccuggcaaauaguaaguaguguuuucaguggcuuugaucuucggucuuugugugguuagagcagauuuuauucaaaagccccugaauagucuuuuuuuuuuuuuagacggagucucacucugucacccaggcacagacacacacgaucuugacucacugcaaccuccgccugccagguucaggcgauucuugugccucagccuccugaguagcugggaauacaggcgcgugccacccaugccugacuaauuuuuauuuuuuuguauuuuuuaauauugagaggugacaacgugcuaacaggccucacucgcucucggugccuccucagccucggcauccacucuggccaugcuugaggagcccuucagcccgcggcugcacugugggagccccucucugggcuggccgcggccagagcggcucccuuugcuuguggagagguguggagggagaggcgccggcgagaacccgggcugcgcacggcgcucccgggcagaguucugggugggcgcuggcuuggugggugcugccggccccaguuaaggaggggcuuagcacccgggccagcagcuguggagggugagcuggguuccccaucacugcuggcccguccgcgcugcgcucgaauucucgccgggccugagccgcuuccccacggggcagggcucggaacuugcagcccgccaugcccgagccggcaccacccccgcuccugaagggcacugcccccugcuccgcagcgaccuguccgauugaccgcccaagggcugaggagugccggcgcgcggcgcaggacuggcggguagcucugcccacggcccuggugcgggauccacuaggggaagccagcugggcuucugaguccaguggggacuuggagaacuguugugucuagcuaaaggauuguaaauguacuaaucagcauucugugucuagcucaagguucguaaacgcaccaaacagcacccugucaaaacggaccaaucagcucucuguaaaauggaccaaucagcaggauguggguggggucagauaagggaauaaaagcaggcugcccaagccagccccggcaaccggcuuggguccccuuccacgcuguggagucuuuguucuuuagcucuuugcaauaaauuuugcugcugcucagucuuuggguccgcauugccuuugugagcuguaacacugcgaaggucugcagcuucacuccugaggccagugagaccacgaacccaccagaaggagcaaacuucugacacaccaucuuuaagaacuaacacucaccgcgaggguccacggcuucauucuugaagucauugagaccaagaacccaccaauuccagacacaauauuuguauuuuguguuuuuaguagagaaggaguuucacuguuggccaggcugaucuugaacuccugaccucaggugaucugcuugccccagccucccaaagugcugggauuacaggcgugagccaucacguccagcccuuacaaucuuuaaaaccauaauagcaggucucauucugaagcuggggccucugccucccacaccuaguuuguuuguuuuugcauggcgucuuuauugaugagaaucagcuguggauggugcagccuaaaguggugggccuguguuugcugauuuauauuugugaguucuguuaggguaagagccagccagucucagaaucacagaauguucagagaugucacuuggaacucugauauuggcaggcucaccuccuuuucaccaugugcuuuuucugacuuugaucugaaugaccuuccuggggugggaugcagcaggauugacgugggcugcagugggaguggacaagugugaugauacagggaagggauaccagcucuuagcauuguuucagggaagaaucagggaguugcuacugguguauuaccuacuucaugaagaaaagacaaguguuuguuggucuauuuggcuuccuuuuuacauaaaacacaagggcaguguccucauguagaaccacugccccuucccggaaaaggaugaccugcuauuuagacagugccagugcacacugacccaccagaccugcccaugucugcaaugguccuauuuuuuaaaucaaacgagagcauuuuuuuaauauacugaauguuucaacaaaggacuuuugcaagucacaccucuggacccaugucaucucugcuaucacuaaaaaaaaauuaggaaggacuaaggaauuagguggcccggcuaauaccacaugauucagggauagcuguggaaagucuggagaaucagccugggauuaucuauaaaaucucacuguauguguauuugguguuuauugcauguaaucaaccuugccccgcccuuaaggagcuuuaauaguagggaaagcagagagggaaacaaaucauugucaugcagucuggugagugauaagacuguccaggccuagagguggcaccgaggaaggaaggauucaccgggguuucuuucuuauuuauuuauuuauuuauuuauuuauuuuauuuuuuuugagacauagucuugcucugucgcccaggcuggagugcagugguaugaucugggcucacuggaagcuccgccucccggguucacaccauucuccugccucagccuccccagcagcugggacuacaggugcccgccaccacgcccggcuaauuuuuuuguauuuuuaguagagacgggguuucgccguguuaaccaggauggucucgaucuccugaccuugugguccguccgccucagccucccaaagugcugggauuacaggcgugagccacugcacccggccucacuaggguuuuaaagaccgaagaggagguuaccaggcagcaggggaggggggcucaagauucacugcagaccccuugcccucaugaugagugggcagaucuuguucucagauucuuaugaaaauggccccugcucugcuuuaccaaaugcuuugagaauuauugguucaucuugcccauggggcagucuagcccagugguuucaaauuccaagugaugauaucuccauuuuaaaacuuacauucuuaacaauuaaaaaaaaccucaaagguaggcaaaggauuugaauagaaauuccuccaaagagcucaauauguacaugaaaauauguucagcaucacuagucagucauuaggggaaaugcaaaucaaaaccacagugagauacuccuucacacccguuaggaugaguacuauuaaaaaaaaaaaaacaauaacaacaaaggaaaauaacaaguguuggccaagaauguggagaaguuugaacuguggugcacuguuggugggaaugcaaaauggugccagcgcugcagaaagcagugugggaacuccucagaaagcugaacauuuaucuuaagauccagcaauuccacuucuacauauacacccaaaggaauugaaaccaggcacuccaacagauccuugcaaaccaguguucauagcagcagacuuaugagccacaauaaccccaaaauggaaacaacauaaauguccaccagcaaaugaauaaacaaaaugcagugccugcauacaguggaauauuauucagccuuaaaaagaaacgaaauucugacacaugcuacaacauggaugaaccuagaagacacuaugcuaagugaaauaacccagacaugaaaggacaaauacagucaucacugcauaaggacauuucagucaauaagggacugaauauaccaugguugucccauaagauuaugauggagcugaaaaauuccuauugucuagagacaucauagcugucauaauguuguagugcagugcauuaccuuuucuguguuuaggugcacaaauaccauuguguuauaauuuccuacaguauucaguacaguaaugccguacagguuuguaacgcaggagcaaaaggcuauccauauagccuacgugugagguaaguguuacacaaccuagguuugugugaauacacucuaugauguccacacaaugacaaaacugucuaaugaugcauuucucagagcguaucaccguugugaggcuuagcaugacuggucucauuucacuuacacgagguaccuaaaauacauucauagaugcacaaaauagagugcuggguguugggcugagagagggaagaaauggagaaucaguguuuagugggcacauuguuuuaguuuuagaagaugaagaguucuggaaauggaugguggcgaugguugcacacauuguuaauguacacaguaccccugagcacuacuguuugugccacagggcugagcagggcaaaagcuggacccacgggccucacaccauccucugggcuccaucccuguccuccuaccucucagccugccucccucugaaauuuuuccucacugccucagcuacagcucccucaucuuccuccauccuuuauugaauuggaagucauuguuauccaacuagacaauaagcucucugaggccagagccuggccuauucuaaauuuuuuuuuuuaaguccugacaguugccaaaaaaaaaaaaagcccauucauuuagucaugguacucuuucucccaugucuuucucuguuucuuuaauuaacuuuuuauuuugagguaauuguagauucacauacaguuguaagaaauaauacagaggucccuuguuuacuuuucccagguuuccacgaugcuaacauuuugguggguuuuuaaaaaauuauuuucagccaggugcaguggcucacacuuguaaucccagcacuuugggaggccaaggcagguggaucaccugaggucaggaguucaagaccagccuggccaacauggcgaaaccccaucucuacuaaaaauacaaaaaauuagccaggcaugguggcgggcaccuguaaccccagcuacuugggaggcugaggcaggagaauugcuugaacccaggaggcggagguugaaugagccaaggucgcaccacugcacuccugccuggggagcaagacucugucuaaaaaaagaaaaaguuauuuucuauuuugauaauuuugguaccaaaaauuuuguaaaacuauaguauaauauaaccaucauauggacauugauacaguccacugaucuuuuucagacugucaguuucuuugugugguguguguguguguguguguguguguguguauuaaguuccauauaauuguaucaacuggguagauucauauaucaaccacaacagcccagguauugaauaguuccagcacuaacaaggaucccuaguguuuuccuuuuauaacuacacauccccccaccccacaccuccaucccuuaaccccuggcaaccacuaacaauguccuccauuucuaaaaucuaucauuucagaaaaauguuauauaaauguaaccacaggguuggccaugguggcucaagccuguaaucccagcacuuggggaggcugaggcgaguggaucgcuugaggucaggaguucgagaccagccuggccaacauggugaaaccccaucucuacuaaaaauacaaaaauuaggugggcgugguggugcauuccuguaaucccagcuacuugggaggcuaaggcaagagaaucccuuaacaugggagguggagguugcagugagccaagaucgagccacugcacuccugccugggcaacagagugaaacugugucucaaaaaauaaauacagaaauaaaaauaaauguaaccauuauguaagcuuuugggauuggcuuuuugaaggacaucaguuuuuaguuaccacaaauaaagcugcuaugaacauucguguaguuguuuuuguauaaagaugauaaguuuuuauuuuucugggagaaauacccaacuguggaauugcugggucguauggucauugcauauuuaguuuuagaagaaacugccaaacucugguuuuuuuuaguggcuguaucgcuucuaucccuucagaaaucuguguuuguuucaguuuuuccacauccucaccaguauucgauguugccaguauuuuuuuauguugccacuauuuuuuauuuuagccuuucuuuuccuuuccuuuccuuuucuuucuuuuugagacacaguuucacucugucgccaagguuggagugcaguggcacaaucacggcucacugcaaucucugccucccgguucaagcgauucuccugccucagccuccuaaguagccgggacuccaggcacacaccaccacacccggcuaauuguuuuguauuauuaguagaggugggguuucaccauguuggccaggcuggucucaaacuccugaccucgugauucgcccgcccaggccucccaaagugcugggauuacaggcgugaaccaccacacccaaccuuauuuuagccauucugauaguuuauacagucauaccucacuguggcuugaagguguguuuccuugguggcuaaugagguugaacaucuuuccaugugcuuauuugccaucuuuauguacuuuccggugagaugucuauucauuucuuuugcccaucuucuaaccagauuauuauuauuguuauuauuauuuuuaacugucuuguuuucuauuaucccuuuuauuucuuacucuuuuaggaaacgcuuauuagcauguucuauguguuagccauuugcaauacagagauaaaagagaaagaauuggcccucagagaacuggcaguuuugggaagagacaagugagcaaguuucuguguaggagggcacugaccucccagcaggagaauaguaaaaucuugcuuccuggaggaggugacaccugaucagcauuugaaggcaugaauauucguuacacuugauauguauuauacuaucuuuacauuuaggacauuaauacaguaagagauagggcagucuaaaagccucuucagggcauccuucuuuauaaguaauuuguuguaugaacuuaauucaagguuagcaaacacggaacacaaaugucauguuucuuggggauucuaagguagagaugacaguauuccagaucccaaugaugugugauccaaugggagcuggggguccauagcgagcagauagcugcugguuacagaaacaaacuuagccacaugggagauuuaggagagugagauauuaauucucacuaggaggucaaagaagguuucuugaagaaggggguuagggcugggauuugaaaaaugaguagagcuucaacaaguagauguaaaaggaaacggauuuguuauagacucauagguuccugcauguuacugauuuccaguuccccaucuugcucuuacccagaguugcuucuguggaaaggucugcaaccuggugucagacuccacaucuuacuaauggguccagugaaagaggucgccaguggagguugcauuucguuuuaggaugagauuuacaaucuauaggaaggaaguccuucaucuuacagauagauggccugaggccuagagagggucaaauccaguccagccccauugccccacuggccagcccaguggaugugcuuuguguagaaaguucucaggccagagcaaggaagugguauggauuucacccuauggcucugcuaaaaauaaaaaauuggcugguaaaaauaaaguguugcaaaguaaguggacuggggaguacuuauuuguuaaaaacacagcuauuuuucucauaugauuuuuuuaauguccuuuaagggauaugauuuuuggagccuggcacggugacucacaccuguaaucccagcacuuugggaggccgagguggggaaaucacuugaggccaggaguuuaagaccagccuggcccacauggugaaaucccaucucuacuaaaaauaacaaaaauuagcugaauguggugucacacgccuguggucccagcuacuugagagucugaggcacuggaaucgcuugaacccgggaggcguagguugcagugagcugagguugcaccaccacacuccagccuaucuucagcuucagagugagacuaucucagaaaaagaaaacaaaggauacuucauuugcagcauuauccuuaaaugacacaggagucaggauacgggaucccuaaggaaagaaauuguggcccauuacagugaacgcuguuuccauaaucacaacauuguaaaugcuguuaauuggcuuuuucagcuuuuagaauccaguuacagauaaaacagggaaaacaaauauguuuagagaacaagaaaggacauguaaucagucucaacaaugcacaagcaaacuggacagaaauugagaguugggaacagggugcggggagccugguagaggcugucauacucuuucgugguuuagaagcccagagacugcacaaaauugaugagugagugagcugagguuuucaguuuuuuuacuuaaguuacaaauuuguguaaguaauagaauaauauaucagaaacucgaaggacuggaaacgggagaggaaggaguaucaaucaaacaauagcuuuuccugcuaguagucgaaggaaauagcaguguaaguauauuaugaaaucaccgcgggaacugcaaagagaugugauugagaguggugaccucugggguggcaggacccaguuuuaaugucauacaaaugauuguuuaaaaggaaugagaaaaaaguuuuauugaccagcagcaaaauuuguucaaaggagcaacaugacaauuacauaucccaguggcuucuagcuguuuaguuuuagaaaucuuaggcaaagaagcacuucagugaugggaaaauacuaacuguaauugcagauauuuuauuaccugaauguuaaauguagccuguaacuguuuuaaaucuuccuaaacuugcccuuauauaggagaaggggggaggauugcucaaugcugguauaaacuugauugccuuucucuuuaagaucuuagauuuuuuugaguuaaaaaaaagugaacuucugugggguucuccgcaaagacuuaagaucccuggaauaaucuagagcuuacucuauuuaauacaguaguuaaacucuuaugcaaaaauuucacuuuuuccacauaagaacacaucucugcuuuuacagugccaaucauugaaaaacaacauuaauuguacauuagggugagacauacccauuuccaagguccagguaaccaggucccaagauuguaucccacaagguuguauggauguuuccaggcuguggccaggaugugagccauggagaagggugggggauggagccaggcaaugccaugugucuacagugccauccugugguugugaugcuguauuagagcaugucuucauuuucuccucucuaggaaggcccuuuugucuacuugucuuuaguaggaaacguugcaaauuccgauggcuugauugcuucuuuauguaaguaauuaaaaacguuugcguuugaaauguuggaggagguuuauugcaagugugacugucaaacgccucuauuauauacuguaugacuucauuuauaugaaauguccagaauaggugagucuguagagauacuguagauuacugguugcgugggaaugaggguagggguggggguguuggggggaaaugaggagugacugcuaaugggcacggauuucuuuuugggguaaugaaauguucuaaaauuagauuguggugauucaaaccugugauucuacuaaaaccaauuauuuaaauagguagauuguguggcaugugaauuacaucuuaauaaagcuauuauauuaaacaauauuugagccugggcaacauagcaagacccuaucuuuaaaaaaaguuuuuuaaaugagccaggugugguggugcacaccuguagucccagcuacucaggaggcugaggcgggagaaucuuuugagcccaggaguucaaggcugcauugagucacaguugcaccacugcacuccagcccgggcgacagagcaagaguccaucucuaaaaaacaauacauaaaauaaaaaauguugguagugaauggccgggcaugguggcucacgccuguaaucccagcacuuugggaggcugaggcagguagaucaccaggucaggagauggagacuauccuggcuaacacggugaaauccugucugugcuaaaaauauaaaaaauuggcugggcgugguggcgggccccuguagucccagguacuugggaggcugaggcaagagaauggcgugaacccaggagguggagcuugcagugagccgagaucacgccacugcacuccagucugggugacagagcaagacucccucucaaaaaaaaaaaaaaaauguugguagugagugcagauggaagagcuugugggguuuaaacugggugguuuucccauacuuuuaauaucaacuuucuuuuuauuguacauauauauuuguggucuuguagauccuuuccaaaagucuucaugcucauugucagucaauauucaauuagcauugauauucuaccauguacugugucaauaccaacagguauuuuuuuuuaccacuuuauaaaacugccuuucucaggauaacugcuuucagguuuugcuucugaaacuuugcaucauuuaucucauuucuuuuuuuucuuuuuuuuuucaggcgagucucgcucugucccccaggcuggagcacaguggcaccaucucggcucacugcaagcuccgccucccagguucacgccauucuccugccucagccucccgaguagcugggacuacaggcgcccgccaccacgccuagcuaauuuuuuuguauuuuuaguagagacgggguuucaccauguuagccaggauggucucgaucuccugaccucgugaucugcccaccucggccucccaaagugcugggguuauaggcaugagccaccgcgccuggcccauauaucucauuucuuugugacucuaaaaucaucuccagcuaggaucugugugggggacuccuguuuaccacuaguguuaggaaacaucuagagaauugaguaggcucauuaguacuucccaaaggaaaaggugucaucuuugaugccucaaguccuagccaaggaguuugagcccccuugaccagaguagagccacuucagauccagggcucagcugaaugcagcuaugcacuuuugauuggcugcauuaaacucugccuggggauugcuggugaagcccagaggcugacggaccccagccugagucauggcuccucccugcugaguguccucuucuccccuuugccagaugccaugcugacaccuccuccccuggcugcccugccuggcaugagagaaagcaaacagcccagauuuggcucaaucccaugaaaugcaaaugucuaacacaggcuuucucuaucaucuucacguuuacauuaugcaccuuaaagaagugaaaacuagcugggugcaguggcacgagccuggagccccagcuacuugggaggcugaggcaggaggauuauuugagcccaggaguuugaauuuagccagggcaacacaguaagaccguauuucuaaaaaccaaaacgcaguaaaaacucauuuauugaagguguccuuuauuuucaugaaaguaaaaauccaguagauaauguaaagcaaguaguacuucccagacuccaaagugccccagaucaccugggaaucuuacucaaaugcagauucugauaccgugugucuagggcaggaccuucugaugaugaccuguguucugaccuuggcuucacugggaugcagggccagccauaaaccucaugaauacucagcaucuccuggucuccacugucugguugaggacacaacaauggcucugguugaggaaaucuaccccgacccuuaguuugcaucuuuuccuuguaaaccucaccuaaguccaguuaucagucacagaaucaauggaaaugaucacaucgucaggcuuuuuaaugcuccuguuugccuuuuuauuguuucaguguuuaauaagcaaagagaugguuaaaguuuagcaguagaggagaugccagagggacugccagagggagaugccacagggagaugcgcugggacugguggauuccagggccccuuacuauccguccccuaccuuccucucacgcauuaaccuucccccaccaucagcucugcuaaacugucuguagauucagacacgcuaccucucagcuccaggccuuugcacaugcuccucccugaaacacccuuauuuuccacucagaucuggagucaucucuugugguauaaggccugaaauuaggauucaguauuaugucugccuuuuuuuuuuuucuuuuuuuuuuaacagagucucgcucugucucccaggcuggagugcaguggcgcaaugucaguucacugcaaccucugccucccaguucaagugaugcucuugccucagccucccaaguagcuggaacuacaggugugcgccaccacgcccagcuaauuuuuguuuuuuuuuuuuuuuuuuuuuuugagacggagucucacucuuucgcccaagcuggacugcaguggugcuaucccggcucacugcaagcuccgccucuuggguucaugccauucuccugccucagccucccgaguagcugggauuacaggcgcccaccaccacgccuggcuaauuuuuuguauuuuuaguagagacaggguuucaccauguuagccaagcuggucucaaacuccugaccucaacugauccacccgccucggccucucaaaaugcugggauuacaggugugagccacccucccuggcugggauucaguauuaugucugcuuugauaccugguaagauccaggggggccucagauggccaaacugcaagucucccuccccacucugcuuccacauauaagguucccuaaccagauagcucucccuaucaaggggagcaggcacagauuuggaggggacaaaugcuuguccccucaguagcaggcuucaguucccaccagucugccuguggaauuauccagacaagccaaucacauccucuguggggaaccagggcucaucccacccccuccucuuguuacugcaaagccugccugcguggccccugcccgaacacuguucccaggugcaaccccuauguggcccugcauggcgagauguccuccuuucccgggccacagugugugcaacuaauaaaccuccuccaucucaucugcccagugucgggucuuguguguucagccaucaccauagcccucaggcagaaguccaucccucaccaacagggaagagaggcagugaucaaaacaccuccuccaggaagucuucccugaaguucguagucuggcuucagugccacuucuucccugcccucauauucgcuaaccgccacuuacugccugguuuucagccucacuaggaugugggccacuaagggccaacaugguccuacuugcagcugcauuaucagggccuaccauaacaccuuccaaaugcuuaaaaaaaaaaaaaaagacuuguugaaggcuggacacgguggcccacgccuguaaucccagcauuuugggaagccaaaacagauggaucacuugagguuaaguuugagaccagccuugccaacauugugaaacccugucucuaccaaaaauacaaaaauuaggccaggugcagugacucaagccuguaaucccagcacuuuaggaggccaaagcagguggaucaccugaggucaggaguucaagaccagccugaccaacauggugaaaccccaucucuauuaaaaauacaaaauuagccgggcaugguggugagugccuauaauccuagcuacuugggaggcugaggcaggagaauugcuugaacacgggaggcggagguugcagcgagccaagaucuggccauugcacuccagccugggugacaaagugagacuccgucucagucagucaguauuagcugagugugguggugggugccuguagucccagcuauuugggaggcugaggcuggagaaucacuugaaccugggaggcagagguugcagugagccgagaucaugccauugcacuccaggcuggguaacagugagacuccuucucaaaaaaaaaaaaaaaaagacuuggucaauaucucuuuuuguuccuaaagaacugacauuuuacuuaggugauauuuuauuagauuuuaggugcacuaacugguacauuucaccuauuguauguauauuuaaauuuagaggagaaacguuucaauaugacauuguuuuccaguuaguuauuggagggcacaggagacugcagacagucagcuaaggacaggcugaugacucucgguggccucucacagaacauucccucagcaugugccuuguguguuaucccauuaaauagcuaauccucuuauuguccuuucucuuaggacagccuuuuguuagaaaccuuugucccaggcccugagggauccuuccucuggucuuuaugagacaagagcugugugcugcucaguagcagaucacaggcuccucuguggacuucacaccuuuucugaauaaugcgaggcaguauuaaagggggagacgaggugugaucacuuccauuuuuucacuguaaucauuugagaucuuaggaccagcauguauuacuuuuacaaauuaagaaaguaauuaaauaauuuuuaauggccuccauaauaccuggccaucauuccagcccugaaaagacuuucugagucaugguguuccugagaagaaaccacucugauaaugggucuggauggaucucugagagcacacuggcuccccaagcagcacagcugagacugugugagagccauugugaguucccugucccugugggcggagaugccccucugcccacuccgauucauucugcagucugggcucucuccuccccucccugcccacugucccuucagcaccuaguuucucuucuguuauuaauaaacguguuguuguauugagauagagucuagcucuuguugcccaggccggagugcaguggugcgaucucgguucacugcaaccuccgccuccuggguucaagcgauucucuugccucagccucccaaguagcugagauuacaggcaugcgccaccacgcccagcuacuuuuuguauuuuuaguagagacacgguuucgccauguuggcugagcuggucccaaacuccugacuucaagugauccgcccaccuuggccucccaaagugcugggauuacaggcgugagccaccgugccuggccaagaaacaaguuuuugguuguuuguuuuuuuguuuuuuuuuuuuugagacggagucucgcucugucacccaggcuggagugcaguggcgcaaucucggcucacugcaagcuccgccuccuggguucaugccauucuccugccucagcugggacugcaggugcccgccaccaugccuggcuaauuuuuuguauuuuuaguagagacaggguuucaccauguuggccaggauggucucgaucuccugaccucgugaucugcccgccuuggccucccaaaguguugggauuacaggugugagccaccgugccuggccauaaacguguuuuuuauaaacauguccuucauaacaaauuucccacaucuccauuauacuuacagaauuuauauggaaauuuugaaguaaggaauuacaauguauuuaccaagaucaugacuggagauugucuuugcaaaaucugaccauguugaauucuuuuaaaauucugcuacuuauguugaagaggguggggcugaggagggcguguaugugaaagcaugcuggaaacugaaugauuggacaccuguaaaccugcugcuguucucagugcuugugucaggugguaaacgcauuuuggucccagggcuucuccugccuuccacuaaggcaucgugaagaaugcagagagaguggcgauuacucauuuuaucuccaccuuaaaggaaagaaaggucauuuccaugaacugucauaaaaauuguugccauuugaguaacaacauggauuuugucuuuagggaaagaauauggcaaagcugaugcaagauggguuuauuuugauccaaccauugugucuguggaaauucugaccgucgcccuggaugggucucuggcauuguuccucauuuaugccauagucaaagaaaaauauuaccgguaggugcccuucuucuguccugcuggaaggaggggagacauuacaugucccaacacuuaggugaccuuuggaguagguugugaccacauauauuuguuagauaaaagguggaagaauagaggcugggcgcgguggcucccaccuguaaucccagcacuuugggaggcugaggcgggaggaucaccugaucccaggaguuugagaccagccuaggcaauacaaugagacccugucucuacaaggaauaaaaaauuuaaaaauuaggcgugguggcacacgccuguagucccagauacuuaagaggcagaggugggaggaucacuugggcuuaggaggucaaggcugcaguaagccaugaucacgccacugcacuccaaccugggugacauagacccugucuccaaaaaaaaaaagcagaagagaaaugaaaauuauuuuaugugagauaagggugauggugcuacuaggaucauuucagacuuuucagaaucaaaaauaugagaaauauuauuuuaauaacaaccuagacucuguagaggcaagaauggugcuaacgcucuuggaugauuugccaccaauacuuuggagaauaaaaccauaauacguccauccuuuuccccccaaaucauucaagaaaacuccugucccacuugacaaaaaguaaauuaucuuauauaauuuggagucagacuugcaagauaaauaggaaaucuucucagaagcagauugugaaggauauggggcaggcggagugcagagagaccaggugcgguggcucaugccuauaaucccagcacuuugggaggccgaggcagguggaucacgagaucagaaguucaggaccagccuggccaacauggugaaaccccgucucuacucaaaauacaaaaauuagcuagccaggcacgguggcgggugccuguaagucccagcuaucgggaggcugaggcaggagaauugcuugaaccugggaaguggagguugcagugagccacguucgugccacugcacuccagccuaggugacagagcgagacucugucucaaaaaaaaaggaugaaaaaauuauccauccuaucagacucagagacuauaaacucuccucccuuccuuccuuuucuuuccuuagggacagaguggccuggggugaauagauugcuauccugagaugaaucccuaaaacaauuucaaguaggcacagcugcauuccauuuuccaccaucuuguaaugaagaagucuuauuuaaagcuuccuuccccacccaauuuuagagagauaguuggcaauaaaaauuaaauuuuuccuugguaccuugacguauuuuucacuccaugacgcugguugcaaacuuacuacgugugcccauguguuuauuauuuuaaacauuugugauauuugcauuauugagccuuuuacuugcccaucgcuuggcccuuuauccucauaucucauuuagucugcacuacacuguuugaggaagggguuauuacucacucuccccuuuuauaauggcucauggugagauucagagucaggccucucuguguuaagucaggugugaucucaccaaauuuccccaagaaugggucaggaucccugaggguccuuacuuaacucugagaauaaucuagaaagggcaguguugcuccucuaaggaaagaaugagccuucauuaauuagauugacuugcccccaucaaaauagcaccacccaacaucugaggcccaacuuaggacgguuuucauagcgaagacuguugaugccgccauuacagacaagaugucaugacucugaugccaaacugugccaagcuggugguucaucccgggcuucuuucucuccaacaggcauuuccugcagaucacccugugcgugugcgagcuguauggcugcuggaugaccuuccucccagaguggcucaccagaagccccaaccucaacaccagcaacuggcuguacuguuggcuuuaccuguuuuuuuuuaacgguguguggguucugaucccaggacugcuacuguggcagucauggcuagaacucaagaaaaugcaucagaaagaaaccaguucagugaagaaguuucagugaacuuucaaaaccauaaacaccauuaucuaacuucaugaaccagaaugaaucaaaucuuuuuguuuggccaaaauguaauacauuccagucuacacuuuguuuuuguauuguugcuccugaacaaccuguuucaaauugguuuuaaggcgaccaguuuucguuguauuguuguucaauuaaauggugauauagggaaaagagaacaaauuugaauuuguaauaauaaaauguuuaauuauacauuuuauggcuggcauuaauuguuccacauuaguaaaaccaauuaucuuagaa

SEQ ID NO: 192501 - RNA, 21461 nt, Homo sapiens
cacaucucaaaaaaaguuuauuauguuugauacaacagauucucaauauuagcaaaucauuccacuuacccccaagcgccagaucuugacuguacagucuaaaaacauuugucaaagugagaaaaauguuacagaacaucucauaaaagaauuaagauacaaauaguauauacagauaguagauuguaacaaaguggaacguacuugcaagacaucaccuagcuaaaauacuugauucccuaugaggacaaacugaaaaauaaaauauuucaagcacacaaagaaaggacaaaauaggggaaaccaaugggaaauauaaaguuuaaacuuauuuuuaacauuuaaaagcaacuacacuuuuccauuugagccaguucaaaaaggagaagucaaauaaagacuuuagaauccugugaccaacuauaauuugagcuugauaacaugaauggcaucugaaagaugcaagccaaguauuucuaguacugugaccuugagagauaauaacugagcaaccugcuagguuaaccuugagggguaaaucauauugauagaacaaacugaauaaagugaaugauacaccagacaauuaggcaccaauuaggcucacuucuccauuuuccaaaccuaccaaaaaauaucugaauagacagauagauucagaccagggagugagcaaaaaauaaaaaugauugcuaauuaggcaauuauauacuaaaaguggaccuuuuaaggccagaguuuucaucccaaucaccagagauccccauaauuucaccguauucagauuggcuaucucuacuuuuaaauuggcacugucuaaaaauucacaaacauuuauggaaugguaaaaauuuugagcuucaaacaauugaauaccauuuggugaugcaagaaaaugcuaauuuuaaaaauagcuucugauuuuggaauuauggaagucuaaauauaauguuuucucacuuuaaaauggaaaaaacuuucgugcuguuucuaaaacacaacauaaaaagggaaaaccauuuggcacuguguacacacaggaacaucccaguuuuaguuuuuaaucauguuuuucaaggaaacaauuacuuucuccaaaugcaugguuuuuaaagaguacuucauauuuccaggacaucuucuuuugaccuaguguguuucuucuuaaaaaucaaugacaguuuugucucuagguuucugacuuuuugaagcaugauccccaaagaggucauaaucacucauauuuuaaaaaccaaaaaaaauuucauuuuuguuaaaguaucccaucaaugaaaauaaaguuguacagagguuugagauaaagauaagguauuagauuuucuucacaaucagccuacuagcuugacuggcucucuuuucccaaaaugacauuucaaacucuuuugaaggacaggaaguuauaaaauguaaacaauuaagaauugucauacucgguuauucuaccuaguguccuccaguugguaagcaagaccaaggagugugucgcuaagagagagagacacugguauccuuccuguuggcuacugcucaaguuaagaaaauaucuuaaaauacgccuaccuuuaccaaaaaaaaaaaaaaaaguauauuuuaaaugauaccaauaaagaacacaugcaggcuuuucuuuuccuccuaaaaauuaaagccagcuuucacaguugguaaaauaaugguaggacagcauuaagacauuuuacggggggaaaaauguuugugacagcagaguggaaaucagcguuaggauccagccaagaacaacagagggaguaagugaagaauugacucaggagcaacuauccuuaacauacugacagccuaucccaauauuuugaguuguuuaagagccaaggcuguaacaggauaccaaauuugccaugagauauaucugucuuuaaggguguuuaaaaauaaagucagcugaaggaaaaacaguaguugaaucauaaaacugaaagaacaacuuauauaguguguaaggaacucaagagaaaccagugagcgagccuuuaugugaaccacugaaacaaucucuuaaaaauaaggcaauucuuuucuaagucaaauucauuagcaauggaacauaaucuacaaaauuauuuucucccaugauuugaauguccauagucucaguuuuuucugggcagucuucauuuauuccuuuugucccaccuaauaauagccccuuucacucuaaaaaguaucccaguuuggaaaauaauuauuuggucauucuacccaacuccacugguuaccccaaaacauuauuuugaauaaucaucuuuuccagaaguuacaggccugaggaacuucaaguuuuuagagaaaacaucacaaacugguauacaagagaaauacugcaaaguacaaaauaccugacuccaguuugguuaucaguagugcugucagaaccacacuggaaaaccaggucaugguaagaaggucuuuguggaggcaguggaaguaaggucaucugaggagggaaaaaguuaccauuccaggucggcgcugaagguuguucuguaaacacuguaauccucccuguuagcaucucaauuguuuugcugcaagagccaaacacccugaaaaaagcuugaguguuccggcuuaggaaauguaccuccacaagagcaggucuuggcuguagcagguauggguuuaagagaucaacuagagaacgaaguucauagaaaagagccucucucugaagccuaagauagucugaaaauucaguggguaauaaaagcuggugaguucucaaaaaaucuaagaugaaacuaaacaaaucaccaucucugucuacaaaaaucuggccaccaaccaucuugaauucuuggucucugccaucuaacaugcgugccaaacgagaagcaggaaacugcuuuaucguagaaaaccuugucgugaauaucuucccucccacauucaaagugaccaguuccugacuacucauucuucccucacuucaaacuagaggcuaccaucagccacacuuaggaaaucaaccuauaaccauaaauguugcuaguuauacaugauuaugcaguggaggggagggaagaauaacaaaaaccagacuuagauucccaggaaacuacuguaagguaaauaguguauccauggcuguguuugcaaauucgaguugccugggaacuugcaguauacaaaaugaaaaagcaacagaugaggaacuaaauagcuuaaggaaaacugccaauauaucugaagauagacaucaaauagaucccuuuccugucuuacauuuaaaaacuuauccaugaaaaccuaguaaaacuauauauauauauauauauauauauauauauauauauauauauauauauauauauauuuuuuuuuuuuuuuuuuuuauuacugggaggggaaaagcauucucccuccccauaccugucuaccacgcagaggcuagacuuaaacguuuuucuuaauuucuuaugaucuccuuagaaauuuaguggcuaaaucaugaauuacauguuaggaaugagacagccuggcaagcucaauuugacuauucucauagcuagaaggaaaucauuucuucugugcuuuaaauuuaguugccaccuuuuauccuguccccauuuucauuaccuccucucaaccaaauuagaggaggacugagguaaagaacucuuauuuucagaaagucuauuccacuuaaugggcuuucaaggaauaucuuacucuaugacacaaauaaggcagacuagagagcaguuauaagguuacuucuuuguuauaugaauucuaagcaagguguuuauuccaugagaggguaucuuuaucucuugugagcagacagaacagcauuaguguucagcugauuacuuuguaauagcugacagacuguuuuaucuguugucaaauuagucuuaacuacacuaaacauucuuucuguaagcaaguggauugguuugguuguacacuugccaucuuucgaacaaaacaacacauagcugccagaaaaaagguagucuucccauuuccugcucuugccauguguucuauauauacauauauauguauauauauguauguguacauauguguguguguguguguauauauauauauauauuuuuuuuuuuuuuuuuuuuuuuuuuuuuuuugguagagacugggucuugcuauguuuacgaagcugguuucgaacuggaacuccuagccucaaauaauccucccacaucacuguccuagaaugcugagauuauagacaugagccacccugcccagccagcugauccuuuuuuuuaaccuaucuaugcuuuugcuugcauagccacuuaacauuucuaguugaucaucuuuggugaaaacuacaaaaacaaaggagaaaagggcagauugaaagcuccacucuccuaaaaauguaaacuuaucacaagaaaaugccagguuuuguauguaccauucacauuuuggugauaauuaacucucuguagaaaauuuuggaaaucuaauuaauuaguaccuucaauaccuuuaguugucucccacacacgcgugugugugugaaaucuucuacaauaucuucccuuuuuuagaccauguucacugucaaaaaggugcuuuaagagcagucuuuggcugggcacgguggcucacaccuguaaucccagcacuuugggaggccgaggcaggcggaucacgaggucaggagaucaagaccaucuuggcuaacaggauggucuuaagggacagugaaacccugucucaacuaaaaauacaaaaaauuagcugggcgugguggcacgcgccuguaaucccagcuacucaggaggcuaaggcaggauaaucacuugaaccugggagguagaggcugcagugagccaagauugcaucacugcacuccagccugggcgacagagcaagacuccaucucaaaaaaaaaaaaaaaaaaaaaagugaucuuuacugcaugcuugaagaacaaucacuacuauacuaccuauacuuccaucaauacaauauuagaucauaugaucucucaccuauuuuuaucacagcauaaauacaaccaacauuugggguggaugcuuauuucaaaagcacucuuuuaaacaaaaaaagguucaggccuauacuacuaaauuucacuuuuaucuuuaugcuaccuaauuugaacauguauagauuauuuuuggaaggaauacuuuuggaggaaaauaugugacuagaaucguugaccaaaucugaauuaccacucucuauucucuaacaauuucuaacaaaagaaaacugcauacuugaaacagauuuuauaauaguuuauauuugcacacaaauucugccacauuguucaguaccaccaaaguaaaauucuugaaucuuucauugaaaaugaaaaacccaucugucaccuguucccaguaaaaaacugauuguucuaugaaaucggcuguuuuagucagauaggaacugaaguuugaaagacagccuuuccaaguugccaggucaucaaauaaugaccauucuaggaacaugguaggaccaaagacaaugacaaggccaagcagaaggauuagcaaaaauaacuuauaaaagcuccagggaaucuugcuaaugaaugugccagugucuugaggcaaagaaaguuuauccacaucgacuaguuuuaugucuucccacugacugguaucaaaguucuucauuaaagggcuugcaggcaaauuagagggagguaaaggaguuuccuugauuacuuugauuuucucucuaaacuccugcaucuguugcagaaauacaauggguucugacacaucuuugaaagccucagcaauguuaaaggccauccguugcuccugcaagaugguguugaguuuguugaucucugggucauaugcuugcauaacagcaaguuucauggucucaaagucagacagaauuucauucuucuuuugauccaguguguguuguaacuucucaaaaaauuccuucacuuuaucugaaucuuuagucaguaacuguagggauuuccucuuacuaguuuccaagguauccaagcgagaaagagcaucuccccgacgccaggucucaaagcucuggaagagggacucaaaggcaucccuuuccugagcauaggcaucuucaauagaacagaagacauguuuggugugcuccccacgaguagcacagaucccacaaaucagcugcauaucagucaggcagaaaauguugagaggcugccccaaguguccuuugcauacuggcauuuugggagagaucuugaucuuguuauacuuuuccacaauacccuucagggaguaauuaaccugcaggcuauuaauuccaguagcugaaguuuccuuacggcauguaggacacuugaauggagcuggucuccacaaggaauuccgcacacucccuucuaagauaccuucuaagcauuuuuugcagaaguugugggagcaaggcaaaacccguggaucaucaaacagacuacaacaaauagggcaugugagaucuucuucaagcagcuccaucacauccuaccagaaaaaaaaaaaauuauuuuacuccaauaaccgucaccacuaggacuauguaauaauuagaagaaaucugccuucacguuaaaaugauuuuucacugaaauaaccagccaaacaaaguagugagaaauuugguaagggaaugcacaccaaagcaaauuuaauccacugagacuagaacaugcuccuuuaauaguagggcauccuauacacaaggccuuugugugggcuuuccaacaacagucuuuggcuaagacaagacucaggacuaggacaacugcaaguugagccagcaggacccaagcaauuguuuuaaaacagagcugacuacugacaaaaacaaggcuauucagugucuguaacagaaugagcucuuuacucugggcccacaaauaugaaaugguauguuauauaaaagaaagaagcacagaaauauaaauccaaacauguacucucauguagacuuuauuaugaauuggcauauuuuuguuucaaaggcaagauuacaauuuuuaaaaucacagguaaaagcacaagaugagaguugcaauucacucuucuagguagagaacuaaaugagguuuuuuguuguuuuuaaaccaccagaacaguaacagaagccauuuuguauuaucuagaaucaucaauuuucacaauguggugggcagaaaccuggaugucccucuuucagggcaucugugagaucaaaacuauuuucguaaugacacuaagauguuacuugcuuuuugcaccaugucaacauuuguaccaaugguguaaaagcaaugguguguagacacugcugaagccuuaggagggaucgagcaaagcuguaagaagcgcugaauuguauucuucaucaccacccaaauugggguuggaguaccgguuucacuuaagaauguucuugaugcagcaguaaaaauuauucauuuuauuaagucuugagccuguguacaguuuuuuaauauauugcgugacaaaauaggcaguacgcacaaagcacuucugcauaccggcagauguugucuggagaaaaagcacuuaagugaagagcggcaaguuaaaccagcugcuuuuuuucauggaacaccauuuuuaccuucugaaagaacaaaugauaaacuauggcuauucagacuuagcuaccugacauuuucuggggaaaaaaaaugagcuugcuacuucaaagaaaacaauugacaguaucucuugcuaaugaaaaggcuggguuuuauguaaaaauuagaauuuuggaaaacauuugauauuuaugagccugacagcuucccauuaauuaaagacuuuuaugaugagaugggcagugauauuaaugaaugugaggauuuucugaggggaaaggaguacuguauaaugaaaugugucaauauuuggagaucugcaaaacacagugaauacuauuucaagucacuaaugcauguuacaaaucaggcauggguaaaagauccauuugaaguucacgaaagaccaacagguucauaaacaauuucagauuccauacuccaacaaagaaacuagcacuugcugaguuuuuguauaguaucacaagaagauucaggcugggagcaguggcucacgccuguaauccuaacacucuggaaggcugcagagaguggaccgcuugaccucaggaguucacgaccaguacgggcaacauagcaaaacuccaccucuacaaaaaaaauaccaaaaaaauuagccagccaugguggcaugcgccuguagucccaacuacucgggaggcugagguaugagaaucccuugagcccaggaggcagaggcugcagugagccgagauagcaccacugcacuccagccugggcaacagagagagaccuugccucaggaaaaaaaaaaaaaaaaaaaaaaagauuaaauuaccugaaaaggcuauuuaaauaauauuccuuccuuuaccaacuacauaucuguguaagccuagauuuuuguguauuuccuuuucuuuucuuuuuuucuuaagagauggggugucucacucugucacccaagcuggagugcacuggcaugaucauagcucacugcagccuugaaauacugggcucaagugagauccucccaaguaacuacagacugcaggugugcaccaccaugccuugcuaauuuuuaguuuuaguguuuuuuguuguuguuguuuuuuuuuuuuuuuuuuuuuugagacggagucugacucugucacccaggcuggagugcaguggugcuaucuuggcucacugcaaccuccaccucccgaguucaagugauucuccugccucagccucccaaguagcugggccuacaggcacauaccaccacacgcagguaauuuuuguauuuuuaguagaaacgggguuucaccacguuggccaggcuggucuugaacuccugaccucaggugauccauccgccucagccucccaaagugcugggauuacaggcgugagccaccgcgccuggccguggauuuuuuuauagacagggucucacuauguugcccaggcaggucuagaaauccagcccucaggcaaucgucccaccuccaccucccaaagugcuggaauuacaggcaugagccaccacacccagccuucuucguuuauuucaaccaaaauaauauauuccaacagguuaaauacagaagcagacaaaagacuccagcugucuucuauuaaauagccauucauuacaggccucuauugcaaugccaugcuucucuuaauuuuguuuuggaaaauaguuauuuuccuaaauuauuuguuaacuuguaauggguuuaucauuguuauuuuacgugaguauuuuuuaaaaauuguuuuaauuucuaauagaguaaauaucgacaguacaaacauaaaguucuugggauucucuuuuuuuuuuuuuuuuuuuuuuugagacagcuuuuucacccaggcuggaguacagcagugcaaucucaguccccugcaacuucugccucuuggacucaagccauccuccugccucaaccuccaaguagcugggacuacaggcacgcaccaucacacucagcuaauuuuuuuuuucuuuguaguuuuuuuuuguagagaugaggucucaccauauugccuaggcuagucucaaauugcugggcucaagugauccucccaccucagacugccaaaacacugagauuacaggccaggauucucaauuuuuaagaguguaaaaguguccuaagaccaaaauauuugagaucccuaauacaggcaauaccauuucucaaugcagguuuauuauuuuuaauucuuauuuugagagacagggucuugcucuguuguccaggcuggacuacaguggccuaauuauagcuuacugcagccucaaacuucugggcucaagcaauccuccugccucagauuccuaaguagcuaagacuacaggcaugcaccaccacgccuggcuacuuuuuuuuuuguagagaccaggucuuacuagcuggccucaagcaauccuccugccucagccucgcaaagcacugagaucacaggugugagccacugcaucaggccacaaguuuauuuuaaauauacauucaucucuauaguuguaaaaccaaagaguacuacauauuucuacauucaguuuacucagggauauaugcacauaucacauuaucaacaauaucacauuaucaacaauaacauaugacuuaaucgguaggccaucuaugauaaaaagugaauacuuggccgggcacggguggcucaugccuguaaucccagcacuuugggaggccgaggcaggcggaucacgaggucaggagaucaagaccauccuggcuaacacaguaaaaccccgucucuacuaaaaauacaaaaaaauuagcugggcgugguggcaggcaccuguaguuccagcuacuugggaggcugaggcaggagaauggugugaccccaggaggcagagcuugcaguuagccgagacagcgccacugcacuccagccugggcaacacagcaauacucugucucaaaaaaaaaaaagcgaauacuuuuuuaacaguaauuucaacagccauacaugacuggacuauaucuagaagguaaacaguauuuaaaggacaagcugagcuugcaggguuaauuaguuuauggcuuuuuuuuuuuuuuuugagacuaagucucacucuugucacccaggcuggagugcaauggugugaucuuggcucacugcaaccuccgccucccggguucaagcaauucuccugccucagccuccagaguagcugggauuuacaggcaccugccaccacgcccagcuaauuuuuguauuuuuaguagaaacgggguuucaccauguuggccaagcuggucucaaacuccugaccccaggcaauccacccgccucccaaacugcugggauuacaggggugagccaccgugccuggcguuuuuuuuuuuuuuuugagacagagucucacuguugcccaggcuggggugcaguggugcaaucucggcucacugcaaucucugcugcccagguucaagcaauucuccugccucagccucccgaguagcugggauuacaggcaccggccaccacgcccggcuaauuuuguuguauuuuuaauagacacgggguuucaccaucuuggacaggcuggucuugaacuccugaccucaugauccaccugccucagccucccaaagugcugggauuauaggcgugagccaccacgcugggcccuauuuuuuuggguuuuuuuuuuuuugagacagagucucacuucgucacccaggcuggagugcaguggcacaaucucggcucacugcaaccucugccucccggguucaagcgguuccucugccucagccuccugaguagcugggaacuacaggcgcccaccaccaugcccagcuaacuuuuguauuuuuugcuggagacaggguuucaccauguugcccaggcuggucucaaccuccugaccucgggugauccgcccaccucagccucccagagugcugggauuacaggugugagccaccacgcccagccaguuuaugguuuuauaguagauuguaagauacauguauuuauaauacauaacauagggagaacuaaagcaaagauuauucugucucaaauuuagugucauauugcaaaaaaagguguaauuagcugauuuuucugaaaaauccuuugugauaugacaaaucauauaaccucugaaaagcauuggaaagagaauggcuauaaagacucaacuuaguuugucuucugaaagagauuaccacacagcuguaagacacacaaacuuucagaacaaugaagucaaacuuuugaugaucugccaaccccaguccugcuccacacuuuucacuuccauuacuaucaucuuuugccuaagaauucuacacaaaggccagauuuuugagaaggcaauagaaacaggaaagugguaagggcaacacucaauaaaagaaaccuaauuuacucauccuugcaauguuaauacuuccagagaauacuauccaagcauauuaaauaagaagaaaacaaagaauauaccaagugauugggugggaugaggaggagaaaaagggcaccaaaggcaaagagaaacuaugaagaaaauugaggauacaacgacaggggccaagaagaauuuucaggcaaacaaaugugaucaaaagugaaaaggaaaaugucacacacaggaaaacuuagaaauaauaaacagucaucccaaggucaugaucaacauacagcucuuaaaaugaaccagaggggaaaaaauacuauuuggaaaguaucuucaaaaaaauugcaucaaaauuacaauagauccucuaauuucauuuuuagugacuuaacuuacaaauuuugguugauaauuuaaagauucuuauuuucauucacuuuaaaaucuacauauuucuggccaagcgcggugguuuacgccuguaaucccagcacuuugggaggccgccgaggugggcagaugaggucgggaguucgagaccagccuggcccacauggagaaaccccgucucuacuaaaaauacaaaauuagccaggcgugguggcgcaugccuguaaucccagcuacucaggaggcagaggcaggagaaucgcuugaacccgugaggccagagguugccgugagccaugaucgcacaagagugaaacuccaucacaaaaaaaaaaaaaaaacuaaauauuuccuuuucucuucuuccuuucuuccuuuaguuuuaugccuucucucuuuuuuuuuuagagauggagucuugcacuguugcccaugcuggagugcagugguguaaucacaacucacugcaaccuccgccuccuggguucaagugauucuccugccuuagucuccccgaguagcugggauuacacgcgccuacaaccaugccaggcuaauuuuuguauuuuuaguagagacaggguuucgccauguuggccaggcugaucucgaacuccugaccucaggugauccacccgccucggccucccaaaguucugggauuauaguugugagccaccaugcccugccuaugccuucucuuuauaaucaaaacuuucucuaagacaaaacuaugugaccacuuccacaagugacuaauaccugauccaagaaaccaugguagacaucuuuguugccuccaaaguuuugaaggauaauuuaaguuaaagccuuuaauaucauaaauaaaagguacucuucacagcaaaauaacuuacaaaaucuuaaaguauggcuaacacaaaaucugaaguaaucaacccagcuuacuccuuugacaugaacaaaaaaggauacauccccuccaccucuuuuucgggguuucugguuguuuuuuuuucuuuugagagggagucucgcucuuguuacccaggcuggagugcaauggcaccaucucggcucacugcaaccucugccuccuggguucaagcgauucuccugccucagccuccugaguagcugggauuacaggugcccgccaccacacccggcuaauuuuuguauuuuuaguagagacaggguuucaccauguuggucaggcuggucucaaacuccugaccucagguaauccgcccuccuuggccucccuaaguguugggauuacaggcgugagccaccgcaccuggcccuuuuuuuuuuuuuaagacagggucucgggcugucacccagacugaagugcaguggcgccaucuuggcucacuggcaaccuccccaccagcaaccucugccuccuaggcucaagcaauucucuugcgucagccucccguguagcucggauuacaggcaugcaccacuaccaccuggcuaauuuuuguguuuuuaguagagacaggguuucauuauguuggccgggcuggucuugaacuccucaccucaaaugauucaccugccucagccuccuaaagugcugggauuacaggcgugagccagugugcccagucuguuuuguuguuuuuuuugagggaguaucacucuguugcccaggcuggaaugcagugacccuaacacagcucacuguagcuuugaccuccccaggcucaggugauccucccaccucagccucaugaguagcuguaagguacuacagguacaugcuaccauucccaguuaauuuuuguacuuuuuuuguauagaugauguuucagcauguugcccaggcuggucucaaacuccugagcucaagcagucgggacucagccucccaaagugcugauuauacaggcaagagccacugcacuuggccucaagcuaguuuuuuuccuaauauagaagucaaaaaacuuuauguaaacaaaauuauuauucacuguucaaauuucaacuuaaagucagauuaagcacauaaaggcaaacaaguuuuccaaaauucaucucuuccuuugaauauuucugaauacuuagaaaagucuuaaauuuugaagcacaaauaccaauuaaaaacuucccaaauguuuuauaccaacaauuuuaaaagcugacaacuuuuuaaaguauccagaaaggugguaguagacacuaguugcggaaaaaagucaaacuuguucuccugccauauugauguuuucuaacauacuuuuaaauuuacauacaaugaaauucacuuuuugauuuacaguuuuauuuuuaacaaaguugcauaccaccacuaugaguuuauuuuuuugaacaaauugucaagcuauccacaaagaagaaggauuacaaaaagugcuuuaugaauccuaccucaauuaguaucuggcaacaacagcuucuauaaaugagaaccauaacacaaccacuaaaauaauaaaaauggaaaagccaauacuuacaaaguaaacgugucauaauagaguuuauauauauguauuggacuucuuccuucuagaauucuuuuaagagaucaacccaaaaugauuauacugcagaaaguacucauucauucacucugaaacaaaaguucauuuucuccuuauaaaaccuauuaguaaaagaaacuuuccuacuaagguuuuaaauuccacuggcuguuagcaauauaaaguuguucaaaauauuacccauguuuuuuguuuuuuuucauuucccauuagggaacaaaaagaaaagccaauaaauauaucacgcuuuuaucuuaaggauuuaacucaaauuuccauccuguuuugaggcaucuuugaaggcaagaauuucaaaacaguaccuaaguaucuaucagguggcuagacagcaaacauugaaacucacuucauagacauuaaauuaugcuaagcuuuacugaacugagacagccacaaauguuacuuugaaauaauuccuauaauaaaauggcucauuaaaaaaaaucauuuccucucagcacacuaguuaaucuuauuuucaaauaguguacuauauucucccaucucagccuccagaguagcugggacuacaggcaugagccacugcaccuuacuauacuguaguaugagauccauuaggccaggugcauuggcucaugcauguaaucccagcacuuuggaaggcugagccagguggaucaugaggucaggaguucaagaucagccuggccaagauggugaaacccugucucuacuaaaaauacaaaaauuagccgggagcaguggcagacaccuguaaucccagcuacucgggaggcugaggcaggaaaaucacuugaacccaggcggcagagguugcagugagucaagaucgcaccacugcacuccagccuagaugacagagugagacuccaucucaaaaagaaaaaaaaaaaagagagauccauuaauaaauguuuucuugaaacuaaguaagggucuaauuaacaacuauuaaaaucuagguagaggauguaagaauacuuuaauauucuucuugaguuuucucuguuugaacauuuucacaauaaaauggguggaaaaacuaaagagccaauuauuaaaaaaccauauugaguuuagaaaguaaaacuuugaaaacauuagcuaaauauaagccucauaagaaguuuaaucugcuguaguaugguuuguuuuuguuuuuguuuuuuugagacagucuugcucugucacccaggcuggagugcaauggugcgaucucgucucacugcagccuccucuuccuggguucaagcaauucuccugccucauccucccaaguagcugagauuacaggugccugccaccacgucaggcucauuuuuauguuuuuaauagagacgggguuucgccauguuggccaggcuggacucaaacuccuggccacaaguaucuuccugccuuggccucccaaagugcugggauuacaagcauaagccaucaugcccagccuaugguuucaucuuucauaaauuuuuuuuuuuaauguauuacuggaagucucugaauccagaccugugaggagacugacauacuugucuggcucucagucuguaaccucugacaaaccacuuauacauacuaguuucucuccucauuuguauagcuauuuuaaaagguauaugaaaaguauuuacaaaguuuuuauuuuaaauacucuguaucaauguguuauuacucuucauucuuuuagagacugucccggugacuuauaugaucaaaacaggacaaaguaagauacagagaucagauuucagauauaaucucuaaaaaugaaaauuaauguauuacacauagcaccucuggcauauauaugaucaaaacaggacaaaguaagaaauaucagauuucaauaccucuaaaaaugaaaauuaauauauuacauauaguaucuaaaauaauuguuauguggcucuugcaaacaauauaaaaguuaccuauguguccauauaagacaguaaguaaccaaccuuuucuggcauuauccuagaauaaacaguaguuaaaauuuccaagauauuucuagcagagauccugacaaggcaaaauagagcuaguacagaauguucacuagcuugguaaguucacuuacucagaaaguucacaaaggguugucagacuaaggugaaauucucagaaauauaaaccaggucacucauuaccucgcuaguucagagcacuaagaaaaacuuuuuccuuuuccuucauucucuucuccauaccauaguuuagccuggacucuuuccugccuuuuuuuuuuuuuuuuuugggacagaguuuugcucuugucacccaggcuggagugcaauggugugaucuuggcucacuggaaccuccgccuccuggguucaagugauucuccugccuuagccucccaaguagcugguauuacaggcacuugccaccaugcccagcuaauuuuuuguauuuuuaguagagacaggguuuuaccauuuuggccaggcuggucucgagcuccugaccucaggugauccgcccaccucagccucccaaagugcugcgauuacaggccugagccacugcacccggccaggugcuguuauucuagaagguaugauaaauaguuuauaaaagacacauaaaaguaaguuucagagaucugcucaugucuauaguuaacaccacuguacuguacacuuagaaaucuguguagaggauaggucucauguuaaauguucuuaccacaauuaaaaccauaaaauauugacaccauacugaaaccgaaguuauccaugcaacuagcuuuugugucuucuuaaauuauaaaauuaguuuuuauuauagaaaauucagaaaauagagagaaaaagccacccauaaucacaucagcaagaaaucaccacuacuauuauuuuggugucuuuauuccaaucccauguguccgugcaugugcacacauuuuaacagaacugguagcauaauacaauuuuguauccuauccccuuauuuuauuacaugccuuucccccaucaugauauguucuagaaaaacaugacaguccauguuguggauaugcuuucuuauugcucauuuauggguuuguucuuguugcuguguuguuuuguuuguggguuguuguguuuuuuugguauuguaacauuuagguaaacaccuuauagagaaaagucuugcuccacagcucuaauuacuuccuuagacaauuccuuuaaauguacuucugggucaaacaguaaggacauuuuuaaggcuguugaaaagaugacuagguuucucucuagaaaggguuuauaucacuuuaugaacucuaaccaaugauguauuagagugguccaccucucuaugcaguuccuaaccuuaaauaaaaccauaguuuuauaggacuuaguaaaaaacaauaagacacacuuguuaccauaccuacccgaguuuaaaauauaaaaguuuaaggcaguuaacauuagucugcaucugugucuuaccaauauauauguauaggcaauaaaugguaauaaaaguuaugggguaggaauagaaauacugggcuuaaaagcaucuuagaaaucaucuaaacaccuaauuuuaggagucaaaaaaacuaagacacccccagcacucaagaaguggagacucaucaguuguacacagcaaacuaggcaucacagccugaguuuucuaauucuuagaccuuagcaauaucuagaaagggacucaagaacucaguauucuuauucauaaaaugaagggguuuaaucauaagcucucuaaaaucccuucuaaaauuuugcaguuuuuacaaacuagguuuaacaggcucucuagugaaggggaaagcacagaaccugcuuuugaguaccuguguucaagcaccaguuuuauccuucauaaaauuaggauuuuuauaucugggaauggugccacacacuuguagucccagcuacucugaaggcugaagcaggaggaucacuugagcccaguucaagaccagccuggggaacacaguugagaaucccaucucuuggaaaaaaauuuaaaaaugauuuuuauaguauuuaccucauaaugaaauggcuccauugccugggggauacacccgugguugucucgagccaagaaagaauucaggacauggacacacacaaggaguggguuuaggagcggaaaauuuaauagggaaagguuccucacgcugagaaauaucacccaagagagggucuccggguuuggggugaaacgcaaucgauuuuguacagaggcuugaggagguggugauuuacauagggcccaggggacugguuugaccaggugaaucauuuacauagcccgucuaaagacuggcccucccacccuaauuuuuuguuaugcaaauguagcuucuaccuggggccgccaugacaccugcacccgugguuuuaccuagugaucgccaagacgcccacauagggugacaaggaaaagggagcggcccagacgcccacauagggugacaaggaaaagggagugagaaaccccauauugaauguaccuggcuuccagauacagcaggcuacauuuacauauaaaagcuucuagccugcauauuuuugcuugcagcuugacuuuucaggcuuucuguuagaaaauaaaugguuugggggcuuuuuuuuuuuuuuugguagagucucgcucuguugcccagucuggagugcaguggcgcgaucuuggcucacugcaaccucugcgucccgguucaagugguucuucugccucagccucccgaguagcugggauuacaggugcacgcacccccacgcccagcuaauuuuuguauuguuaguaaagaugggauuucaccauauuggucaggcuggucuugaacuccugaccucaagugauccacccaccucagccucccaaagucaccggccaggagcugcuuuuuauuaaaggaaaauuccaccgagaacucuuuuacccuuucuagcugccuaaaaguaauuucucaacuccugugugaugugugagaauuccauaaacuacgaaacuauacaaacauaaauaagguuuaauuacauauggcaaacucuacacauuuaagguguuauuuuggagcaucaguguaucaagcaagaaaagguucuaaacuugaacugugauuucaaggcaaggcaaaacaaauauuacauaagguaucagguacaaagcagugucaugaaaaugagcauaucugaacaaaagcugugacagaauuaaggccagauaaccuaucauaaauguauagaaugaacagaacagcccgguuuuaggaaaggacuucccagggagguuuaguaagccagcugggagaaaggaaaaaaaacguauuuuuagggagggauagggacgcucccauugugcaagaaggaaguauagccgguuaacagcuccaucaaguucuacuagaaggagugccuauguaaaugaaauucugcuuuuaaagugccuauuauauaaaggucucuagaaaacucaagcccuguucuacaagcccuagcagccugacaauucacuaagcauaggagaagggaaaaaaaaguaggaaaaaaguguggaagccccuuucuuccuuuguaauaugaauguuuggcuauauuuaagauaaauaccacauaaauaauugcuaaacgugaauucuguuuuucuaaguuuuaacaaaauaugcaaagaacaaagaccaccaaugaaaguggaugggaacauacguauucuacacacaguuccauuuuggaagguucuagggccuauugaaauuggguguuuaaaaaaaaaagauaacacaggaaaauuauuguaguuuaccucugucuccuacaagcugauguauuuggcaggguuacuauuucccagggcaaagcaggucuuuuuuuucacguuuugacuaacgaacuagaggcuacugcaaagaaagaagaaaaagaacaguauuaacgcauuuauuugcacagcaccccaaucuugacccucaauuuuuucaaucgcccccacaaauaaagcccggcuguuuagaccuggugaaccgccaggagccuggagcucuuuguauuaagcagcuucucgguuagggcgcccucccccggcgccaugcaaccaaacgcuggcggcgcgcuguaaccuaaggcccacacccgucuuuucuuuucuaggggauguggagacgcugguagcggggccaggaaggcuccggacggagcagguuuucuggaccacagacacacugccccggcgcccuccgcaggccgcuccuccccaggcccaugacagugccccgcugguuucugccgcgcugccggacuggagcucagacggccuucgccagcccccccaacccacgcagaucccugcugaccugggcaacuccccacccucgcugaagguucgaggaccaccccgcuuucccgagaggagccgggcggcggguacuuaucuccgaccuccggcuagugggaaaggccgcgcgaccgcccguccuccaacuacagggaccgcacgguacgcgccaagcacagccccaaaauggacucgcggcuccggcuagcuccgcccccuucccucuccc

SEQ ID NO: 192502 - RNA, 25613 nt, Homo sapiens
ggggcggggccgggaggguacuuagggccggggcuggcccaggcuacggcggcugcagggcuccggcaaccgcuccggcaacgccaaccgcuccgcugcgcgcaggcugggcugcaggcucucggcugcagcgcugggugagugcuggggacccggggccaccgcagcguaagugaccuuggcggggacggugcuacccggccgccgagacggguuccucugcgcccucagucgggcccaggcgcggccccgcggcgucccugggggccggcggggagccgggacccucgggacugucccugacgggcgggcuggggugggaguccgcgcgcuccgaagcgucggcgagaaaagcagaaaacagcuccgcccgccagcccucugcccuccgcuccccuccccgggcugugcgccggaccccggcccucggagcggggacgcggccaggaccgccgagggaggcgccugcgaggaagagcucggccggguccggagacugcugccugggaccgcgcucccagcgccugggccucggugucuccgggccaaacugccgacauaaucgcaucugccggcaucuauuuucgguuuauuucccccucauugcgaaggauuugccuggccaacuuucugcgcaagaucccacgcaauuccugggaccccagaagacagguccuguugaagaacaggaaucuggcacugggugggcuggggaggaagccgcacgguguuaaauccauaaacaggaagagaaaccagacagcgaaaccaagaggcgaaugggcgauuggaugccgguggggagaaggccgggggcgcacccugcuccuggacuccaguaaagggaggccgggcagagucccuggggcgccaccucccccucgguuaguagcccuggaggccggggggaguuggccucuggggagcagugggugcuggguguggggcguugcaggcaggcuggggugggcgacccagguggaagugaauugcacuuggcuuccuggugggccucugucacccccuucccaggcgcugagaaagccagcaggcuggcaaagaaaaggacccuagcgcaggccccacacuccuccuccuaacggacgagagaccccccaaacccacuggagaagugacgcugugggguucaaaugcagaccuggcaccuuuuuguagccuggaaaaacauucccacugccugcugccggaggagaggauagcugagaugcacucucuuugaauccaaacguucaggaacguaaggcgaagaggccuaagagggcguuggcuggcucugucucucaggcuggagcacaguggcgcgaucucggcucacuacaacuuccgccucccaaauucaagcuauucuccugccucagccucccgaguagcugggauuacaggugcccgccaccacgcccagcuaauuuuuguauuuuuaguagagaugggguuucaccauguugaccaggcagaucuugaccuccugaccucaggugauccgccugucucggccucccggugagucacggugccuggccaagaacuguuucuuguuggcucuggugcuggugacuuagaacccgccagcuccuggagaaaggggcugggccgcccacccuguguagcuuucccaaagacagagucaaacgucuccuggagaacagaggcuucccuucgucuuuggucauuuguccucuagcuggggguacccccugguggaaaggcacaggucccuugcuccccagguggcaacgcaggccagacacggcccuggcacagcucuccuggguguuggcucaggacagcccuguuuccaacugguuaggcggugaggggugguggcccuuugguuccagguugaaacugcccauguggugcugauuuagcagacuggggaggcucuuuuuguaggcagguucuuuucuuuccccagcugcuggaccugggaguuggaagagaaguugcacccauuuuagggguaacagauauuuucuguugcucuugguuggauugggaagugaauugaagggaggucacguuucaggggugccuugggaugucugucagugauuuucuuuucuuucuuaauuucuuuuucuuucuuuuuuuuuuuuuuuugagacacacucccucuaucgcucaggcuggagugcaguggugcgaucucgguucacugccaccuccgccucucauguugaagcaauucuccugucucagccucccucccaaguagcugggauugccagugcccaucaccacaccuggcuuuuuuuuuuuuuuuuguauuuuuaguagagacgggcuuucaccauguuagccaggcugguuuucgaacuccugaucucaagugauccgccucagccucccaaagugguaggauuacaggcaugagccaccgcgcgguggagggguaauuuucuuaaaucugguaaugaguugugguuguguagaguaacauaccguccuuucgagauauggacugaaacauugagagggaggaguuacagguaugucgauucuucuuuucucucucuccuuuuuuuuuuugagguggagucugacucucucacccaggcuggagugcaguggcaagaucucagcucacugcaacuccgcuuccuguguucaagccauucuccugccucagucucucaacuagcugcgauuacaggcaugugccuccacacucagcuaauuuuuuuauuuuuaguagagauuuuuugucucuccuaaaaaaauccaauguaaaaaaaucccaauguggggguuuugccacguuggccaggcuggucucgaacuccugaccucgugauccgcccaccucggccucccaaagcgcugggauuacagguaugagccacugcgcccagucugcugccucuuuucaauggucuggccuaaggaaauuauuggaaacaugugcgguugagugauauuuacugggcacuuccacaugguccauguaaagggagaugguuggggugacaggcaguugagucuaggggaggcauguacagaugugcugugccucugggauaucaggguggcaggcagcagucucuacgucuggucccaggcugccugagaaagagcaugugggaggcaaaccuugcgcccuggcaugguuguuaauguuuauauuuacccuagcuugugugggguaggagguuuagggaucaaauuccacucuguguuuagacauuuuuuucuuucuuuuuuuuuuugagacaguuucacucugucacccaggcuggaaugccguggcacaaucucagcucacugcaaccucaccucccagguucaagcaauguuccugccucagccuccggaguagcugggauuagaggcaugcaccaccaugccuggcuaauuuuuguauuuuuaguagagaccucaaaugaucugcccgccucgccucccaaaguguugggauuacaggugugagucacugugcccagccauguguuuagacuuuuaacuaaucucuuuuuuaguuucaagccuuaucguccgccucuguagaccacuccugugccuguuuccugauccuuccaagggccauuguauucccugucugcugccccucuuuuggauucuucugcacauuuuuuuguucaugcauucauucauuuauuguuugauuaaugacagggucuugcuuugucucccaggcuggugugcaguggugcgaccacggcucacggcagccucagccacccagauguaagcgaucugguucccaccucagccucccgaguaguaaguagcugggaccacaggcggugcccagguuuuuuuuuuuuuuuuuuuuuuuuucguugguagagacagggucucacuguugccaggacugcucugaaacuccugguuucaagugauccccuugccuccucccacuuaggccuuccaaaugcugggauuacaaggcaugagucaccuccaggccuuuuuguacuuuuaaaacucugcaucaguguauaaacaauguuauuaaaguuuauaugacuucaguuacacuacauggauccuuuuucacucacgguugugagauuuauuucuguugcuacauccaguucuaguccauuuguguuaagugcccaguguguuuaucuacugagggacaguuauguuauuucguguucacuauuaucccaugcuacaauaaauauccugugucucccagauacuuagaagaguuucugcagggcacaugugggagaguuuguuucugggucaugagguguguucaucuuccaucuugcuagaugcuggcaaaggguucuccagugugguugcaucaauuuacucgcccagcagugugcagaguuccuguuccucacauuuaccaacacuagauaguaccagacuuugauuuuugccaaucugauggguuugaagugguaccccuguuuuaauuucaugaccagaaauucaaauuuaaucuuugcuguaggacaacaguaacccacuuaugccuaguguuccauuauuagaacgcuaagcaugugggaguuuuuacaucauacugcucaaggucaucgccaaggucugauguuuuuacucgugcaaaaauuuaaaaaauugcaaccucuggcauaaauggguugagugacacuuuuccuguuuuuauuguuggucagugauggcauauuugcuggguuuuuuuguuuuuuuuuugaaacggagucucacugugucgccaggcuggagugcagugguguaaucucggcucacuguaaccuccgccucccggguucaagugauucuccugccucagcccccugaguagcugggauuacaggcgugugccaccacgcccagcuaauuuuuguauuuuuaguagagacgggaugucacuauguuugucgggcugguguugaacuccugagcucaugaucugccugucuuggcuucccuaagugcugagauuacaggccugagccaccgcuagccuauuuauuuuuuauuuuaaauuuuaauuuucuauauagagacgaggucacuauccugcccaggcuggucuuaaucuccuggguucagucaaucuucccaccuuggccucccgaagugucagaauuauagaugugagccacugugcucagcccagaacugauguuuucuaaaugcugggugcugagaaggauguguggcuggcagucuugacuguguuaucugucuuuaccaggccaguaacuucuuuggucuggucaucaagauaaucuagcaucaccagcaagcaugcauggagaaggaugggcccaauguggccaagaugguaacgggaccaguagagagcccuguagaagacaucuagauauucugcccuaagagcccggagggccgggcugucucaugacccucugacgugcugaccuggacucuggcagaaugugcacacacacagucacacagcuuccuggcuugcgcaagucccaggagggcggugccagccacaggcuuuucccauucgaggguuggaagcguaucaucaaaccacaucagagugcugggggccaccugccacccauucccaacccacucagccuuccugguguuugggacaugcuuugcuuuggcagucaagacagcagaacaaaucaacuuuuaaggccuugucacugauaguacaauuuccauuauuuuucauccaaauuaggauacuucugaaaauagaaaugaugacucugggaugcaaacguuggcuguccuauguauaaggagauggcuuuucacgcucccagugacugaggaaguuucucccagauggcgcugcucugagccuggugcaggguaggcacuuucaaaagagugucuccuuguaucuuccaucagccuugcgagauggguaucuguucccagggccccaagggaggaaaacaggaccuagcuggauccaagagcuaggccuuucuuuuuuuuuuuuuuuuugagauggagucugacucugucgcccaggcuggagugcaguggcgugaucucggcucacugcaaacuccgccucccggguucacgccauucuccugccucagccucccgaguagcugggacuacaggcgccugccaccaugccuggcuauuuuuuuguauuuuuaguagaaacgggguuucaccguguuauccaggauggucucgaucuccugaccucgugauucgcccaccucagccucccaaaguacugggauuacaggcgugagccagcaugcccggcccagagcuaggccuuucuguggcuggccuucgcgucagccucaacuacccugguguaaucucgccugcgguugaauuagggaaccgccguguucugcaagcuggagaggcagaacacuaaugagcagaacacuaaucucauugcaaucucaaaggaucucuaaaagcuuuuauaaagcaggcccaagguccuuugguauccgaugcagacguggugaaugcauuggcucugucagcaucugagcaagucaguaacagaaauggggaguaaaagcuuucagaacuuuccagaauauugacuaaauugucuuguuuacaaccaacaacgacaacaaaaaauaacugcugagggccuucguagugucugcuguuucaaguguacaguagucauuuugucugcaggaugugggguugcuguggcugaccuuguacaauauuccacucauaggugucuucaggccuauggagagcagcuugcgugggcugggccugcaguaccugguuugcauagaugauuggcaggugggcagcacggggaaggaccugugaguggccaaccugguucaggugagggagguggaguggggcuucucugcuuccccugguucccuggaagccuccaaggcuggugagcaucacugcugccucugcacaccugugugcuggguggguuuucugacagguuuucaguugcuucggggcuacagcugcagggagccugcuccaugggacagaugggccucuggugcccguucaucaggggacugaugagaccgaggccugagagcccuuuggauuuuguuuuuguccuuaauuuaaucauaagccaagaaucuacuaaacacaguuccauuaggggcaaagacguaacacaucagaggccacagcaaggcugugauucauacucaaaaaggaaaggucucugggucacaacagagcauaguugaggucagcacacucccacccagugcagggcugcuccagcauugaggugugucuggcagguugaaguaggggaagaugaaacucgccgaagucuuguuuugugguugcacuuaaguggucaaaacuucaggagcaacugccguuauuagcggugagugccaagacuaguuuuuauagaagagaaagaaacaaaguacucugggaaggucuuacugagccuucacagucuccccaccuuuccacuguucccgugcucuuagccgcucugcuggccuauaaggcacagucuucauuuguggcuucuggcaaaauguaagcacuugacuuuuguuuuuguuuuguuuuguuuuguuuuuuugagacggaguuucccucuuguugcccaagguggagugcaauggugcgaucucagcccacugcagccuccaccuccuggguucaagcaauuguccugcuucagccucccgaguaguugggauuauaggugcacaaccaccacgccuggcuaauuuuuuguauuuuuaguagaaaugggauuucaccauguuagccaggcuggucucgaacuccugaccucaggugauccaccuccuuggccucccaaagugcugggauuacaggugugugccacugugcccggccaacuuucaauucuuuagagcugacuaugagaggagccagcaguauagccacagcaccaacgaaugaggaagagcaaaauacugcaugacagcuuugcuaagaauucuuucacuuuuuuugucuaucagccaggagcuagcaacuuggcuuauuuggaaauuuuaaguguacauauccugucuccuuaaauccuuuacagauuuaaagugcagucuaccugagggcucugugaccauguaagaaagcuuuuucuuucuuuuuuuuucucugagacagaguguugcucugucgcccaggcuggagugcaguggugugaucuuggcucacugcaaccucugccuccuggguucaagcaauuuuccugccucagcuuccugaguagcugggacuacaggcagcaccaccaugcccggcugaguuuuguauuuuuaguagagacaggguuucaccauguuggccaggcuggucuugaacuccugaccucgugauccgccugccucagccucccaaagugcugggauuacaugcgugagccauuguguccggccuuuuuuuuuuuuuuuuuuuuuuuuugagacagagucucgcucuguugcccaggcuggagugcaguggugugaccucagcuuacugcaaccuccgcuuccuggauucaagugauucuccugccucagccucccaaguaggugggauuacaggcacccaccaccgugccuggcuaauuuuuguauuuuuaguagagacaggaguuucaccuuguuuaguagagacaggcuggucucgaacuccugaccucaggugauccgccugccuugaccucccaaagcgcugggauuacaggcaugagccacugugccuggccagaaagccuucuuuauugagcuugguggcagcccaaaacugauucuuuaagggugucaggacuuaacaccuccugugacuuagccgcaccuccucuccuuugacuuucauuccaccuccuuccaggaucgcaaggucccuauuuguccuggaaacggcuucaagguagucuagggugccguuugccgggggaggaaggugcucugguugauagagucgccuggccgcacacucuuuuuggcacauaacaacguucuacagagccgggguggagcgugcuuucucauaagugcucugcagguuuggagagagaggauaugaggagcacccuuuucuguuuuuuuuaacccaaagauuagcuuggaaaaggggcagaggggugcacuggaacucaggucugccuaagcagcacagcagaccaaggucuagagaugacaucugcucgcagcuguucuuccaccagcccgcauccuggaaaggggucuuguggcacacaagaguucacauccuucccucgugaaauaaggacuuuguguucaucaucucuuguaagaagcagagcagaaagcacagaauuaagaaauaaaagggaagugggugccuauauaaagggaagugaaaauggguugcugucccaugcaaagacccuggaaagcuguuaacagcucagcuugucacuuucaccaucugcauuuguccagagugauugagauuugcguuguuguggagagaaaggcgccuguugcacaauggagugagauugccacugcugucaggaccucuguguuuggcuugacacuuuuugaguucucagcagucucgggacccucaagaguggaagcauuuuuggauguuaaaugcugggguuaauugaaguuaagagcuuguuuuacugggcaugguggcucacaccuauaaucccgacacuuugggaggccaaggcgggcagaucacuugaguccaggaguuugagaccagccugggcaacauagcaaaaccccaucucuacaaaaaauacaaagcugggcguagugguguaugccuguagucccagcuccuuaggaggcugaggggagcagaucucuugagcccaggaggcagaguuugcagugagccaugaucgugccacugcacuccagccugggcaacagagugagauccugucuuaaaacaaacaaaaaaaacaaacuuguuuucauuuagacucuuccuggcguuggggaccuauuggaauagguuuagugugaacugagagcuagaaguguuagaggagagagggagggaacagagcccgcuggagcgagugcccuuccuaccuuaucacugcaugccaggcaugugccggcgcuuugguccuccucauuucauucuugacugccaccugagacacgaugguuacuagcuccauuuuauagguggugaaacugaggcuuggggaaggucagaccccaagggugccauuuagucaguggcagagccagauccaaaugcaggucuccugacuccaagugcagggcucauuuuaucguccgguugcagcacgcuggcggccccuugagccccaaccuggauaccauaggggaggagcagagaagccaggaacaccacagcccugggccaaggugcggggcugaaagaacuucccagcgcucagccugggacuaguggaaugggcugggcccuggggcuggcagcgguggccccggggagccugggaaugaguagggagcacagggaggugugggagggccugggaaccaugaaaaggagggcgggugcagggaagucgccugcuagugaaguggcgagggggcccugugggacuccagggaauggccacggcagguuguccuccaggaguugagagccacuggacauggcagcugccuguguucucagccaccacaguaaccaaagaaaucuugguuuuaaaauucaaguugccauggaaacgcucccauccucgacuuggcuuauuauuuaaaauaacaucucuacagcacaaagcccccggguacauccaaggacacugcugucugcccacgagacaugcuaaccucacaguguggaggcugugugggucacugacaugcauggccacgugagacgcugccuacccacgagucacggaaaaggggaagauuauuaagaaagucacuaggggccagguccaguggcucaugccuguaauccuagcacuuugggaagcugaggcaguuagaucccuugaagccaggaguucaagaccagccuggccaacauaacgaaacacggacuauacuacaaaaauuagccaaacgugguagcacaggccuguaaucccagcuacucaggaggcugaggcacaagaaucacuugaaccugggagguagagguuucagugagccaagauugcgccacuguacuccagcaugugccacagagcgagacucccaucucaaagucacuagggaggaagccucauuggugggaaggaagaccaaauuggaaaugcucugaggaaucauuaaaacaaauguccuuuuaucaguuugguggcucagggccuuuaguaauacugccaacuauuuuuccuagaagaaacaaaacugaaauaauaggaacauacucacuuuuuuuuuuuucuuaaaaguaaggguauguugugaaaaaaagucuccccaccguagugaccgacugccgugcaucuuccuuggcauuuugcauguaguggcaggaguguuccuacauguguagauugcugagagggucagaugcuuaugguccucagucacccacagcuugcuuuuuccccacuuaacauugggacuuggggcauuuuuacucuguuaauacaauagaauucacuucaacuaguugguuuuuuacuuuuauuuuauuauuauuauuuuuagaugaagucucaaucugucguccaggcuggagugcagccucugccuccuggguucaagugauucuacugccucagccucccaaguagcugggauuacaggcaugcgccaccacgccuggcuaauuuuuuguauuuaguagauacaggguuucaccaccuuagucaggcuggucucuaacuccugaccucaggugauccaaccgccucggcuacaggcaugcgccaccgugccccaccaacuaauugcuuuuuuaaugguugcuucauauucuauuuaaccacuuaccguaauuuaacaguuacucuguuauuggauacuugauucauuuccaggacaugcagauuuagaaacuggugggcguugcugguugaugucucggugguugugcccacccaccccaggcacucauuaucaugccuuccguuuccccacuuccuaagcccugcaagaagugccaaacuguccagcccuugccaaucugauacaugcugaauaccuccuugauuuuaucugcaccucccugagguugaacuuauuuuacuuuauuuuauuuuauuuuugaggcagagucucacugucacccaggcaggaaugcaguggugaaaucuuggcucacugcaaucuccaccuccuggguucaagugaguugaagcaauucuccugucucagccucccaaguagcugcgauuacaggcaccugccaccacaccuggguaauuuuuguauuuuuaguggagacgggguuucaccauguuggccaggcuggucucaaacuccugaccucaggcgauccaccugccucagccucccaaagugcugagauuacaagcuugagccaccaugccgguugaacuuauuuuuaucuguguuggccauuuguaguuuuucuauuaugcugguuccauuuuucugacuuugaagagccuuuuguggaaacgaagccuaaaguauaugugaguacugcuuuguuucgucaguuuuuguuuuaaagagacuuuucaguguaaugcaagcauuuucccuugaaggcuguguuuccugucaauccuaagcuuuccuccagcauuaccuuuuuaaaaaacuuuauuuucuauauugauggggucucacaauguuguccaggcugguguugaacaccuggccucaagugauccacuugccuuggccucccaaaguacugggauuauaggcaucagccaccgcacccagccuguuuuucaaagggcauugauuuuuuucauaaaacuuuuuaaauuaagaucugugggccuggugcggugccucacgccugucaucgcagcacuuugggaggcugagucagguggaucacgaggucaggcguucgagaccagccuggccaaaauggugaaacccugucuuuacuaaaaauaugaaaauuagcugggcaugauggcacaugccuguaaucccgcugcucgggaagcugagguaggagaauagcuugaacccaggaggcagagguugcagugagccgagaucaugccauugcacuccagccugggggacagaguaagacuccgucucaaaaaaacaaaacaauucuguguugcaugugguacuuuuugugugugaggaguccagugugaagauucagacuucaggcagccacuuguacaagcacuguccuguuuccucucuggccucaccuagguaacgcugauuccuccacggaggaugugcuucugagugguccguugggugcugugcugaugagcaucacccagcauuuuacgacacaugugcugccccagagggcugggcucccgucagagcucuuuuccacuggcugggugcgguggcucacaccuguaaucccagcacuuugggaggcugaggccaguggaucaccugaggucaggaguucgagaccagccuggcuaacaugguaaaaccccaucucuacuaaaaauacagaaauuaggugcgugugguggcgcacaccuguaaucccagcuacuugggaggcuaagaaccugggagguggaggcugcagugagccaagauugugccacuguaccccagacugggugacauggcccacagaccaagacccugucucaaaaaaaaaaaaaaagcuuuuuuccagagccaucuugcuguccucauauauuuauucuccuagaugaauuguugcuuaagcaacaaugaaguuuaaauuguucuucagauagaaccccuaggugccaggcaguuuguuaagcacugacaccgcaguccugugacuuucaugacgaccugugaccugugggagguagaacaccucacccacccgugggagccccuggagugacugacaggaaccccugccucacccagcuccccgcgccgcggcucuccccagcccuggaugcaggcgcccaggagacauguauugcuuuuguugagcugcucacuuaggagggugacucagaguucaagcuggaaagcacuggcuugugacucaugagccagugcaagaucaaacggcuggggcaucgaggugagaguuuuccuucucagaagccucaucuccgcagccggaagcagagcccuuggcugacuggaaaaaccagagaggccccgggaguggguggauggccagcccagccccaccucucagccucaaccuccaccagcccacaccgagcuuguuugucuguguccugucgaaacuaggacuccuggauuguaacuuuucuuacauuucccuguccccuggguccuccacuuaggguguaaucacacagacaggcucuuaacuguuucauaucacucacuugggaaagugucucaagcuguucuacaaauccaugcaaaggccguuuaaaaauagcagcgaaggcccuggacucggucucguccagcacagccccuuggcucucucucugggcucuggccgccuggcccccggggacccacacgaggucauggcgugcuucgggcaggggggcggggaucccauagacaccucagcuccuuaagaguucuccgccugggccaggacgagcauggggguccccacugaugcccgagacggugccccugugugugugagcccucgacccacauaacagagagguguccugaugcccucuguccucuccagguggaucuaggauccggcuuccaacauguggcagcucugggccucccucugcugccugcugguguuggccaaugcccggagcaggcccucuuuccauccccugucggaugagcuggucaacuaugucaacaaacggaauaccacguggcagguaggcuguggggcugcguccuauguauguccccucccaggucggucugugcacacugacuccaggaaugggaagccagcccucacuguggcccacagaacauuguccuggacuguugaaaaauggcccugacccugagucaugucggcucuggaccacgccucccuccuuugucccauaccccacgugugugcaugagugugugugcauguguaugaauauaugguugugugcacguggaggugugugggggaguaagugagcuucggaaguguucaaaaccagcuagccccugugacgcccgccguggcacaguggcaguuuaucagucccgccccugauucccuuugucucugcccagcccugacccucggacugagaaccaagaaugaggagugagccauguugagggcuggagagggucucugauugucagcaaaugggagcagaucaggggagacacccacucugcccgugugucacucugggcuguuccccagugccccccaacccuugggcccuugaauuggguagggucucugguuuucccuggguugggcuucgugugugggcagcgugcccauccaccgccaucccgggagacccuucagucagugggugacucucuuccaggccgggcacaacuucuacaacguggacaugagcuacuugaagaggcuaugugguaccuuccugggugggcccaagccaccccagaggugagugccugcuccucugcaccgcuguaaugugaguggcaggcguugguuuggggcagugggaagugggagagugaaggccucucuggcguccgcagggcucaugcugcccagggcugccgacaccgcuugagguacaguacuuguuucuuuucauuuuuauauuacuuucucuuuuuauuuuauuuuuuccuucucaaguuauuaguagagaagaugcuggugcuuuuuuuugguuuuugagagagucucacucugucacccaggcuggagugcaguggcacgaucuuggcucacugcaaacucugucucccggguucaagcgauucucaugccacagccuccugaguagcuggggccacaggcuugcaccaccgugcacggcuaauauuuguauuuuuaguagagacuggguuucgccauacuggccaggcucgucucgaacucuuggccucagcaagucaucugcccaacucggcaucccagagugcugggauuaccggcaugagccacccccaguguuuucuauugugcuucuccaaggugucucagccgcagaugugacagacaaggucuggguccccacuaugugggcagacucaaucuugaguaauuuaagggaaaucuaagaaaagccagaugaggccaaguaugguggcucacgccuguaaucccagcacuuugggaugccaaggcaagcggaucaccugaggucaggaguucgagaccagucugaccaacaugaugaaaccccgucucuacuaaaaauaaaaaacuuugccaggcgugguggcgggcgccuguaaucccagcuacucgggaggcugaggcuagagaaucgcaugaacccgggaggcagagguugcggugagcugagaugaugccacuucccacgugaggaugggguaguuaaguugcacgacacugccuucugcacaauggggaugauaugagaaaugaugagaggauccugggcagagguugaggcaggagagcagggcaagaaacacuaucuggacugaauaaacuuauuuaaaaaugaguuuauaauuuguggauaaauucaucuuaaaaaauccauuacauaagccuagaaagaagcguacaauaucgcaagucaggccaggugugguggaucaugccuguaaucccagcacuuugggaggccaaggcaggcagaucauuugaagccaggaguuuaagaccagccuggccaacauggugaaacccugucuuuacuaaaaauacaaaaauuagccgggugugguggugcaugccuguaaucccagcuacucaggaggcugaggcacgagaaucgauugaacucaggaggcagagguugcagugggcagagaucucgccacugcacuccagccuggaugacacagugaaauucuguccacucccacccucccgucccacccaaaaaaaaaaucaaaaggugcauugagcaacagaauuuccuuuuguuuuaugaaauuaccaaggacaccugucugcagccuucuucggcaugucuugugcucauuuccuuguuaggggaguguggcccagccaaaguggccuuugcagggauuggggagggaguugugggaucagagcuuguaaugaagaccuuccuuuauccagaguuauguuuaccgaggaccugaagcugccugcaagcuucgaugcacgggaacaauggccacagugucccaccaucaaagagaucagagaccagggcuccuguggcuccugcuggguaaggcccugcuggcuggcggggaagcgcuggagagaaagugggagcaacacuggagagucuugggggauucgggguggggacaacucugacaaggcaaguuauagaaacuuucugagucccaguuuccaucaguacaaaaaucacaaucccucuggccaugaaugauggcgaggauuagguggaguggcgggcagagcauccagcagauugcaaguccacguguacagguggcgaagcagcucccuuucccugacaugcuggcccguccgcaaauaccaggagcucucacugcuacucugcuucaagaaagcaucccuuuagugucagugagcugucuuaauuuugucauuuaauugugguaaaauacacguaacagaaauguaauaaucuuagcaaucuucuuuuguuuucuuuuucuuucuuuuuuuuuuuuuuuuuuuuuuggagauggagucuugcucugucacccaggcuggagugcaguggugggauauuggcucacugcaaccucugccuccuggguucaagcaauucuccugccucagucuccccaguagcuaagacuacaggcaugugccaccacgcccagcuaauuuuuguauuuuuaguagagaugggguuuugccauguuggacagccuggucucaaacgccucaccuguugaucugccuuccucggccucgcaaaaugcugggauuacaggcgugagccaccgugcccagcaacuauuuucaaguguacaguucuguagcauuaaguacauucacaguguugcucagccaccaccaccaucugucccccgaacucuuuuucagcucgcaagacagaaacucuguccccauuaacaccaauauuguagccccugguaagccccacucuacuuucugucucuaugaauuugacuccuagggaccucauacaaguggaucacaacaguauuuauuuucugggugagcuguguuuuuuguuaagaaaaaaacacagccagguacgguagcucacgccuguaaucucaacacuuugggaggcugaggcaggcggaucaccugaggucaggaguuugagaccaaccuggccaacauggugaaacccugucucuacuaaaaagacaaaacuuagcugggccugguggcaggcaccuauaaucccagcuacuauagaggcugaggcaggagaauugcuugaacccaggaggcguagguugcagugagcugagauugcgccacugcauuccagccugggcaacaaaagugaaacuccgccuccaggaaaaaaaaaaaaaaccacacacacacauacaaacuaauacuacacauuuugcagauuucagaaaugaacccaguuuccaggcagagguucacgggggugcuucucuugcuuuaaaagcugaguugggcaaaucguugaggcaggagaguggggcaaguggcucaucacgccucuaaucccagcacuuugggaggccaaggugggcaaaucacuugaacccgggaguucaagaccagucuggccaacguagcaagaccccauuucuaccaaagaaaauaaaagcugaguuugagccccaggagcguccccugguguugagagaucaguugccuacaaggucugaggugccccuguggcccuuugaggggacugcugcagagggcccagcccggacauggcagccucacccgguggggcucguuccugcaggccuucggggcuguggaagccaucucugaccggaucugcauccacaccaaugcgcacgucagcguggaggugucggcggaggaccugcucacaugcuguggcagcauguguggggacgggugagucaggcugugcuuccacagcggguuuagugcugagagacccugggccccagcuucucaguggaggggacuuugaggacuuccugggacugcugcgagucagaaguguuucggggagacuccgagagucuggcaggcagggccuggcaaggcugcugcuuccugggaggugccugaaccaaggcuggcccggcagagcugucugagggguggcaucccagcaaaacagucaguuucagaaaaugugguggaaugucuggccccuggucugguuugugucaucgcauguuccuuuuuccugcuuggggaaccaguuuggggcauuuccuuauguguaguuagcggggauggcuccaccuuaacaacaaggugguggcacagaacuuucugcuccagcugccugcagccucgccuugguuccgcaguagcgguguucacuggcggcugcagauccgaaaugccugagggcuuaaaaaaaugcaugggcuucuccccuaacuaguuaaaugggaaucacuggcgauucucauuucagagaacuggugguguuuuuaaguaccuuagggaaguuuagcgucugcucaguugagaaucaguguucuacccggaagggcacucguagccuggucugguauggacaugaacaggagagccuccugucuucucccggaucuuugugggcagggguggggcuggcgguuauucccugcaagcugugcuuaucuagggagcgucccuuggaggguuuggggucugggaggucugcucgcaccacuugcugcagcuggggguggguccacgaguggccucgggcacuuggguagcacacaguggucuggagagcugguggugcuucucucagagguuuucauuagaggcugucuuuucagcuguaaugguggcuauccugcugaagcuuggaacuucuggacaagaaaaggccugguuucugguggccucuaugaaucccauguagguaaguguguccccuuggccacuuucuggccagauggauuguuugagcaauuaaccaucauggcuuuauuugccuuuauaaacuggggguugagacagaggggcugcugagaggugcuagccaggugcacaggccucuggcaggaccugccuggcguccaugcugcaggcacgaggcuugccuugccccaggucuucuccgugggggcuguagguugacuccgcuuucucccgcgucccaucagggugcagaccguacuccaucccucccugugagcaccacgucaacggcucccggcccccaugcacgggggagggagauacccccaaguguagcaagaucugugagccuggcuacagcccgaccuacaaacaggacaagcacuacgguaaggggccuggggccuggccacggcgcacguggaggcuggggagcugcugcaucccuccucacgcugcagcgaagaggucagggcugaggagccuuggggucccggaacucuaggauagaggagggggagugaugcccucuugccaggagaagcagcacacucuccacuuucugccuguuccacccugaacucagccucagcccuuccaaacuggaagggaccaaagcccuccuuuuacaagggaguggcguguccuggagucuugagguauccuggccucuuccggggccucgugcucauugcuccguucucccauuucugagcuuccagccccagcccuguccuuaguucuucaggggagccuuccuugagcuccccuggcagggcaaguccccuuagaugcagucuuccccuggaggccaccagaaaucagugacuggcugaccguggcgugccacgaggcacggucacugcccuccccaaccccgagcucgguucauuuuccaggauacaauuccuacagcgucuccaauagcgagaaggacaucauggccgagaucuacaaaaacggccccguggagggagcuuucucuguguauucggacuuccugcucuacaagucaggugcgugcugauggcugauggcaauagagggugggggucgggaggggagccugggugccaggaugguucauguugaccaauagggcuggauugggcaggcaggugaggggcuggggaagagggcuguguggggccuuccauauaggcucacuccucuguggaccagccuggcaccugacugucuuuguccagguguugugccaacacacacaauuccagaggccucucccagagccucugggcuaguuccuucccauccauuagcguccagcucauacauguucucugugggaacgccccccucccugguggcuggccacgccugcccucgccuuccuggcuuugcauugcuuuaccagcauguuucuguuauaauggcaggccguucguguuugcacuggcugacacauuuucuucaucuuucucuuugcaaaggccuagaucgugccucacaccaguggaugaacacacagggaggaccuugcccuggguagugccauagggacuccaaccaaggaaucuggacaguccccauccccaaguccugucuuagaaaucccuugcuccagaugaacagucuuugcugacugcaucuaucccauuaauauuuugcuagauuggaaacuuguaaaacaacaguuugacaaaggaagaugauucuggcaagaaaaaguuucugugaagauggcacuucuuagcauaguccucgcccuuauuauuaaaagaugcauuuccacuuugacagugauuuccccacccgagagccugguugggcagcccugagccccuuagccaguaucuuucccaucagcuagcauuagcugccaccaguccucccuucuccucccucaccucuucaggguguaccuggagcagcuauuaaaacucuuuaagccguguaacgcuuuugacaaacccuuacuuacauggaaucccaguauaaagaacagaugaaucagucaucuagcauuaaauguuuuaucaauuagaauguauuagaaauucuauuuuuaaagccaacaagcacauuuuguaggaaucuauuucaauauuuacucaacaacuuugaguguguugggccuucaaaaauauauuuaauuccccaguauugugggacccccccuggagccuccugguggagcagcagguucccucuggaagcuguuucuccuucccggagcaugaccagcugaguguggggggugcuguggggcgugggacaguggcccggucucggucucagccaguucuucccuuuucaggaguguaccaacacgucaccggagagaugauggguggccaugccauccgcauccugggcuggggaguggagaauggcacacccuacuggcugguugccaacuccuggaacacugacuggggugacaauggugaguggcugcccccuuccugccaagaacagugaauugugagccacaccccguggccaucucggcuuucucuguucuacccaccgcacagccuuaaacccuggaccuacggccaggcugugagcuccuccuaagugccaggcagucaggaguucccuuuugcugugagggcagacucugagcagcuucagagccaacgccugcaacaguucccacagcaucgcgccagauccugugaugggaagggugaccgggcagggggcuugcccguggaggugugccccacggcuccagaagccuugugguguugaggacugugcuagugggccaacagcaggaguggccagggaugagugacuuaaggucuuuuaaggaugagucugacuauauugguugacccuugucacacuuuaaaagcaccuuacuuuuuauucccaggcuucuuuaaaauacucagaggacaggaucacuguggaaucgaaucagaagugguggcuggaauuccacgcaccgaucaguacugggaaaagaucuaaucugccgugggccugucgugccaguccugggggcgagaucgggguagaaaugcauuuuauucuuuaaguucacguaagauacaaguuucagacagggucugaaggacuggauuggccaaacaucagaccugucuuccaaggagaccaaguccuggcuacaucccagccugugguuacagugcagacaggccaugugagccaccgcugccagcacagagcguccuucccccuguagacuagugccguagggaguaccugcugccccagcugacuguggcccccuccgugauccauccaucuccagggagcaagacagagacgcaggaauggaaagcggaguuccuaacaggaugaaaguucccccaucaguucccccaguaccuccaagcaaguagcuuuccacauuugucacagaaaucagaggagagacgguguugggagcccuuuggagaacgccagucucccaggcccccugcaucuaucgaguuugcaaugucacaaccucucugaucuugugcucagcaugauucuuuaauagaaguuuuauuuuuucgugcacucugcuaaucaugugggugagccaguggaacagcgggagaccugugcuaguuuuacagauugccuccuuaugacgcggcucaaaaggaaaccaaguggucaggaguuguuucugacccacugaucucuacuaccacaaggaaaauaguuuaggagaaaccagcuuuuacuguuuuugaaaaauuacagcuucacccugucaaguuaacaaggaaugccugugccaauaaaaguuuucuccaacuugaagucuacucugaugggaucucagauccuuugucacugccuauagacuuguagcugcugucucucuuugucccugcagagaaucacguccuggaacugcauguucuugcgacucuugggacuucaucuuaacuucucgcugccccagccauguuuucaaccauggcaucccucccccaauuaguucccugucauccucgucaaccuucucuguaagugccugguaagcuugcccuugcuuaagaacucaaaacauagcugugcucuauuuuuuuguuguuguugugacugacagagugagauuccgucucccaggcuggagugcaguggcgccuucucagcucacugcaaccugcagccuccuagauucaagcgauucuccugcuucagccuuccgaguagcugggaugacaggcacucaccaauaugccuggguaauuuuuguauuuuuaaguacauacaggauuucaccauguuggccaggcuaguuucaaacucccggccucagguggucugccugccucagccucccaaaguguugggauuacaggcgugagccacugggcccugccuguauuuuuuaucagccacaaauccagcaacaagcugaggauucagcucauaaaacaggcuuggugucuuggugaucucacauaaccaagaugcuaccccguggggaaccacaucccccuggaugcccuccagccuugguuugggcuggagucagggccuguauacaguauuuugaauuuguaugccacugguuugcauugcuggucaggaacucuagugcuuugcauagcccugguuuagaaacauguuauagcaguucuugguauagagcaaacuagaagaaccagcaaucauuccacuguccugccaagguacaccucaguacuccccuucccaacugaagugguaugaggcuagcucuuuccaaaagcauucaaguuuggcuucugaugugacucagaauuuaggaaccagaugcuagaucaaauaagcucugaaaaucugaggaacauuguaggaaagguuuguuaagcaucucuuaagugccaugaugagcauaacagccggccgucguggcucacgccuguaaucccagcacuuugggaggccaaggugggaggaugacaaggucaggaguucaagaccagccuggccaacaugcugaaaccucaccucuacuaaaaauacaaaaauuagcugggcaugguggcacaugccuguaaucccagcuacuugggaggcugaggcaggagaaucgcuugaacccgggaggcggagguugcagugagccaagacagugccagugcacuccagccucggugacagcgcaaggcuccgucucaauaauuaaaaaaaaaaaaaaaaaaaaaaaggccgggcgcaguggcucaagccuguaaucccagcacuuugggaggcugaggcgggcagaucaccugaggucaggaguuuugagaucagccuuggcaacacggugaaaccccaucucuacuaaaaauacaaaauuagccaagcaugcuggcacaugccuguaaucccagcuacucgggaggcugagguacgagaaucgcuugaaccugggaggcagaggaugcagugagccgagaucacgccauugcacuccagccugggggacaagagugaaucugugucucaccaaaaaaaaaaagaaaaagaaagaugcuuaacaaagguuaccauaagccacaaauucauaaccacuuauccuuccaguuucaaguagaauauauucauaaccucaauaaaguucucccugcucccaa

SEQ ID NO: 192503 - RNA, 25613 nt, Homo sapiens
uugggagcagggagaacuuuauugagguuaugaauauauucuacuugaaacuggaaggauaagugguuaugaauuuguggcuuaugguaaccuuuguuaagcaucuuucuuuuucuuuuuuuuuuuggugagacacagauucacucuugucccccaggcuggagugcaauggcgugaucucggcucacugcauccucugccucccagguucaagcgauucucguaccucagccucccgaguagcugggauuacaggcaugugccagcaugcuuggcuaauuuuguauuuuuaguagagaugggguuucaccguguugccaaggcugaucucaaaacuccugaccucaggugaucugcccgccucagccucccaaagugcugggauuacaggcuugagccacugcgcccggccuuuuuuuuuuuuuuuuuuuuuuuaauuauugagacggagccuugcgcugucaccgaggcuggagugcacuggcacugucuuggcucacugcaaccuccgccucccggguucaagcgauucuccugccucagccucccaaguagcugggauuacaggcaugugccaccaugcccagcuaauuuuuguauuuuuaguagaggugagguuucagcauguuggccaggcuggucuugaacuccugaccuugucauccucccaccuuggccucccaaagugcugggauuacaggcgugagccacgacggccggcuguuaugcucaucauggcacuuaagagaugcuuaacaaaccuuuccuacaauguuccucagauuuucagagcuuauuugaucuagcaucugguuccuaaauucugagucacaucagaagccaaacuugaaugcuuuuggaaagagcuagccucauaccacuucaguugggaaggggaguacugagguguaccuuggcaggacaguggaaugauugcugguucuucuaguuugcucuauaccaagaacugcuauaacauguuucuaaaccagggcuaugcaaagcacuagaguuccugaccagcaaugcaaaccaguggcauacaaauucaaaauacuguauacaggcccugacuccagcccaaaccaaggcuggagggcauccagggggaugugguuccccacgggguagcaucuugguuaugugagaucaccaagacaccaagccuguuuuaugagcugaauccucagcuuguugcuggauuuguggcugauaaaaaauacaggcagggcccaguggcucacgccuguaaucccaacacuuugggaggcugaggcaggcagaccaccugaggccgggaguuugaaacuagccuggccaacauggugaaauccuguauguacuuaaaaauacaaaaauuacccaggcauauuggugagugccugucaucccagcuacucggaaggcugaagcaggagaaucgcuugaaucuaggaggcugcagguugcagugagcugagaaggcgccacugcacuccagccugggagacggaaucucacucugucagucacaacaacaacaaaaaaauagagcacagcuauguuuugaguucuuaagcaagggcaagcuuaccaggcacuuacagagaagguugacgaggaugacagggaacuaauugggggagggaugccaugguugaaaacauggcuggggcagcgagaaguuaagaugaagucccaagagucgcaagaacaugcaguuccaggacgugauucucugcagggacaaagagagacagcagcuacaagucuauaggcagugacaaaggaucugagaucccaucagaguagacuucaaguuggagaaaacuuuuauuggcacaggcauuccuuguuaacuugacagggugaagcuguaauuuuucaaaaacaguaaaagcugguuucuccuaaacuauuuuccuugugguaguagagaucagugggucagaaacaacuccugaccacuugguuuccuuuugagccgcgucauaaggaggcaaucuguaaaacuagcacaggucucccgcuguuccacuggcucacccacaugauuagcagagugcacgaaaaaauaaaacuucuauuaaagaaucaugcugagcacaagaucagagagguugugacauugcaaacucgauagaugcagggggccugggagacuggcguucuccaaagggcucccaacaccgucucuccucugauuucugugacaaauguggaaagcuacuugcuuggagguacugggggaacugaugggggaacuuucauccuguuaggaacuccgcuuuccauuccugcgucucugucuugcucccuggagauggauggaucacggagggggccacagucagcuggggcagcagguacucccuacggcacuagucuacagggggaaggacgcucugugcuggcagcgguggcucacauggccugucugcacuguaaccacaggcugggauguagccaggacuuggucuccuuggaagacaggucugauguuuggccaauccaguccuucagacccugucugaaacuuguaucuuacgugaacuuaaagaauaaaaugcauuucuaccccgaucucgcccccaggacuggcacgacaggcccacggcagauuagaucuuuucccaguacugaucggugcguggaauuccagccaccacuucugauucgauuccacagugauccuguccucugaguauuuuaaagaagccugggaauaaaaaguaaggugcuuuuaaagugugacaagggucaaccaauauagucagacucauccuuaaaagaccuuaagucacucaucccuggccacuccugcuguuggcccacuagcacaguccucaacaccacaaggcuucuggagccguggggcacaccuccacgggcaagcccccugcccggucacccuucccaucacaggaucuggcgcgaugcugugggaacuguugcaggcguuggcucugaagcugcucagagucugcccucacagcaaaagggaacuccugacugccuggcacuuaggaggagcucacagccuggccguagguccaggguuuaaggcugugcgguggguagaacagagaaagccgagauggccacgggguguggcucacaauucacuguucuuggcaggaagggggcagccacucaccauugucaccccagucaguguuccaggaguuggcaaccagccaguagggugugccauucuccacuccccagcccaggaugcggauggcauggccacccaucaucucuccggugacguguugguacacuccugaaaagggaagaacuggcugagaccgagaccgggccacugucccacgccccacagcaccccccacacucagcuggucaugcuccgggaaggagaaacagcuuccagagggaaccugcugcuccaccaggaggcuccagggggggucccacaauacuggggaauuaaauauauuuuugaaggcccaacacacucaaaguuguugaguaaauauugaaauagauuccuacaaaaugugcuuguuggcuuuaaaaauagaauuucuaauacauucuaauugauaaaacauuuaaugcuagaugacugauucaucuguucuuuauacugggauuccauguaaguaaggguuugucaaaagcguuacacggcuuaaagaguuuuaauagcugcuccagguacacccugaagaggugagggaggagaagggaggacugguggcagcuaaugcuagcugaugggaaagauacuggcuaaggggcucagggcugcccaaccaggcucucggguggggaaaucacugucaaaguggaaaugcaucuuuuaauaauaagggcgaggacuaugcuaagaagugccaucuucacagaaacuuuuucuugccagaaucaucuuccuuugucaaacuguuguuuuacaaguuuccaaucuagcaaaauauuaaugggauagaugcagucagcaaagacuguucaucuggagcaagggauuucuaagacaggacuuggggauggggacuguccagauuccuugguuggagucccuauggcacuacccagggcaagguccucccuguguguucauccacuggugugaggcacgaucuaggccuuugcaaagagaaagaugaagaaaaugugucagccagugcaaacacgaacggccugccauuauaacagaaacaugcugguaaagcaaugcaaagccaggaaggcgagggcaggcguggccagccaccagggaggggggcguucccacagagaacauguaugagcuggacgcuaauggaugggaaggaacuagcccagaggcucugggagaggccucuggaauuguguguguuggcacaacaccuggacaaagacagucaggugccaggcugguccacagaggagugagccuauauggaaggccccacacagcccucuuccccagccccucaccugccugcccaauccagcccuauuggucaacaugaaccauccuggcacccaggcuccccucccgacccccacccucuauugccaucagccaucagcacgcaccugacuuguagagcaggaaguccgaauacacagagaaagcucccuccacggggccguuuuuguagaucucggccaugauguccuucucgcuauuggagacgcuguaggaauuguauccuggaaaaugaaccgagcucgggguuggggagggcagugaccgugccucguggcacgccacggucagccagucacugauuucugguggccuccaggggaagacugcaucuaaggggacuugcccugccaggggagcucaaggaaggcuccccugaagaacuaaggacagggcuggggcuggaagcucagaaaugggagaacggagcaaugagcacgaggccccggaagaggccaggauaccucaagacuccaggacacgccacucccuuguaaaaggagggcuuuggucccuuccaguuuggaagggcugaggcugaguucaggguggaacaggcagaaaguggagagugugcugcuucuccuggcaagagggcaucacucccccuccucuauccuagaguuccgggaccccaaggcuccucagcccugaccucuucgcugcagcgugaggagggaugcagcagcuccccagccuccacgugcgccguggccaggccccaggccccuuaccguagugcuuguccuguuuguaggucgggcuguagccaggcucacagaucuugcuacacuuggggguaucucccucccccgugcaugggggccgggagccguugacguggugcucacagggagggauggaguacggucugcacccugaugggacgcgggagaaagcggagucaaccuacagcccccacggagaagaccuggggcaaggcaagccucgugccugcagcauggacgccaggcagguccugccagaggccugugcaccuggcuagcaccucucagcagccccucugucucaacccccaguuuauaaaggcaaauaaagccaugaugguuaauugcucaaacaauccaucuggccagaaaguggccaaggggacacacuuaccuacaugggauucauagaggccaccagaaaccaggccuuuucuuguccagaaguuccaagcuucagcaggauagccaccauuacagcugaaaagacagccucuaaugaaaaccucugagagaagcaccaccagcucuccagaccacugugugcuacccaagugcccgaggccacucguggacccacccccagcugcagcaaguggugcgagcagaccucccagaccccaaacccuccaagggacgcucccuagauaagcacagcuugcagggaauaaccgccagccccaccccugcccacaaagauccgggagaagacaggaggcucuccuguucauguccauaccagaccaggcuacgagugcccuuccggguagaacacugauucucaacugagcagacgcuaaacuucccuaagguacuuaaaaacaccaccaguucucugaaaugagaaucgccagugauucccauuuaacuaguuaggggagaagcccaugcauuuuuuuaagcccucaggcauuucggaucugcagccgccagugaacaccgcuacugcggaaccaaggcgaggcugcaggcagcuggagcagaaaguucugugccaccaccuuguuguuaagguggagccauccccgcuaacuacacauaaggaaaugccccaaacugguuccccaagcaggaaaaaggaacaugcgaugacacaaaccagaccaggggccagacauuccaccacauuuucugaaacugacuguuuugcugggaugccaccccucagacagcucugccgggccagccuugguucaggcaccucccaggaagcagcagccuugccaggcccugccugccagacucucggagucuccccgaaacacuucugacucgcagcagucccaggaaguccucaaaguccccuccacugagaagcuggggcccagggucucucagcacuaaacccgcuguggaagcacagccugacucacccguccccacacaugcugccacagcaugugagcagguccuccgccgacaccuccacgcugacgugcgcauugguguggaugcagauccggucagagauggcuuccacagccccgaaggccugcaggaacgagccccaccgggugaggcugccauguccgggcugggcccucugcagcaguccccucaaagggccacaggggcaccucagaccuuguaggcaacugaucucucaacaccaggggacgcuccuggggcucaaacucagcuuuuauuuucuuugguagaaauggggucuugcuacguuggccagacuggucuugaacucccggguucaagugauuugcccaccuuggccucccaaagugcugggauuagaggcgugaugagccacuugccccacucuccugccucaacgauuugcccaacucagcuuuuaaagcaagagaagcacccccgugaaccucugccuggaaacuggguucauuucugaaaucugcaaaauguguaguauuaguuuguaugugugugugugguuuuuuuuuuuuuuccuggaggcggaguuucacuuuuguugcccaggcuggaaugcaguggcgcaaucucagcucacugcaaccuacgccuccuggguucaagcaauucuccugccucagccucuauaguagcugggauuauaggugccugccaccaggcccagcuaaguuuugucuuuuuaguagagacaggguuucaccauguuggccagguuggucucaaacuccugaccucaggugauccgccugccucagccucccaaaguguugagauuacaggcgugagcuaccguaccuggcuguguuuuuuucuuaacaaaaaacacagcucacccagaaaauaaauacuguugugauccacuuguaugaggucccuaggagucaaauucauagagacagaaaguagaguggggcuuaccaggggcuacaauauugguguuaauggggacagaguuucugucuugcgagcugaaaaagaguucgggggacagaugguggugguggcugagcaacacugugaauguacuuaaugcuacagaacuguacacuugaaaauaguugcugggcacgguggcucacgccuguaaucccagcauuuugcgaggccgaggaaggcagaucaacaggugaggcguuugagaccaggcuguccaacauggcaaaaccccaucucuacuaaaaauacaaaaauuagcugggcgugguggcacaugccuguagucuuagcuacuggggagacugaggcaggagaauugcuugaacccaggaggcagagguugcagugagccaauaucccaccacugcacuccagccugggugacagagcaagacuccaucuccaaaaaaaaaaaaaaaaaaaaaagaaagaaaaagaaaacaaaagaagauugcuaagauuauuacauuucuguuacguguauuuuaccacaauuaaaugacaaaauuaagacagcucacugacacuaaagggaugcuuucuugaagcagaguagcagugagagcuccugguauuugcggacgggccagcaugucagggaaagggagcugcuucgccaccuguacacguggacuugcaaucugcuggaugcucugcccgccacuccaccuaauccucgccaucauucauggccagagggauugugauuuuuguacugauggaaacugggacucagaaaguuucuauaacuugccuugucagaguuguccccaccccgaaucccccaagacucuccaguguugcucccacuuucucuccagcgcuuccccgccagccagcagggccuuacccagcaggagccacaggagcccuggucucugaucucuuugauggugggacacuguggccauuguucccgugcaucgaagcuugcaggcagcuucagguccucgguaaacauaacucuggauaaaggaaggucuucauuacaagcucugaucccacaacucccuccccaaucccugcaaaggccacuuuggcugggccacacuccccuaacaaggaaaugagcacaagacaugccgaagaaggcugcagacagguguccuugguaauuucauaaaacaaaaggaaauucuguugcucaaugcaccuuuugauuuuuuuuuugggugggacgggagggugggaguggacagaauuucacugugucauccaggcuggagugcaguggcgagaucucugcccacugcaaccucugccuccugaguucaaucgauucucgugccucagccuccugaguagcugggauuacaggcaugcaccaccacacccggcuaauuuuuguauuuuuaguaaagacaggguuucaccauguuggccaggcuggucuuaaacuccuggcuucaaaugaucugccugccuuggccucccaaagugcugggauuacaggcaugauccaccacaccuggccugacuugcgauauuguacgcuucuuucuaggcuuauguaauggauuuuuuaagaugaauuuauccacaaauuauaaacucauuuuuaaauaaguuuauucaguccagauaguguuucuugcccugcucuccugccucaaccucugcccaggauccucucaucauuucucauaucauccccauugugcagaaggcagugucgugcaacuuaacuaccccauccucacgugggaaguggcaucaucucagcucaccgcaaccucugccucccggguucaugcgauucucuagccucagccucccgaguagcugggauuacaggcgcccgccaccacgccuggcaaaguuuuuuauuuuuaguagagacgggguuucaucauguuggucagacuggucucgaacuccugaccucaggugauccgcuugccuuggcaucccaaagugcugggauuacaggcgugagccaccauacuuggccucaucuggcuuuucuuagauuucccuuaaauuacucaagauugagucugcccacauaguggggacccagaccuugucugucacaucugcggcugagacaccuuggagaagcacaauagaaaacacuggggguggcucaugccgguaaucccagcacucugggaugccgaguugggcagaugacuugcugaggccaagaguucgagacgagccuggccaguauggcgaaacccagucucuacuaaaaauacaaauauuagccgugcacgguggugcaagccuguggccccagcuacucaggaggcuguggcaugagaaucgcuugaacccgggagacagaguuugcagugagccaagaucgugccacugcacuccagccugggugacagagugagacucucucaaaaaccaaaaaaaagcaccagcaucuucucuacuaauaacuugagaaggaaaaaauaaaauaaaaagagaaaguaauauaaaaaugaaaagaaacaaguacuguaccucaagcggugucggcagcccugggcagcaugagcccugcggacgccagagaggccuucacucucccacuucccacugccccaaaccaacgccugccacucacauuacagcggugcagaggagcaggcacucaccucugggguggcuugggcccacccaggaagguaccacauagccucuucaaguagcucauguccacguuguagaaguugugcccggccuggaagagagucacccacugacugaagggucucccgggauggcgguggaugggcacgcugcccacacacgaagcccaacccagggaaaaccagagacccuacccaauucaagggcccaaggguuggggggcacuggggaacagcccagagugacacacgggcagagugggugucuccccugaucugcucccauuugcugacaaucagagacccucuccagcccucaacauggcucacuccucauucuugguucucaguccgagggucagggcugggcagagacaaagggaaucaggggcgggacugauaaacugccacugugccacggcgggcgucacaggggcuagcugguuuugaacacuuccgaagcucacuuacucccccacacaccuccacgugcacacaaccauauauucauacacaugcacacacacucaugcacacacgugggguaugggacaaaggagggaggcgugguccagagccgacaugacucagggucagggccauuuuucaacaguccaggacaauguucugugggccacagugagggcuggcuucccauuccuggagucagugugcacagaccgaccugggaggggacauacauaggacgcagccccacagccuaccugccacgugguauuccguuuguugacauaguugaccagcucauccgacaggggauggaaagagggccugcuccgggcauuggccaacaccagcaggcagcagagggaggcccagagcugccacauguuggaagccggauccuagauccaccuggagaggacagagggcaucaggacaccucucuguuaugugggucgagggcucacacacacaggggcaccgucucgggcaucaguggggacccccaugcucguccuggcccaggcggagaacucuuaaggagcugaggugucuaugggauccccgccccccugcccgaagcacgccaugaccucguguggguccccgggggccaggcggccagagcccagagagagagccaaggggcugugcuggacgagaccgaguccagggccuucgcugcuauuuuuaaacggccuuugcauggauuuguagaacagcuugagacacuuucccaagugagugauaugaaacaguuaagagccugucugugugauuacacccuaaguggaggacccaggggacagggaaauguaagaaaaguuacaauccaggaguccuaguuucgacaggacacagacaaacaagcucggugugggcugguggagguugaggcugagagguggggcugggcuggccauccacccacucccggggccucucugguuuuuccagucagccaagggcucugcuuccggcugcggagaugaggcuucugagaaggaaaacucucaccucgaugccccagccguuugaucuugcacuggcucaugagucacaagccagugcuuuccagcuugaacucugagucacccuccuaagugagcagcucaacaaaagcaauacaugucuccugggcgccugcauccagggcuggggagagccgcggcgcggggagcugggugaggcagggguuccugucagucacuccaggggcucccacgggugggugagguguucuaccucccacaggucacaggucgucaugaaagucacaggacugcggugucagugcuuaacaaacugccuggcaccuagggguucuaucugaagaacaauuuaaacuucauuguugcuuaagcaacaauucaucuaggagaauaaauauaugaggacagcaagauggcucuggaaaaaagcuuuuuuuuuuuuuuugagacagggucuuggucugugggccaugucacccagucugggguacaguggcacaaucuuggcucacugcagccuccaccucccagguucuuagccucccaaguagcugggauuacaggugugcgccaccacacgcaccuaauuucuguauuuuuaguagagaugggguuuuaccauguuagccaggcuggucucgaacuccugaccucaggugauccacuggccucagccucccaaagugcugggauuacaggugugagccaccgcacccagccaguggaaaagagcucugacgggagcccagcccucuggggcagcacaugugucguaaaaugcugggugaugcucaucagcacagcacccaacggaccacucagaagcacauccuccguggaggaaucagcguuaccuaggugaggccagagaggaaacaggacagugcuuguacaaguggcugccugaagucugaaucuucacacuggacuccucacacacaaaaaguaccacaugcaacacagaauuguuuuguuuuuuugagacggagucuuacucugucccccaggcuggagugcaauggcaugaucucggcucacugcaaccucugccuccuggguucaagcuauucuccuaccucagcuucccgagcagcgggauuacaggcaugugccaucaugcccagcuaauuuucauauuuuuaguaaagacaggguuucaccauuuuggccaggcuggucucgaacgccugaccucgugauccaccugacucagccucccaaagugcugcgaugacaggcgugaggcaccgcaccaggcccacagaucuuaauuuaaaaaguuuuaugaaaaaaaucaaugcccuuugaaaaacaggcugggugcgguggcugaugccuauaaucccaguacuuugggaggccaaggcaaguggaucacuugaggccagguguucaacaccagccuggacaacauugugagaccccaucaauauagaaaauaaaguuuuuuaaaaagguaaugcuggaggaaagcuuaggauugacaggaaacacagccuucaagggaaaaugcuugcauuacacugaaaagucucuuuaaaacaaaaacugacgaaacaaagcaguacucacauauacuuuaggcuucguuuccacaaaaggcucuucaaagucagaaaaauggaaccagcauaauagaaaaacuacaaauggccaacacagauaaaaauaaguucaaccggcaugguggcucaagcuuguaaucucagcacuuugggaggcugaggcagguggaucgccugaggucaggaguuugagaccagccuggccaacauggugaaaccccgucuccacuaaaaauacaaaaauuacccaggugugguggcaggugccuguaaucgcagcuacuugggaggcugagacaggagaauugcuucaacucacuugaacccaggagguggagauugcagugagccaagauuucaccacugcauuccugccugggugacagugagacucugccucaaaaauaaaauaaaauaaaguaaaauaaguucaaccucagggaggugcagauaaaaucaaggagguauucagcauguaucagauuggcaagggcuggacaguuuggcacuucuugcagggcuuaggaaguggggaaacggaaggcaugauaaugagugccuggggugggugggcacaaccaccgagacaucaaccagcaacgcccaccaguuucuaaaucugcauguccuggaaaugaaucaaguauccaauaacagaguaacuguuaaauuacgguaagugguuaaauagaauaugaagcaaccauuaaaaaagcaauuaguugguggggcacgguggcgcaugccuguagccgaggcgguuggaucaccugaggucaggaguuagagaccagccugacuaagguggugaaacccuguaucuacuaaauacaaaaaauuagccaggcgugguggcgcaugccuguaaucccagcuacuugggaggcugaggcaguagaaucacuugaacccaggaggcagaggcugcacuccagccuggacgacagauugagacuucaucuaaaaauaauaauaauaaaauaaaaguaaaaaaccaacuaguugaagugaauucuauuguauuaacagaguaaaaaugccccaagucccaauguuaaguggggaaaaagcaagcugugggugacugaggaccauaagcaucugacccucucagcaaucuacacauguaggaacacuccugccacuacaugcaaaaugccaaggaagaugcacggcagucggucacuacgguggggagacuuuuuuucacaacauacccuuacuuuuaagaaaaaaaaaaaagugaguauguuccuauuauuucaguuuuguuucuucuaggaaaaauaguuggcaguauuacuaaaggcccugagccaccaaacugauaaaaggacauuuguuuuaaugauuccucagagcauuuccaauuuggucuuccuucccaccaaugaggcuuccucccuagugacuuugagaugggagucucgcucuguggcacaugcuggaguacaguggcgcaaucuuggcucacugaaaccucuaccucccagguucaagugauucuugugccucagccuccugaguagcugggauuacaggccugugcuaccacguuuggcuaauuuuuguaguauaguccguguuucguuauguuggccaggcuggucuugaacuccuggcuucaagggaucuaacugccucagcuucccaaagugcuaggauuacaggcaugagccacuggaccuggccccuagugacuuucuuaauaaucuuccccuuuuccgugacucguggguaggcagcgucucacguggccaugcaugucagugacccacacagccuccacacugugagguuagcaugucucgugggcagacagcaguguccuuggauguacccgggggcuuugugcuguagagauguuauuuuaaauaauaagccaagucgaggaugggagcguuuccauggcaacuugaauuuuaaaaccaagauuucuuugguuacugugguggcugagaacacaggcagcugccauguccaguggcucucaacuccuggaggacaaccugccguggccauucccuggagucccacagggcccccucgccacuucacuagcaggcgacuucccugcacccgcccuccuuuucaugguucccaggcccucccacaccucccugugcucccuacucauucccaggcuccccggggccaccgcugccagccccagggcccagcccauuccacuagucccaggcugagcgcugggaaguucuuucagccccgcaccuuggcccagggcugugguguuccuggcuucucugcuccuccccuaugguauccagguuggggcucaaggggccgccagcgugcugcaaccggacgauaaaaugagcccugcacuuggagucaggagaccugcauuuggaucuggcucugccacugacuaaauggcacccuuggggucugaccuuccccaagccucaguuucaccaccuauaaaauggagcuaguaaccaucgugucucagguggcagucaagaaugaaaugaggaggaccaaagcgccggcacaugccuggcaugcagugauaagguaggaagggcacucgcuccagcgggcucuguucccucccucucuccucuaacacuucuagcucucaguucacacuaaaccuauuccaauagguccccaacgccaggaagagucuaaaugaaaacaaguuuguuuuuuuuguuuguuuuaagacaggaucucacucuguugcccaggcuggagugcaguggcacgaucauggcucacugcaaacucugccuccugggcucaagagaucugcuccccucagccuccuaaggagcugggacuacaggcauacaccacuacgcccagcuuuguauuuuuuguagagaugggguuuugcuauguugcccaggcuggucucaaacuccuggacucaagugaucugcccgccuuggccucccaaagugucgggauuauaggugugagccaccaugcccaguaaaacaagcucuuaacuucaauuaaccccagcauuuaacauccaaaaaugcuuccacucuugagggucccgagacugcugagaacucaaaaagugucaagccaaacacagagguccugacagcaguggcaaucucacuccauugugcaacaggcgccuuucucuccacaacaacgcaaaucucaaucacucuggacaaaugcagauggugaaagugacaagcugagcuguuaacagcuuuccagggucuuugcaugggacagcaacccauuuucacuucccuuuauauaggcacccacuucccuuuuauuucuuaauucugugcuuucugcucugcuucuuacaagagaugaugaacacaaaguccuuauuucacgagggaaggaugugaacucuugugugccacaagaccccuuuccaggaugcgggcugguggaagaacagcugcgagcagaugucaucucuagaccuuggucugcugugcugcuuaggcagaccugaguuccagugcaccccucugccccuuuuccaagcuaaucuuuggguuaaaaaaaacagaaaagggugcuccucauauccucucucuccaaaccugcagagcacuuaugagaaagcacgcuccaccccggcucuguagaacguuguuaugugccaaaaagagugugcggccaggcgacucuaucaaccagagcaccuuccucccccggcaaacggcacccuagacuaccuugaagccguuuccaggacaaauagggaccuugcgauccuggaaggagguggaaugaaagucaaaggagaggaggugcggcuaagucacaggagguguuaaguccugacacccuuaaagaaucaguuuugggcugccaccaagcucaauaaagaaggcuuucuggccaggcacaguggcucaugccuguaaucccagcgcuuugggaggucaaggcaggcggaucaccugaggucaggaguucgagaccagccugucucuacuaaacaaggugaaacuccugucucuacuaaaaauacaaaaauuagccaggcacgguggugggugccuguaaucccaccuacuugggaggcugaggcaggagaaucacuugaauccaggaagcggagguugcaguaagcugaggucacaccacugcacuccagccugggcaacagagcgagacucugucucaaaaaaaaaaaaaaaaaaaaaaaaaggccggacacaauggcucacgcauguaaucccagcacuuugggaggcugaggcaggcggaucacgaggucaggaguucaagaccagccuggccaacauggugaaacccugucucuacuaaaaauacaaaacucagccgggcaugguggugcugccuguagucccagcuacucaggaagcugaggcaggaaaauugcuugaacccaggaggcagagguugcagugagccaagaucacaccacugcacuccagccugggcgacagagcaacacucugucucagagaaaaaaaaagaaagaaaaagcuuucuuacauggucacagagcccucagguagacugcacuuuaaaucuguaaaggauuuaaggagacaggauauguacacuuaaaauuuccaaauaagccaaguugcuagcuccuggcugauagacaaaaaaagugaaagaauucuuagcaaagcugucaugcaguauuuugcucuuccucauucguuggugcuguggcuauacugcuggcuccucucauagucagcucuaaagaauugaaaguuggccgggcacaguggcacacaccuguaaucccagcacuuugggaggccaaggagguggaucaccugaggucaggaguucgagaccagccuggcuaacauggugaaaucccauuucuacuaaaaauacaaaaaauuagccaggcguggugguugugcaccuauaaucccaacuacucgggaggcugaagcaggacaauugcuugaacccaggagguggaggcugcagugggcugagaucgcaccauugcacuccaccuugggcaacaagagggaaacuccgucucaaaaaaacaaaacaaaacaaaacaaaaacaaaagucaagugcuuacauuuugccagaagccacaaaugaagacugugccuuauaggccagcagagcggcuaagagcacgggaacaguggaaagguggggagacugugaaggcucaguaagaccuucccagaguacuuuguuucuuucucuucuauaaaaacuagucuuggcacucaccgcuaauaacggcaguugcuccugaaguuuugaccacuuaagugcaaccacaaaacaagacuucggcgaguuucaucuuccccuacuucaaccugccagacacaccucaaugcuggagcagcccugcacugggugggagugugcugaccucaacuaugcucuguugugacccagagaccuuuccuuuuugaguaugaaucacagccuugcuguggccucugauguguuacgucuuugccccuaauggaacuguguuuaguagauucuuggcuuaugauuaaauuaaggacaaaaacaaaauccaaagggcucucaggccucggucucaucaguccccugaugaacgggcaccagaggcccaucugucccauggagcaggcucccugcagcuguagccccgaagcaacugaaaaccugucagaaaacccacccagcacacaggugugcagaggcagcagugaugcucaccagccuuggaggcuuccagggaaccaggggaagcagagaagccccacuccaccucccucaccugaaccagguuggccacucacagguccuuccccgugcugcccaccugccaaucaucuaugcaaaccagguacugcaggcccagcccacgcaagcugcucuccauaggccugaagacaccuaugaguggaauauuguacaaggucagccacagcaaccccacauccugcagacaaaaugacuacuguacacuugaaacagcagacacuacgaaggcccucagcaguuauuuuuuguugucguuguugguuguaaacaagacaauuuagucaauauucuggaaaguucugaaagcuuuuacuccccauuucuguuacugacuugcucagaugcugacagagccaaugcauucaccacgucugcaucggauaccaaaggaccuugggccugcuuuauaaaagcuuuuagagauccuuugagauugcaaugagauuaguguucugcucauuaguguucugccucuccagcuugcagaacacggcgguucccuaauucaaccgcaggcgagauuacaccaggguaguugaggcugacgcgaaggccagccacagaaaggccuagcucugggccgggcaugcuggcucacgccuguaaucccaguacuuugggaggcugaggugggcgaaucacgaggucaggagaucgagaccauccuggauaacacggugaaaccccguuucuacuaaaaauacaaaaaaauagccaggcaugguggcaggcgccuguagucccagcuacucgggaggcugaggcaggagaauggcgugaacccgggaggcggaguuugcagugagccgagaucacgccacugcacuccagccugggcgacagagucagacuccaucucaaaaaaaaaaaaaaaaagaaaggccuagcucuuggauccagcuagguccuguuuuccucccuuggggcccugggaacagauacccaucucgcaaggcugauggaagauacaaggagacacucuuuugaaagugccuacccugcaccaggcucagagcagcgccaucugggagaaacuuccucagucacugggagcgugaaaagccaucuccuuauacauaggacagccaacguuugcaucccagagucaucauuucuauuuucagaaguauccuaauuuggaugaaaaauaauggaaauuguacuaucagugacaaggccuuaaaaguugauuuguucugcugucuugacugccaaagcaaagcaugucccaaacaccaggaaggcugaguggguugggaauggguggcagguggcccccagcacucugaugugguuugaugauacgcuuccaacccucgaaugggaaaagccuguggcuggcaccgcccuccugggacuugcgcaagccaggaagcugugugacugugugugugcacauucugccagaguccaggucagcacgucagagggucaugagacagcccggcccuccgggcucuuagggcagaauaucuagaugucuucuacagggcucucuacuggucccguuaccaucuuggccacauugggcccauccuucuccaugcaugcuugcuggugaugcuagauuaucuugaugaccagaccaaagaaguuacuggccugguaaagacagauaacacagucaagacugccagccacacauccuucucagcacccagcauuuagaaaacaucaguucugggcugagcacaguggcucacaucuauaauucugacacuucgggaggccaaggugggaagauugacugaacccaggagauuaagaccagccugggcaggauagugaccucgucucuauauagaaaauuaaaauuuaaaauaaaaaauaaauaggcuagcgguggcucaggccuguaaucucagcacuuagggaagccaagacaggcagaucaugagcucaggaguucaacaccagcccgacaaacauagugacaucccgucucuacuaaaaauacaaaaauuagcugggcgugguggcacacgccuguaaucccagcuacucagggggcugaggcaggagaaucacuugaacccgggaggcggagguuacagugagccgagauuacaccacugcacuccagccuggcgacacagugagacuccguuucaaaaaaaaaacaaaaaaacccagcaaauaugccaucacugaccaacaauaaaaacaggaaaagugucacucaacccauuuaugccagagguugcaauuuuuuaaauuuuugcacgaguaaaaacaucagaccuuggcgaugaccuugagcaguaugauguaaaaacucccacaugcuuagcguucuaauaauggaacacuaggcauaaguggguuacuguuguccuacagcaaagauuaaauuugaauuucuggucaugaaauuaaaacagggguaccacuucaaacccaucagauuggcaaaaaucaaagucugguacuaucuaguguugguaaaugugaggaacaggaacucugcacacugcugggcgaguaaauugaugcaaccacacuggagaacccuuugccagcaucuagcaagauggaagaugaacacaccucaugacccagaaacaaacucucccacaugugcccugcagaaacucuucuaaguaucugggagacacaggauauuuauuguagcaugggauaauagugaacacgaaauaacauaacugucccucaguagauaaacacacugggcacuuaacacaaauggacuagaacuggauguagcaacagaaauaaaucucacaaccgugagugaaaaaggauccauguaguguaacugaagucauauaaacuuuaauaacauuguuuauacacugaugcagaguuuuaaaaguacaaaaaggccuggaggugacucaugccuuguaaucccagcauuuggaaggccuaagugggaggaggcaaggggaucacuugaaaccaggaguuucagagcaguccuggcaacagugagacccugucucuaccaacgaaaaaaaaaaaaaaaaaaaaaaaaaccugggcaccgccuguggucccagcuacuuacuacucgggaggcugaggugggaaccagaucgcuuacaucuggguggcugaggcugccgugagccguggucgcaccacugcacaccagccugggagacaaagcaagacccugucauuaaucaaacaauaaaugaaugaaugcaugaacaaaaaaaugugcagaagaauccaaaagaggggcagcagacagggaauacaauggcccuuggaaggaucaggaaacaggcacaggaguggucuacagaggcggacgauaaggcuugaaacuaaaaaagagauuaguuaaaagucuaaacacauggcugggcacagugacucacaccuguaaucccaacacuuugggaggcgaggcgggcagaucauuugaggucucuacuaaaaauacaaaaauuagccaggcaugguggugcaugccucuaaucccagcuacuccggaggcugaggcaggaacauugcuugaaccugggaggugagguugcagugagcugagauugugccacggcauuccagccugggugacagagugaaacugucucaaaaaaaaaaagaaagaaaaaaaugucuaaacacagaguggaauuugaucccuaaaccuccuaccccacacaagcuaggguaaauauaaacauuaacaaccaugccagggcgcaagguuugccucccacaugcucuuucucaggcagccugggaccagacguagagacugcugccugccacccugauaucccagaggcacagcacaucuguacaugccuccccuagacucaacugccugucaccccaaccaucucccuuuacauggaccauguggaagugcccaguaaauaucacucaaccgcacauguuuccaauaauuuccuuaggccagaccauugaaaagaggcagcagacugggcgcaguggcucauaccuguaaucccagcgcuuugggaggccgaggugggcggaucacgaggucaggaguucgagaccagccuggccaacguggcaaaacccccacauugggauuuuuuuacauuggauuuuuuuaggagagacaaaaaaucucuacuaaaaauaaaaaaauuagcugaguguggaggcacaugccuguaaucgcagcuaguugagagacugaggcaggagaauggcuugaacacaggaagcggaguugcagugagcugagaucuugccacugcacuccagccugggugagagagucagacuccaccucaaaaaaaaaaaggagagagagaaaagaagaaucgacauaccuguaacuccucccucucaauguuucaguccauaucucgaaaggacgguauguuacucuacacaaccacaacucauuaccagauuuaagaaaauuaccccuccaccgcgcgguggcucaugccuguaauccuaccacuuugggaggcugaggcggaucacuugagaucaggaguucgaaaaccagccuggcuaacauggugaaagcccgucucuacuaaaaauacaaaaaaaaaaaaaaaagccagguguggugaugggcacuggcaaucccagcuacuugggagggaggcugagacaggagaauugcuucaacaugagaggcggagguggcagugaaccgagaucgcaccacugcacuccagccugagcgauagagggagugugucucaaaaaaaaaaaaaaaagaaagaaaaagaaauuaagaaagaaaagaaaaucacugacagacaucccaaggcaccccugaaacgugaccucccuucaauucacuucccaauccaaccaagagcaacagaaaauaucuguuaccccuaaaaugggugcaacuucucuuccaacucccagguccagcagcuggggaaagaaaagaaccugccuacaaaaagagccuccccagucugcuaaaucagcaccacaugggcaguuucaaccuggaaccaaagggccaccaccccucaccgccuaaccaguuggaaacagggcuguccugagccaacacccaggagagcugugccagggccgugucuggccugcguugccaccuggggagcaagggaccugugccuuuccaccaggggguacccccagcuagaggacaaaugaccaaagacgaagggaagccucuguucuccaggagacguuugacucugucuuugggaaagcuacacagggugggcggcccagccccuuucuccaggagcuggcggguucuaagucaccagcaccagagccaacaagaaacaguucuuggccaggcaccgugacucaccgggaggccgagacaggcggaucaccugaggucaggaggucaagaucugccuggucaacauggugaaaccccaucucuacuaaaaauacaaaaauuagcugggcgugguggcgggcaccuguaaucccagcuacucgggaggcugaggcaggagaauagcuugaauuugggaggcggaaguuguagugagccgagaucgcgccacugugcuccagccugagagacagagccagccaacgcccucuuaggccucuucgccuuacguuccugaacguuuggauucaaagagagugcaucucagcuauccucuccuccggcagcaggcagugggaauguuuuuccaggcuacaaaaaggugccaggucugcauuugaaccccacagcgucacuucuccaguggguuuggggggucucucguccguuaggaggaggaguguggggccugcgcuaggguccuuuucuuugccagccugcuggcuuucucagcgccugggaagggggugacagaggcccaccaggaagccaagugcaauucacuuccaccugggucgcccaccccagccugccugcaacgccccacacccagcacccacugcuccccagaggccaacuccccccggccuccagggcuacuaaccgagggggagguggcgccccagggacucugcccggccucccuuuacuggaguccaggagcagggugcgcccccggccuucuccccaccggcauccaaucgcccauucgccucuugguuucgcugucugguuucucuuccuguuuauggauuuaacaccgugcggcuuccuccccagcccacccagugccagauuccuguucuucaacaggaccugucuucuggggucccaggaauugcgugggaucuugcgcagaaaguuggccaggcaaauccuucgcaaugagggggaaauaaaccgaaaauagaugccggcagaugcgauuaugucggcaguuuggcccggagacaccgaggcccaggcgcugggagcgcggucccaggcagcagucuccggacccggccgagcucuuccucgcaggcgccucccucggcgguccuggccgcguccccgcuccgagggccgggguccggcgcacagcccggggaggggagcggagggcagagggcuggcgggcggagcuguuuucugcuuuucucgccgacgcuucggagcgcgcggacucccaccccagcccgcccgucagggacagucccgagggucccggcuccccgccggcccccagggacgccgcggggccgcgccugggcccgacugagggcgcagaggaacccgucucggcggccggguagcaccguccccgccaaggucacuuacgcugcgguggccccggguccccagcacucacccagcgcugcagccgagagccugcagcccagccugcgcgcagcggagcgguuggcguugccggagcgguugccggagcccugcagccgccguagccugggccagccccggcccuaaguacccucccggccccgcccc

SEQ ID NO: 192504 - RNA, 36629 nt, Homo sapiens
ggcggagcggcgggcggggcgucgccguacuaggccugcccccuguccggccagccccucgaagcaccuacuccacagguccagccggccggugagcgccuggggaccgcagaggugagagucgcgcccgggaguccgccgccugcgccaggauggaguucgugaaaugccuuggccaccccgaagaguucuacaaccuggugcgcuuccggaucgggggcaagcggaaggugaugcccaagauggaccaggugggccgagccucccugcuugcccggggcggggaaggagcucgcugggccggccucagggccugagcggccgggcccggaucuggggcaaggggcgcggcgagcagggccgacgccuggguguucccgucccccuuuccucgagccuucccccuguagggcccggguggacgcggccguccuggcugaccugucccugcccccgcaagccgcccugggcaugagcgacuuuugcgugguucccggugguugcgcuccccguuucguccccuccgugagcaucggcgcuuaccgguauuuuaacccgaggguuacacaucugaggcaauguggguggguuacgcgggagaggacgagugaguuuuuugguaagcggaaugaacuaugcagauaacaucacaugaaggccguuucuggaaugaagucugacuccuccaguuucaccaccucuuccggagcucuccccgccuugcugccuuccaucgcuucauccucggugcuuccugaguuuuaaaaucgccuaucuacgcuuccaaguuccaaugaguuaucuaacgucuauggauuagcuaggugguugguggaaggucagaacuugguuuuacuuagauuuuuaucugccucaugccuguacuauuuguuuaaugaaugcauaggagguguuuuuauuccaacaagaaaauuauucguacgcgauuauugaaugaauagacaaauucagccaaguucuucuggucuggaccagccuggcugauuucuguaacuuuuuugggccaacaggacaguagcaaaugugacucaggccgaggcuugauaggugccugaacaucggagucuuucuuucaguguccaugugcuucaguaaacacacuagaaaauaaauuucugguuuuuguccccaguagacuacacccucauuugguguuauuuuucacgugcuaucuuuaauacagguacauccuucagucuauuuguagaacauucaguuuucuucaucuuuucuuugccggugcuacauuauuugaauuauuuugcuacagaauaacuucuauuauuugauauggcagaugucacuuuuuauauuuagauauagcauucauuuauuuaacaaauauuugacgaccaguuguauaucagauaguguucuaggugcuggagguacaacagugaacaagcuaggugaagaccuugauuuuauaaaacuuacuuuuuaguggaagagagacaauuuaagaaagcgaauguacaguuuuucacguggagaaaagcacugcagaggaagauacuagcagggcaagggaucugagugcagucagaccucauuuggguccagacuucauuccucuaugucucuuuccuuucuacagaaagacuguuagagaaaaugguagcauugguuuccuguugggagggaaaguggguggucaugguaaguggguagagaaagacuucacaguauacuguuuuuguacauuuugaguuuuuuuaaaagcgagacuugagcuauucuagcucugauaauauggugcaguauuuguuauguuaguuguagucuuucugggcaguuuuuacauccccaugagccguuaaaaaaauaccugaaccuuuaauuaggggaaauaaauuggaaaaauacauuucccuucacuuaacauuaucuuaguuucucuuuuuuuuuuuuuuuuuuuuugagauggagucuugcucuguuacccaggcuggagugcagugguggcgggaccucagcuagaugcagccuccgccuccuggguucaagcaauucuccugccucagccugcugaguagcugggauuacaggcaccugccacuacgcccggcugauuuuuugguauuuuuaguagagacgggguuucaccauguuggugaggcugguuuugaacucuugaccucaagugaucugcucgccuuggucucccaaagugcuaggauuacaggcgugagccacugcacccggccuuuuuuuuuuuuuuuuugaggggggggucucacuccaucguccaggcuagaaugcuguggccugaacaugacucacuccaguuuugacuuccuuggcugaagccauccucccaccucggcuuccugaucccgaguagcugggacuccaggcacgugucaccaaugcauggcuaauuuuuaaauuuuuuuguagacacaaugucucgcugcauugcccaggcuggucuugaacuccugagcucaagcgauuuucccaccucagccuucaaagugcugggauuacaggugugagccacugcacccaaccaguuucucucugcaaacuagggaaaaaauuuacgcuuagcagauacugagggcugauuauuucuaucacagaagcauuuggcuauagaauuucaggguuuaguaaacuugauuuacacugaauuuuuaggugcauaucaguaaaucuacgggcauaugccgccugcaaguuguguggcaucacccaaaagccgagaguaauggaaagagcaggcuguuaguaaucaggcagaucuggcuccuguccaaucuaaauccuguuauuuagacuaauaucuuaagucuguuauuaaguccgauuucugacgcuauuaaguuaggugaacaaccuugguaacuuaaccucugaaccacaguuacuucaucuguaaaauagggauguauguaugguaacgauuuuuuaaccacaacuucccaacucuaagauggucugaaaagaauuuuuugaguguuuggcucagaaucacuuggcagcaaaaccugacuugaaguugaggcuucauucaucccacuuaguauauucaaauguuuugcuaaagaaauaauuaugaggugcuacuucacacugacuaggguuguauaugcauuuuauugccuauuuucuaaaacacuaaaaaugcuaaauucugccccaggucuugccacagauguuucaguggacuaugggccugugagaccuuaaaggguugauugaguaaggaucacaggugauguccgcauugugcuuggcauggaguuaagugcuugauaaauggugguuaucaaucugauuauguaaauuuauguaaauucaguucucaaguuugugguuuuuuuccccuccuggagaaaucuauucuauuuuaaagugaggaaggcuccguggagggcugguagcugguagcuguucacuuguggaacuuucagccugaggcuggagccccuuccugggagucuggucuugucgucuuccugaccacccccacacccuuccucuaaauucccuccaucccuguuuuucucccgcuugcgagcuuuugggagugugcugaaucucagacugcaauagauaaacccaagagggacaggcaccaguagccugagcuugcuuucuccccuggcucaugggaaucaagcaguagaaauuuuuagugaguguuguuuuccauaguaugcuuacuaguugugucuuccuguuuuguucuuggugauuugaagaaaccuguuuacaagguaagggacugaaacaaauaggugacaggaaaaagagcagcagggguacgagcuggaggaguaaguggcuuggcuugcucucuuucagaauggagggcuguauggaaaggagggguaguguucuugaagaguguugggguuuaaaucuagggggaccgugucuuggcauugauugaaacuccuggcuuaacaucaccccgaaacuguuaguuggacugaacaugacauuuggcagugcaguuaaaaacacuuccugcuguagccugguaauggucaggcuaugugaagagcugcucuggagcucaguccagagcggguauucuguuucuuucacucugaaauccugccucucgauauuuugagaaggaaggaguuggugaauuguuuuaaaauccucgaugaaugucuucauuuauucaugacaccacuucugaauauauuuaugugccagacgcugaaguuuacuaauauuauggugcccaguaaauacuuguuuuuacuaauauuuuuuauggcaauaaaaugacuuuuucaggauuaugugauuuaaaagauugacccuuuuggcaaaauacguauucaugauaggaaauauauacaaauaaaaacaacauaguucacuuaaaccucccaccagagcccaggguucacuguuaccauucugaagugacuauggaauuuccuagaaguggauaugccauauuuuuuuaaccacuccuauuggauauuuguuuuuuauuuuuuugagauggggucccacucugcaguguacaauaucauaguucacuguaacguguaucuccugggcucaagcgauccucccaccucagccuccugaguagcuagucuucaguagcuagacuauaggugggcgccaccacaccuggcuuuuuaaaaaauuuuuuaaaaacuuuuuuaugaacacgaggucucacuauguugcccaggcugcccucaaauuccugggcucaagugauucucccaccuuggccuuccgaagugcagggauuauaggcgugcgccacugcacccggcccuguuggauaaaugauuccagucucucccaaaaagaacuguuguaagacuguggggugaggggagggaagggacaaauaggaacccgccguauuuuccacucccugugggccuaaaacugcucuaaaaaauaguccaugaaaaaauacauaguacaaacagcaacucuuucugauaugcuugcauuuaaaaucaggcuuuuucucccuuuuggaaaaacacaguccuuguuugcuuuagggaagaguaaaggucagugcgcugcauugcauuaauuucgaagggaaagaugagaagacaucuugaaaggaauggcuggcuuucuagagaauaguagaggcuuaauaggugucauagaaaaaccaggguuggacagugguaguaaaacggcaaaacagauuuuauucagaaaaacuacugcaguaagaggagagagaccucgguacagaacugcuccacugcgaauacaaagaaaaguaggaauugauggcgggggagccggaugucaguggauggaaaauuauuacgaggaaacacaggggugugcauucuugcugaaggcaggccagaguuaucagacaucaccugagggauggagggggauguggaaccuaaucggcugucuagggugaucagauacugaaguugggggauucuggucaaaucaauuuagcaggauucuugguaaaacugggcgaugcaaagacagaugcguugaguacaaaguccaggccuuauugggaagaggauuucagcggagcccgaguagaguuuggucuagggagacucugucacugggaggacgagcgagccgcucggaagugcgcuggguucccuuagcggccaguggguucuggugagaagggcaacagcgggaggaggcgccggugcggagcgggaggccgggggcggggcugcggggcugcggggcgggcccguugugggucggcccagcgcguauucgaguagagggcgagcccgucccgccccucgucgggcgcuucccagaucugcuugagucuauggaggaaaaacuccgcgggguccgcgauucccauggccgcagccgccugcggcaccaaggccauggcccucuucaagcgcaccuuggugcugagucccgccgcggcgcccaggggcccgggcgcaggcaccgccccgcggggcugcugcuugccuccugccgccuggcccugcaaggacuggccucggggagagggcggcaggcuguggagccgccugccccagucccacucccacucccacucccacucccacucccacuccugcuccucgacgucucccaccgccguguguguugucugcccgcaggacucgcucagcagcagccugaaaacuugcuacaaguaucucaaucagaccagucgcaguuucgcagcuguuauccaggcgcuggauggggaaaugcggugagugauggaggcagcgccucuggcuuggaggaaagcuuguccgggaccuuugaguguguuggaagcuaccuuuugauauagcgcucagcguugcagccucguugcuguggcuuauccagaacauagcccggcccuacguguuuacuuuagaaagcccuuccaggcucuuugccaucuaguagagucccugcgggcccagccuuucagagaagaggggggagggggugauguuuauuaacuuuuuuuagucuuggcagcugaaccugccugugagcaggucguguauuucucggcuucccuuauccaacuuugcauuucuauuucuagcauauuggguugauucuuuugaagcugccucugugcacauuacacccaugaacuuagaccaguugccuuuauguaugaucguauuuauacugagaaguuacuguguuuuuugacuuucuuuucuauuugcuacauauuaguucggucuaaacguuuggucuucuggucuccauaguucuacauugguuaaaugcaacucacuucugggaguaguggugacauucaacuaguaggcuuuuuaauaaacuacagaaguucauuacucucauguaaggaaggaaaacuaauguaacuuucguuaaguaugaaaagcguuggauauccuuauaguucuuuagaguuaagggugagauggguuuagaaaguggccaggcacaaguuauuuuaaaauaaaaaaucuuuggcuguuuguuccaauauauuaauaguuuucccuuuuuuacagcaacgcagugugcauauuuuaucugguucuccgagcucuggacacacuggaagaugacaugaccaucaguguggaaaagaaggucccgcuguuacacaacuuucacucuuuccuuuaccaaccagacuggcgguucauggagagcaaggagaaggaucgccaggugcuggaggacuucccaacggugagugggguuacgcaucuugucuacggacuguuguguucauaauugcuaacgugguuguccgguagccuccauacauguggagaaagguuaaauaagcauucugagggcagcauaaugugaggguuaaaaacuccgguagccaagacucugaagccaggcugccuggguuggaaucucaaaucucccacuuacuaaacuguugguuacuuacaaagacucucugugccucaguuucuucaucuguaaaauagggguaauaauaacaccuaccucaugguauucugaggauucaaagaauuaacguagguaaugcucuuagaauguuagcuacugcuguuauuaucaguauuggaaguccaguguuucuuccugugggaagacgcagucaaauuuuaguguugugaaagauucucaggcuagcucacaaaagccugccgacuguaugaugcagccuaccuguaacacugcuggccucuugacuacccggagccugguagcaugggacugcugcucacgaugggcagcagccuggcaugggggcggugucuguuggcagcuagggcgagccucugccacuucaccugugauccugggcaaguuccuuaucugcuuugugucuccgucuccucguuuguaaaguuagagcugagaggauuaauuucgcacauauaaaguacuuagugccugguacaggguaaguauucuguaaguauuagcuauuuggucuauuuuguuggaguaaaguggguuauaguuaaaauccuaagauuuuuaaagucccucaaguucauguggacaucugccuagguccuacuauccuagaauucgcaugucuuaucacacaaauaacugauucuuccauaucuuauaaauaaagguuugauuuagcaaagucacauguuguguaauagcucgaagaagcccuuuuuguccacaguugccagagcuuuuggagaacaguccuuauguuauugaaacaaaccuaaucuguagcugaguugggagggagcuaaguggacagagaguccuccacccaaacaaaagaaucuuugauucuugggcauaaugggagcaauauuuaaaaaaaaaaaaaaaaaaaaaaaaaggaauguuuggggaagacucuugcggugcaaaggcuguuucagauugcugagaucagaccuuaaguaccaaagcccaaauauaguacaacauaauacaaaugagaagaaaauagcugaagaauaauucgaguuuauacaguacaauucaagagaagaaagaaaauuuaugacgacuagcugggugagaauuagaacuguaacccugggaagguccuggugauuugacucucacaggacaccugaugaccagaggauggguuuccuuugaugggaaaucuguggcgauucauugaugggccucugaauucugcugaagcagaggaaguaguaauaccccauuuauaauggaagugcauucucacuuaaaaacaacuaauauuauucuagcuggaccuagccucuagaaacagccaaauuacauuugacuugaguggauucauaauaauuaaaaaauuucuggggcaugggauaaauguguuagguauugcuaagucaaggcagcccuauccccucagcagaagugagggaauaugaaagugugugaaugcuaacauaauuuuggggaauaucgccgucagauuuccagaugauauuccaacauguuugugaaacuucagugucuuccuguguucauacaguguuccaguggaaaaauaaugcuuaguucuggaagguuucagaugugaacacugaacucaucguuuucuuuuuuggguaguagaguuagagauuccauccucuugaaagcacaguugccccgggaagaguaaaagggagcagaaggcguaagccaggcacggcuguuuucacuguuguucaccuuuuguauccuuacgaauaugaagauguacuaaguuguguguuuugcgugcauauauaauuuuaagcuacuugaguuguaggucccuccagucugugauucaguuugagaugggacuguaugggaauuaacagugccuugucuucuuaaggagugauuuguguaugugcugauauagcucaguaugucuuugaaaccaguugucuggggcuaggccugcaaucagcuuuuggcuaagaggucccaggauggaacaaguagugugaaagaggacugauaccuuggccucacacacaguacugcucuuagacuggggcaagugaaacuccucacuucagagugccccauucuaggcccccucacucccaaaggggugagggaucacuggggccaugggaaugugcuuguucagcucucgugggcucuccuucuguaccacguucuggacaucuggaguuccuugccccaaaucccugagcccacgucugcguccgcacagucuauuuccuaaggucaguccaucuccuccaggugggaacgugccaccauugacugugcccuugggccugagugauggccaagggcuguguuggggaguguuguggauggauccuggcaccgagggcugggauauccucucaaaugaaugugaggugccucccagugcuggagagagcgggauucaggaagcaguggaagggaagagccugggauauggggaucagcugucugugcccugcugcauucuggaauaaaacucugagggacuaagaauucuaaauucaaaccugaaucaaccagguuguuacaaagauaaguuugucagugcaggaggauacaauauauuuuacuuaaguuacuagcucgauugaucauuuuuaaauuuuuagcuacauauaguaugugggccuccauuuguccucuuaucccaggccuugcagaauuuaggaauaagccucaauacaguguucuaacccagugacuuccgccucgauguacaguagauugaaccugauccuuuauacuuuagugaucauuaguugauaccaguucaagucaggcuuucuagaaaucucauuguauguuagggguucgauuagaguacagucaugcaucacuuaaugaauggccacaggauacauucugagaaacgcauugauagaugauuucaucauucugugaacaucauagaguguacuuacacauaccaagauggcauagcuacuacagacguaggcucugugguacaggccauugcuccaaggcugcacaucucuacaggaugguacuguacugaauacuguaggcaauuggagcacagugguaaguauuuguguauuuaaacauagaaaagguauaguaaaaacaggguguuacagucuuaagggcccaccauuguauuuccagucuccguugacugaaacaucauuauacaguacaugagcacguaucuuucucaccugguacuaguggaaagcuagaaggcuuagaagucuaccuguaaacauagcuuaaguaauaauacagccuuauuuuuaaaugauaauagcaauaauaguguucacuuauugagcauuuuacuaugaguuacuuacuaaauauauuucaucguuaauuuacucuuuguguuauuugaucuauaacaucguuuaacagggaaauuaccuaguacauaauguacuguuaucuacauuuuaucuagaugaggaaacugaggcacagagaaauuaaguacuuugccuaggauuacccgugaaguuaagugacagaaucaaugaaucuggaaggucuggcuucagaucucuugugcugagucacucgcauacuuuacuaccucuaagguuucuaaucagaggaauuuguaucuguauucccugcuacucuuacccucuaugugggauuuggccuuucuccauuaucccugugaacucgcucugggaccuuccuucuuguacuuggaaccaucagaaagugaucugagaacauagaaaucuacuguguugugaaacagaauuaccuggaagcggaaaaagcccuccuggcucaauucacaugucacggcuuauggucguauccggggaacauaugaaacugggcacugagugcggagucaggaaagcccuguccauccucuggguuucuggggaaaacguggaccccuucauugucacuuucuccuguauauuuuuguuuuuacuuuuagaacuguacaauuacguaauaaauaauaaaaagucguuggaaggauaggugaaguucagaagugaaaguguuuuggaggagucuaagcuccuucccacccucauugaccuuuccucucuaauaaauagaacuggucuaaccaaggaucuguggaaugagcagaguccaacggagauucagggauucuaauaaccucuuguagaaucacugguuuguuucagccacaagaaggaauuaccuuuugacauuggcuugaacagcuguugugcaaagaaaaacuuuuuggaaaguucuggaaguaccagauugauuuuauagguuuuuuuuuuuuuuuuuggagggacauggggguauugacaguugauguuaaucagaaauccuaaauuauguguauuccugguauguugcaaucagccggccaccugguuuuccucugggcucuuaauuuuagguguauuccgaggaaguuuuucuaacuuuucuguaaacacagaccagguauauugcauacuuucaauguuuaaccaaaucucuucacuguuugcaguauuaucuguaggcucucauguuuuaagacuucccaugguguuuuuguauuguauuuugcuaaccuauaaacaauucuuugaacuuaaaacaagauauuugggcaguaacaauaaauuuuaaaaacaucaauucaacuuuuuuacauuagggcuuggacuauggaaaaaguauugggcagcaugccucauacugaguuguuuaaugaauuuaaaaguauagccuuaauagugagagaaacucuauagcuucauaauauaaauuggguaacuaaugagauaaaaugguuggcagaucugcucacuagaaucuaagcucuucaagggucugaguuuuuuuuuuucuuuuucuuuuauuauacuuuaaguucuaggguacaugugcacaacgugcagguuuguuacauagguauacaugugccauguugguuugcuacacccaucaacucgucauuuacauuagguauuucucguaaugcuaucccucccuuggccccccaccccacaacaggccccgguaugugauguuccccuccuuguguccauguguucucauuguucaacucccacuuaggagugagaacauguaguguuugguuuucugucguugugauacuuugcucagaaugaugauuuccagcuucauccaugucccugcaaaggacaugaacucauccuuuuuuuauggcuguguaguauuccaugguguauaugugccacauuuucuuuauucagucuauuauugauggacauuuggguugguuccaggucuuugcuauugugaauagugccacaguaaacauacaugugcuugugucuucauaguuggacgaguuauaauccuuuggguauaugcccaguaaugggauugcugggucaaaugguauuucuaguucuagauccuuggggaaucaccauacugucuuccacaaugguugaacuaauuuacacucccaccaacaguguaaauuuaguccuguuucuccacauccucuccagcaucuguuguuuccugacuuuuuaaaugaucgccauuguaacuggcuugagaugguaucucauugugguuuugauuugcauuucucugaugaccaguggugaugagcauuucuucauaugucuguuggcugcauaaaugucuuccuuugagaagugucuguucauauccuuugcccacuuauugaugggguuguugauuuucuuguaaauuuuuuuuaaguucuuuguagauucuggauacuacccuuuguuggauggauaaauuacaaaaauuuucuccuauucuguagguugccuuuuacucugaugauaguuucuuuugcugugcagaagcucuuuaguugaauuagaucccauuugucuaguuuggcuuuuguugccauugcuuuugguguuuuagucaugaagucuuugcccaugccuauguccugaaugguauugacugcauuuucuucuaggguuuuuacgguuuuaggccuuauauuuaagccuucaguccaucuugaguuaauuuuuguauaagauguaaggaagggauccaguuucagcuuucuacauauggcaagccagguuucccagcagcauuuauuaaauagggaauccuuucuccauugcuuguuuuugucagguuugucaaagaucagauggcuguagauguguaguguuauuucugaggccucuguuccguuccauugguguacauaucuguuuugguaccaguaccaugcuguuuugguuacuguagccuuguaguauaguuugaagucagguagcgugaugccuccagcuuuguucuuuuggcuuaggauugucuuggcuaugcaggcucuuuuuugcuuccaugugaaauuuaaaguaguuuuuuccaauucugugaagaaagucauugguagcuugauggggauagcauugaaucuguaaauuaccuugggcaguauagccauuuucacgauacugauucuuccuauccaugagcauggaauguucuuccauuuguuuauggccucuuuuauuucauugagcagugguuuguaguucucuuugaagagguccuucauaucccuuguaaguuggauuccuagguguuguauucucuuuguagcuauugugaaugggaguucacucaugauuuggcuccuuguuugucuguuauugguguauaggaaugcuugagauuuuuugcacauugauuuuguauccugagacuuugcugaaguugcuuaucagcuuaaggagauuuagggcugagacgaugggguuuucuaaauauacaaucaugucauuugcaaacaggcaauuuuacuuccucuuuuccuaauugaauacccuuuauuucuuucucuugccugauuauccuggccagaacuaccaauacuguguugaauaggaguggugagaggacggcauccuugucuugugcagguuuucaaagggaaugcuuccaguuuuugcccauucaguaugauauuggcuuuggguuugucauaaauagcuccuuauuauuuugagaugcguuccaucaauaucuaguuuacugagaguuuuuagcaugaaagacuguugaauuuugucaaaggccuuucgugcaucuauugagauaaucaugugguuuuugucauagguucuguuuaugugauggaugauguuuauugauuuguguauguugaacagccuugcaucccagggaugaagccgacuugaucgugguggauaagcuuuuugaugugcugcuggauucaauuugccauuauuuuauagaggauuuucgcaucaacguucaucagggauauuggccuaaaauucucuuuuuuuauuguuugucugccaggcuuugguaucaggaugaugcuggccucauaaaaugaguuagggaggauucccucuuuuucuauuggaauaguuucagaaggaaugguaccagcuccucuuuguaccucugguagaauucggcugugaaucugucuguuccuggacuuucuuugguugguaggcuauuaauuauugccucaauuucagagccugcuauuggucauuucagagguucaacuucuuccugguuuagucuugggagaguguaugugucgaggaauguauccauuucuucuggauuuucuagcuuauuugcauagagguguugauaguauucuccagugguaguuuguauuucugugggauugguggugauauccccuuuaucauuuuuuauuacgucuuuuugauucuucugucuuuucuucuugcuagcggucuaucaauuuuguugaucuuuucaaaaaaccagcuccuggauucauuaauuuuuuuuuuugaaggguuuuuugugugucuaucucuuucaguucugcucugaucuuaguuauuucuugccuuuuacuagcuuuucaauuuguuugcucuugcuuuucuaguucuuuuaauugugauguuaagguguuguuuuuagaucuuuccugcuuucucuugugagcauuuagugcuauaaauuucccucuacacacugcuuuaaaugugucccagagauucugguauguugugucuuuguucucauugguuucaaagaacaucuuuauuucugcuuucauuucguuauguacccaguagucauucaggagcagguuguucaguuuccauguagaugugugguuuugagugaguuuauuaauccugaguucuaauuugauuucacuguggucugagagaaaguuuguuguaauuucuguucuuuuacauuugcugagcaguguuuuucuuccaauucuguggucaauuuuagaauaagugcgauguggugcugagaagaauguauauucuguugauuugggguggagaguucuguagaugucuguuaggucugcuugguccagagcugaguucaaguccuggauauccuuguuaaccuuuugucuuguugaucuaucuaauauugacagugggauguuagacucgcacacaauaauaaugagagacuuuaagucuuuuucuaggucucuaaggacuugcuuuaugaaucugggugcuccuguauuggguacauauauguuuaagauaguuagcucuucuuguugaauugaucccuuuaccauuauguaguggccuucuuugucucuuuugaucuuaguugguuuaaagucuguuuuauuagagacuaggauugcauucccugcuuuuuuuuuucgcuugguagaucuuccuccagcuguuuauuuugagccuaugugcaucucugcacgugagacgggucuccugaauacagcacagugacgggccuugacuguuuauccaauuugccagucugcgucuuuuaacuggggcauuuagcccacuuauauuuaagguuaauauuguuauguuugaauuugaucugucauuaugauguuugcugguuauuuugcccauuaauugaugcaguuucuuccuagccucgauggucuuuacaauuuggcauguuuuugcaguggcugguaccaguuguuccuuuccauuuuuacugcuuccuucaggagcucuuuuagggcaggccugguggugacaaaaucucugagcauuugcuugucuguaaaggauuuuauuucuccuucacuugugaaacuuaguuuggcugguuaugagauucuggguugaaaauucuuuaagaaugcugaauauuggcccccacucucuucuggcuaguaggguuucugcugagagaucugcuguuagucugaugggcuucccuuuguggguaacccgaccuuucucucuggcagcccuuaacauuuuuuccuucauuucaacguuggugaaucugacaauuacguaucuugggauugcgcuucucgaggaauaucuuugugguguucucuguauuuccugaauuugaauguugaccugccuugcuagguuggggaaguucuccuggauaauauacugaagaguguuuuguaacuugguuccauucugucuaucacuuucagguacaacaaucauagcauuggucuuuucacauagucgcauauuuauugaagccuuuguucauuucuuuucauucuuuuuucucuaaucuugucuucuugcuuuauuucauuaauuugaucuucgaucacugauauccuuucuucugcuugaucgaaucggcuauugaagcuuguuuaugcuuugugaaauucuuguacuuugguuuucagcuccaucaggucauuuaagcucuucucuacacugguuauucuaguuagccauuuguccaaccuuuucucaagguuuuaaguuuccuugcgaucggucagaacgugcugcuuuagcuuggagaaguuuguuauuaccaaccuucugaagccuacuucugucaacucguuaaacucauuguccauccaguuuuguuccuuugcuggugaggaguuacguuccuuuggaggagaagaggcguucuguuuuuggaauuuucagccuuucugcugugguuucuccccaucuuugugguuuuaucuaccuuuggucuuugauuuuggugacguacagauggguuuugguguggguguccuuuuuguugauauugauccuauuccuuuguuuguuaguuuuccuucuaacagaggcccgucagcugcaggucuguuggaguugcuggagguccacucuagacccuguuuaccuggguaucaccaguggaggcugcagaacagcaaauaucgcggccugauccuuccucuggaagcuucguccaagaaggacacccaccuauaugaggugucugucggccccuacugggaggugucuccucccagucaggcuacauggggcucagggacccacuugaggaggcagucuguccguuacuggaguucaaaugccgagcugggagaaccacugcucucuucagagcugucaggcagggauguuuaaaucugcagaagccgucugcugccuuuuguuuagauaugcccugcccccagagaugcaaucuagagaggcaguaggccuugcugagcugcggugggcuccacccaguucaagcuuccuugcugcuuuguuuacacugugagcauagaagugcguacugaagccucagcaauggcggggaggcgcuuccccucaccaagcuccagcaucccagcuugaucucagacugcuuggcuagcagcaagcaagguuccaugggcaugggaccccccgagccaggcacuggaggcaaucaccugcucugccaguugcgaagacugggaaaagcacaguauuugggcagaguauacuguuccuccagguacagucacucacgccuuuccuuggcuaggaaagggaaauccccugaccccuugcacuuccuggaugaggugacguccugcccugcuuuggcucacccuccaugggcugcacccacuguccaaccagugccagugagaugaaccagguaccucaguuggaaaugcagaaaucacccaucuucugcaucgaucuugcugggagcuguagaccagagcuguuccuacugggacaucuuggaagcaacucugggucugaguuucuguuuguugcccugauguauauccccagugccuagaaugauacuuguuacauaggaagugcuugauccauguuugcacaaaugaaucuuucucauaaugagguuucucuaaacaagcuguucucccaaaaacuuaaacccagcuuuauguugaagcaucucauuauacauuggaaagaugaaauguguagugagacuuugaaucuucuuuugaaucuagaaacauuagcauuuuuagaccauucuauuuuaauauuuaugaaauuuaugaaauaauaagaaacaugaggccgggcucaguggcuuaugccuguaaucccagcaguuugggaggccagggcuaguggaucaugaggucaggaauuugagaccagcuuggccaacauggugaaaccccacuucuacuaaaaauauaaaaauuagcugggcgugguggugcaugccuguaaugccagcuccuggagaggcugaggcaggagaaucauuugaaccugggaggcggaguuugcagugagcugagaucgugccauugcacuccagccugggcaacauugcgagacuccaucucaaaaacaaaaacaaaaacaaaaaaaaugugugaccuaaauuaggcuuauagaugaaccauugcagucaugauuaauuccgccauuguuugccuugugaucuuuggugccaugucuguacauauuucaugauuucuguguuuuuacgguuuccauuucagaucucccuugaguuuagaaaucuggcugagaaauaccaaacagugauugccgacauuugccggagaaugggcauugggauggcagaguuuuuggauaagcaugugaccucugaacaggagugggacaagguuagucucauaaaacagugucugugugugauguauuagacagagcuggcaguccucauagugaagcucagaacaagaaaaguuguccaguauuuucagccccucugguuuuacaauucaucuguuuagguugaaugucucaucauaaacaguuuauuccagaguuaauuccaaaccagcagcuauguaggauaucagccaggcuaggaguaggguacuggagagaagugcuuaucuagacaaagggauguaauugaccaugaagauuaaaacuacacaucaaaacauaagguaggguuaggagucuugccuauuuuucauaggaaugguguuugugagacuuacucaucacuucuguggaaguaaagacauuuuauuuauuuauuuuaaagccagucagauuuagcaggcagagacauuucagacaucuaaaguguugauguauuucauaccuuuaacugugcuuaaauuaggaucuccgaaaagaugcugcuacauggucacuacguuaguguagguccaaggucuugggccucuuaauuuuucaaaccucaaaacuugacagcaguuaucuuuggaacugcugauuugugcuuccuaaguuaacagcauacaaugacugcuagaaaucaauuucugcauuuaaggugaaguuagccggguacuaugguuuaccuguaaucucagcacuuugggaggcugaggugggaggaucauuugagcccaggaguuagacacaagccuaagcaacauagcgagaccccgucuuucaaaaaauuaaaaaaugagcagggaauugguggcaugugccuguggucccagcuacucuggaggcugaggugugggaggauugcuugagcccaagaguugaagguugcagugagccaugauugugccacugcacuccaacgugggugacagagcaagacaccaucugaaagaaaauaaaguugaaguuaaaacuucuggccaagaaccagcacugguuaugauaguaacucauuuucuguugugcagauuuauucaggaaacuuaauuuuagguuguugaauagaaguuuugaucagauaaaauugaauuaaaaaaaauuuuuuuugagacagggucuugcuguuauccaggcugguguguaguggugugaucacggcuccccgcagccucaaccuccugggcucaggugauccucccaccucagccuaccgaguagcuguaacuacagugcaugacaccauaccaggcucauuuuuguacauuuuuuguagagagaggguuuugccauguugcccaggcuagucucaaacuccuggcaucaaacaguccucccacucuggccucucaaauguugggauuacaggcaugaccagccaauuauuucaaggaguuauuuuuuuucuucuacuuugggggaagaugaauuauauaagucuccauuuuaggaguauuucuaccaaaagaacuauuaucuucaaauauauuuuuggauaguacuauagauauacuaauuuuuuuuuaaauuucuaguaauucuuuugaagauuuuguauagcuguccaaagccaauuucugucuaccuaauuucagcaagauuucacucuuuucauguuacuuuugucccagaacaaauuucaagugcuuucucuucaccugugcauucuucccccugauuagucucuggcuuuguauuacuuucagucagagacgacuuuuuuuuuuugagacagggucucacucugucacccagacuggaaugcaguggcacagacaaggcagccuugaccuucugggcucaagcaaucuuccuugcccucagccuccugaguaacugggaccacaggcacguugccaccaugccuggcuaauuuauuuuaauuuuuauuauuuuugagacaggguauugcucugucacccaggcuggaguguaguggcaugaucaaggcucacugcagccuucaccuccugugcucaagcaguccucucaccucagccuccccauuagcugggacuauagguccacaccacuacaccaggcuaauuuuuguaauuuuuugguagagacaggguuucaucguguugccuaggcuggucuugagcuccugggcucaagcgauucaccugccuuagccucccaggugugagccacuacacucagccuuuuaaaauuuuuuacagagaugaggucuugcuuuguuggccaggcuggucuaaaacucuugggcucaagcaguccccucuccacagccucccaaaauuccgggauuacaggcgugaacuucggucauuuccuaacuuuuacccuuccuaaugacacuccagagcuuaccuucuuuacuuuugcuucuuaaguuaacuaauagacaauuauuguauguggauauugcauuaaguugucuuaggauacccuuuucagaggaggacagcuuuugacaaauugcugucgcggaaaaaaaaaguauuuggcaauuaagaguugcauuuacugaaaucucuguugagagaggggaaguuacguugucucuaaaagaaaaacuaaaaagaaaaggggaaguuuuagcaaaguuguuaaagccugacacuuaagucauacuaccuaguuuugaacucuuagccccugccacagacacggcagccccuugaaccuuccuggguucaagcgagccuccuacuucagcccccugaguaacugggaccacuggccugugucacugugccuggcuaauuuuuuuuuuuucucacaugggcaauguugggcaaguuaaaucgacuucuuugugccucaguuuccucaucugaaauggagaucauacugcuauguaccugauacaauguuugugaggauugaaugugcagaguucuuuuuuucuguuguuguuguuuugagacggagucucacucugucgcccaggcuggagugcaguggcgcgaucucggcucccugcaagcuccaccuccuggguucacgccauucuccugccuuagccuucugaguagcugggacuacaggcacccgccaccaggccagcuaauuuuuuuguauuuuuaguagagacgggguuucaccgucuuagccaggauggucuugaucuccugaucucgugauccgcccgucucagcuucccaaagugcugggauuacaggcaugagccaucgugcccggcugaaugugcagaguucuuaaaaccgugucaagaacauaaaauaguuauuuguucuuucauauaaugaugauuuugagggccugcggaucuugacauguuaucagauuggucaaaaaaagauuaaaccauaguugguauuguccuaguuccuguuaccagaauauuccaucuuucaucguugccuucucucauaguuuuauguaucaaaaaguuuauuguaaagcuagggcgggcacggugucuugggcugguaaucccagcacuuugggaggccaaggcuggcagaucaguugaggucaggaguucgagaccagcguggccaacauggugaaaccccgucucuacuaaaaauaaaaaauuagcuggaugugguggugggugcuuuaauuccagcuacucaggaagcugaggcaggagaaucacuugaacccaagaggcagagguugcagugaguugagauugugccagugcacuccagcccaggggacaaagugagacuugaucucaaaaaaaaaaaaaaaaaaaaaguuauuguaaagcuagacacggugguauuugccuacaaucccagcuguucgggaagcugaggcagaaagauugcuuggguccaguaguuugagucuaacgugggcaaauauaugagacuccaucucaaaaaaaaaauaaaaaauaaaaauaaaaaaauguuuacuaguuuuuuucaguagccuuuuauuauaguagcaguacauguguauuguagaaauuuggaaaauacaagugaaaaauaaaaacaucaaauucccgucagccagagacugcuaugaaauguuuugagcacauccuucuugaauguuuuuuaaauccugguauguauauuuguauuuuaaaaucaaaaugcauucuuacccauucucuuuugaaccugcuuuuuuguagcuaaugaucucuaguguguccauuucaguaaaaauuccauuauuaaagugcuuuaaaaaucgucucuuacaguacugccacuauguugcugggcuggucggaauuggccuuucccgucuuuucucagccucagaguuugaagaccccuuaguuggugaagauacagaacgugccaacucuaugggccuguuuuugcagaaaacaaacaucauccgugacuaucuggaagaccagcaaggaggaagagaguucuggccucaagagguaacagauucaggguauuuugggggaaaauaacuuuagacauucucugaaaaauccuuuaacucuugugguugcgggugacagaaaaacaagucaggccucccccaggcagcauaaggggauguggaaaauaggauagcuugacaugaguuugcuucagguagacuggcugacucccaggauucacaccacguaaucaguauauucaagccuugcuguccuugauuucuuucagacggucuuucuccaagugguggauaugguaacaacccaugugcacuagcuuaacaaaaaguucuuaggaauggcuuuguucggccuggcgcaguggcucaugccuguaaucccaacaguuugagaggccaaggugggcggaucaccugaggccaggaguucgagaccagccuggccaacaucgugaaaccccguguuuacuaaaaaauacaaaaauuagccgggcgugguggcaagggcuuguaaucccagcuaccugggaggcugaggcaggagaaucgcuugaacccaggaagcagagauugcggugagcucagauugugccacugcacuccagccugggcgacagagugagacucccucucaaaagaagaggaagggcuugguucuucugcucagcccugaaucaguuacuguugcuacacagcugaguucucuggccucgccuggauuacgucuacacaguacacacagaauggauuucccccaaagaaagaauucugcagcaggaaggggaaagggauggcagguagacaaaaacuccaggugucuguaauaagggacagggucgaucuuuaauuaaaacauggacagggaacagaaagcuuuugauacugauuuuguucagaaggaaaguagaaaauuuuaugacuguucccugaauuuauuccagcauuuaccuuuugcuuuccauaaaaguguuuccugcagccaaguacuuuaaaguuuuaaaaagacgggugaggcuaaguguggugucucauacuuauaaucccagugcugaggccaggaguucaagaccagccugagcaacacagcaagauaccaucucuauaaaaaauuguuagaaaaugauucugcugaaagagcaaaaauaaaaauuaaagaaaguagaaaaaauaaaacuaaauuuaaaagauuaacugggcauguuggcaugcaccuguauuccuagguauucgggaggcuaaggcacaaggaucccuugagcgcaggagcucaagguuggauugaguuguaaucacaccacugcacuccagccucgguggcagaaugaaacugucucaagaaaaaaaaaaagugacagagggaaacaauauuugcaauucauagagcagauacaggguucauauuccuaauauuaaaaaaaacuucuaaaaguuaagaaaaaggccaacugccccacagaaaaaugggcaaggagauaagaacaagauaguucacaggaagagacacacagaugauuauuaaaaaucugaaaagaugcugagucuuacuccuaagaaaaauucacauuuaaacuacucugggggcugggcaagguggcucacgccuguaaucucaacacugggagaccaagguaggaagaucacugaagccaggauaucgagaccagccuggacaacguagugagaccuuaucucuuaaaacaaaacaaaacaaaacaaaacaaaaaaaacaguaaaaauuggccgggcacagugacuccugccuauaaucccagcacuuugggaagcccaggugaguggaucacuugaggucagguguuugagaacagccuggccaacauggcaaaacuccgucucuacuaaaauuacaaaaauuagccaagugugguggcauacgcugguagggccagcuacuugggaggcugaugugagacuccauuuaaaaaaaaaaaaucaaaaauuagcuggguauaguggcacaccccuauaguucucgcuccuugggagguugaggcaggaggauugccugagcccaggaguucaaggcugcagugaaccaugaucgcaccacugcauucuagcagccugggagacagagcaaaacccuugucucaaaacaaacaaacaacaacaaaaaaacaaaaaacacuucccucagcucagacauggccuuuuaaguuuccuaggugacucgugugcagccaggguugagaaaccacucuugucuuaccccucuuuugcagacacagggcucagagaagggaaggggauugucuggggauguauagugaggcaguggcugccuuggaaguggagucucagucucccggcuccuaggccagccccugaccacuguuccauugucucccagacagaacaucagccacgggcaugugaugcaugagcgugagccacaccaucuugcacacacaggagcagagcccugcucuucucauucacuuacuuuaucuguaaaauagcaucauuucuaccacacggugguggugugaauaaaaugagaugaacuucuagcauagagugcuuaguaaagguucuggacauuucguaguaguugaaucaugccaaaugugguccuaggugauuggcuucuuuugcuagcauguuuucagggcuccuccaugcuggggcauugcaucacugcuuuauuccuuuuuaucgccuaguauuauuccacuguguggauagaccacauuuauccauucaucaguugaaggauauuuggguucuucccauuuuuuuuggcuauggugaauaguacuguguacauuugcauauaaguuuuuguguagauguguguuuuccuuuuucuugggucuaugcugagaaguggaauugcugguucauacagcagcucgaaccuugugaggagcugccagacgcuuuuccaaggucgcuccaccauuuuacauucccgucagcagugugagagucccaguuucaccagcacuuguuguuaucucuuuuuaacuguauguauauauacuuaacauuuuauuuauaauaaauguacauaauagagaauuugccauuuuaacuauuuuuaagucuauuauucaguggcauuaaguacauuaaugauguuauauaaccaucaacacuauguuuccagaacuuucgcuagcuucagagaauccucuaaauaauaucauuaaaaaucaucaagccgaaucccacuguuagaauuaaagguuuuauuucacuuucaaguuaucaggauccagggagguguaauacacuuagaggauagacucagcucauuucccagcuaugccuuucagcagcuuucuuaccagaguaggaauauaauguuagucauuauuuagaggccuggccaucuugagaagguuuacuguuuagucugcaguacaauuauaacuguuuuuguauauuggguuauuuuuuucagaaguaggccaguagcucuaacaggagccucuuuagccugaauucguccaaguagugcaguguugcacuaguugucccucgggacaugcuccccaauacguaacucacuuccagguugcaacuggacacuuacugguagucagaaauagcuauugcauggagcuuaaaaugaacuugaucuucgugaaagaugagucugcagcuaagagacuuuacuguauaucauaguguuuuuuuuuguuuuguuuuguuuuuguuuuugugacggagucucacucuuucacccaggcuggagugcaauggcgagaucuugacucacugcaaccuccgcccccuagguucaagcaauucuucugucucacccuccugaguagcugggauuacaggcgccugccaccguacccggcuaguuuuuguauuuuuaguagacacaggguuucaccaccuuggccaggcuggucuugaacuccugaccucgugauccacccuccucggccucccaaagugcugggauuacaggcgugagccacggcgcccagccuguaucauaguucuuaugcacaaagacccuuuaauauuguuuguaaauucuccccuaugcacacgcugaccuguuccuuaaucuucuuaucugucuagguuuggagcagguauguuaagaaguuaggggauuuugcuaagccggagaauauugacuuggccgugcagugccugaaugaacuuauaaccaaugcacugcaccacaucccagaugucaucaccuaccuuucgagacucagaaaccagaguguguuuaacuucugugcuauuccacagguagggaagggggcuccucuggguggauacggggcuaaagggagugggguaggaguaaggguggauuuugcugugcuauauucaaggauaugauuccuuaaaaagacgaugacuccaguuuauuacgcugggaguuucauagcacccgccuuugcuuccagccaccaaacucagcucagccuugagguuaagccugcuccuuuucagaaccuucuuucuggauuuacuauuuucuacagcuauccuaaacuaguuagguucuuuuccucacaguuaagucaaggucuuuggcuuagauuuauggggagugcuggguaaaaccugggugaagcuguuaucauuaaaaagucuucauuaagcaccuaauuacugcuguccuuuuccuagacccggcauaaaaagaaccugguccgguagaccuagccucucaguaugcuaggaacuuacacuuuuuaguugccuuuaccaaguauugcagauacuacugcaaauaagugaagaaaguaacagcauuuaacugauuugggaacuugguuugaucuuguucuaaugaccaacuucgaauggugguugaaaguaaaaucuguaucgccgucuuauguuuccauuuaccuagaaauacuuuaccuuugagcacaggaaauuaauccccuucugguuguucucccccuggcauugguuuuaaauauauaaugauuauguuuguuguaggaaaaauagaaaaacaacuacaauagaaaauucuucccauauauuauuuugaaauacauauuuccgauccgauaauccauugcucuagcauggaaaauguuggauuuacuuguguuugcuuuuuccaaauaaaauggaacuuuuguggcuacauuauagaauuguuuuagacugcuuaauucuguguguuguugagaaagggaggaguggggaagguaaaaaucuugacauacuuucuucguggguauuuuuucuugagcgauuccaucuuaguugauuagcaguuagcaauugcccauucaacagaagguuuucuuaccuuuuugugauaaugauagcuaacgacaucauuucuucuuuuuucccucucuucuuguugucucuaggugauggccauugccacuuuggcugccuguuauaauaaccagcagguguucaaaggggcagugaagauucggaaagggcaagcagugacccugaugauggaugccaccaauaugccagcugucaaagccaucauauaucaguauauggaagagguggguuuuuauuuaacuacuuggauaauuuguagcuacuuuuaugauuuaguaaugucacuguuuaaccagguuuggauauuagaugauccuaacaauucacuauccuguggccuaaagagacaggaauugauauccuuuauaaggaaaaaagucuauucacaggagccgagcagauugcucacugcuguguaguacccuggugagaggagauaaauggagcaaggcuguagguuggagccccucaguagaaucauagauuuugagcugcaagaugaugcaggaggccaaccaagcuucuuguugcuggugaggaaugugagguugaagcuugucugugcugaugcagugcgugauugaguggaucucuggcucccguccauguguccugacacccagucugguacuuucauuaugccacaggccucaauugaaaaaucacaguagggaauuuaggccaaggaaagccaucaaguugcaauuauuuccuaaauuuucuuuggaaaauuucauuucaaauaccaaaaccauccuauaaaaagaaaacuuaccuucuuaggucaaaucucuaauauuugacuagguucaaaaaguuuauuucuggccaggcacaguagcuuacuccugaaaucccagcacuuugggagaccaaggugggaggaucacuugaggccaggaauucaagaccagcccgggcgacauagcaagaccccauuucuacaaaaaauuuaaaaauugucaugguggugcacgccuguggucccagcuacucaggaggcugaggcagguggaucacaugagccugagaggucgaggcuacaguaagcugugugauuucaucauugcacucuagccugggugauagagugagacuuugucucaaaaaaaaaaaaaaaaaaaaaaaaagucuuagagaccagaagucuuuguaaucucuaauaaucucuaggcccuagagcagugguuuguaaauggaggugauuugcuccccuccccccagaggacauuggacaaugucuggagacauuuuugauuguccuaaccggcaggaaucgggugcuacuggcaucuggugaguagaggcccaggaugaugcugugauccucaggugugauccuguugagaaugaaacacuguagacuuuaugaaaacauacaagacccucaucauuuuuccuuugccugagcucccuccccagagguuaccucuguucaugguuuugugcauccgucuagucccccuguuacgcguuuacaggaauaugguuugcaacaguguuuucaucuaaauagaauuauacaaaauagcgauuucugauuucucuugcauauugcacauucuucuuauacuuccucccuaccuuuaucugacacagaaaugcuguauguccagaacuucuaucagaggcaccuauggaagucuaagggaagaccacaucgcuuuuaaaaacccuaaaauuuuguagucacuagaugaaaauauucagccagugacccaaaaaauugcuaccaaugagacucuccauuuugccauguagccagaacuuacuuugaucuaugugccugggguagugaccaaguagguggguaggaguaaucucagggaaacuugaggccccagccucauggcuagggucauaauuugaacccaggucugucugacaucagaauccaugauguuaaccccaauucuaagggguucaacuacccuuucuaaauggaauccugcuauauuaagcacuauuuauucauuuuauauaaacuagaaacauuuuauguaguaaguaguugagaguguuuugguuuugcaguuugaucacuaguuuuagaaaccaguuuuuaaacacuuuguggccaauuccauuacuauauuaaaauucagauuuauuugguuuuuccuuaacuauugggauuaaauccugguuguaauucauaguuugagggcgagggugggcagucuacaguuggcugagcccuguuuuugugaauaaauguuaucagaacacagccacacccauuugcuucuuugucuucuguggcugcuuuugcaaugugacggccgaguugaggagcugcaacaggcgaugacuuguaaagcugaaaauauuuuuuggcccuugaauaagagguuugcugacuucugacuuaggguaucaguuguucuguuaucccaguaaaacucaaggcauuaggggagaaauguuaauauuaauacuuaaguugauuugauuuagggaaaucuuugaagauuucuaagucuuaagcaguagaaccuguuaaugguuuuaguuucagcaguaaggacauuuuacaaguaaaguuuuaaaugaaaacauuuuguaugaagccacaagucgucuggccucuugcugguguccagauauuaacacugauccuauuucuccuugcugaccaagucuguccuuuguaguaagaaaggaagaaacguugacucuguccgaucucuggacuuaguguuguagcgagcaugcaccuggaagggacuugccagaggaccuccucaugcuucuccagugcuuagugggggcuuggagugcagccccaggucuucacgagcaguuggccacacugcagggcccucaccccacucuggagcagccucugcuucaaaccagccuggaugcuugucagcuggggagaagaucaaccugcuauuuugggauagaaauaaaugcucagccaaacggccagaaacccccauuccccucucugccaaagugaauuccuuggcagggagaaucuuguucgugucucugcacacuuccugugcccuccugugguuaagucagagaaucauccggcucuuugagccccaggugccuagcugcucaaggaugguccccagccagcagcugccaggaaucaccugggagcccauuaagacauccagcccccacccaaacguaucgaaucagaaucugccuuuuuuucccaaaugauguuuuugcuuuaauggaaguuuagauguucauagacaagaguuuuaaaugaugaucaagcugauuccauauucgcaguuguaaguagaacugcugagacguggaaguaccacauggacucacagaggagcugcuguauguagcacagcauugcacaagagcuuauuucagucuaguaaacauuuauaggagccugugucauuuaaucaucaagccucgcacuguggcucacaccuguaaucccaaaacuuugggaggcugaggcaggcagaucacuugagguaaggaguucgagaccagccuggccaauauggcaaaacccugucucuacuaaaaauacaacauuuagccaggugugguggugcacacuugucaucccagcuauuccggagccugagacaugagcaucgcuugaacucgggagguggagguuguagugagcugagauggcaccacugcacuccagccugggcaacagggugaaggcccuuucucaaaccccucaaguauuuggcuucaacuuuaugccgggcauguagaugaaaagucggcuaugaccuguccuugacaagcagauguaacuccuugauugaggcuaguagguuuuuaagaccugaauaauugaguuugcagaaaccuacugugugccuucagguaaauggagagugggguuuggucuagcaacgaagcaucuagaaggucccuuuggccuuaccggcucuguuuuagguaaguccacgucugaguaccagugacugcagcucuuccaguugugcugucaugcuuauauguuagaaaugaucaucaaaggacucaaaaguuuugccacuaauuguauuaccggggacugucacaaccaagauuucucuuaauuuauucaccuuacuuaucuccuggaagggcauauugaagugcucuuggaguucucuaaaaggguuuuuguugguuguguauauucacuugggugccagcgauugauuccaaauaaguaaaucuuuuuucccaaaaggauguaagauggcuuaugguuauaaguacaacaggcuaacaaaguacaaguagaugagaaaguaaaaugaagaaauaaagucauaggagccacagaauuaacccaggaaugaauaaguguguaguuuggugcugauguuaucauccuuuauuuguacauugcuuguacaguugcucugagaagguaagucuuaaauuuucaaaagugaaaugucaccgagcaugguggcugaugccucuaaucucagcacuuugggaggcugaggcaggcggaucacuugaggucaggagugcgaaaccagccugacuuaugugaugaaacccugucucuacuaaaaaaaaaaaaaaaaaaaaaaaauacaaaaguuaguugggcaugguggcaggugccuguaaucccaccuacuugggaggcugaggcaggagaaucgcaugaaccugggaaguggaggcugcagugagccaagauugcaccacugcacucuagccugggugacagagcgagacaccaucuuaaaaaaaaaaaaaaaucuacaauauaccaaaaccauuacuuaccugagaaacuauucucagggucauuguagugaaugccuauuuuauggcuuuugauggcaucagggcacucaggucauuuacaagaguagugugugagacccugugugucacugccacucaucuuggccuucggccacugcuguagcaaccaguuuccaaguagggcuggaccuugccuucugcuccagagaccucucgcuuccugcccuugggcuucugacgagcugcaggaacugccuggcacguggguccccacaacccagaggaggugagggccaccucucugcuccucagggccaccuuucauaaggcuccuugaaggucccucaagaucaagccaacucaacacauccuugauaggccuuccugccuucuguuucacuucuccacucguuuccaaauaaauggcugcaugcaagcuuuugccucagguucugcuuuuaggaggaaggcuaagacaagcaguaaagcaacaugggcaggcagaaggaugacuucuaauagaauuaucucaucacuauauauuuuacuuuauggaugcuuguauugaaaagucuuggcuggguggaguggcucacgccuguaaucccagcccuuugggaggccgagguggguggaucacuugaggucuggaguuugagaccagccugaccaacacugguaaaaccuugucucuauuaaaaaugcaaaaauuagccagggaugcacgcuugcugugugccagcacagggcuaggcuggagauaaaaaggugaguaaguaggugcgguguagucagggugaaaacuacagaugguccauuuccacguaaguggaaagguaaagguauguacaauaggguggcuccuggcugaaccuggagcugcagacagguuuucuagaaggcauaauccugaaguugagacuugggggccuagguaggagccaguugaagggacgugggaggcgcauuccagagagaaggagugguaugagacuggaacagaggugugcagcagcaucgcaugggcgaaacaacaguagacaguuguucuuuuguuuuuguuuguuuuuugagacagggucuuguucugucauccaggcuggagugcaguggcaugaucucggaucacugcaaccuccaccucccaggcucaagugaucuucccaccccaguccccaaguagcugggggaccacaggugcaugccacgaugcccggcuaauuuuuguacauuuuguagaaacaggguuuuacuguguuguccaggcuggucuuaaacgccugagcuuaagcagucuacgugccucagccuccugaagugcugggauuccaaacaugagccacugugccuggcccggcaacuguuacuagacuguagagagggaggugggcaagggcuggugacacuagacaggugcaguaggucuggaccauggguggccuugcgcuacacauuacagagcucaggcuuuuuuucuccaggugagagggcuggugccacugaggcaucaagcagagguuugagaucuccuuggugacaguguagagcagacagguagauuugggaauuuaagcuuagacucacguuggagacugagauagcucaucugagaggcacucagggccuaaucucaggcaguaauuuuagggauguaggggaagagauggauucugcacauacuugggaggcuuguggaggaguggggagggaggcacagggaggacuccagggugguucauacggcucccugcuucuguuccugucccccuuugucaagcuguggucuguacugcguguuccaucuuguuucuaagcugcuuuugcccagucuuuccagcauuucccuuucgucauguuagucugugccugucuacgugaacuauggugacguuuauugggccuggcacugugaggugcuggggaugugaagaucauuguggcucagccgcugcucucgagggccucugggugcaguaugcacaccugugccuccuguuugcucaggaagacaggcuuugagaugagcuggggcugacauccccaccuuaucauugggauggcuuuggguaaguuauguucauguucucugagccucccuuuccucauugguaaaauggguauaaaauaccugccaguggaggguuguuguaaguagccauggaaaauguaaagcacauagcacuuaucauuuuuuccugugucuuuaacagauuuaucauagaauccccgacucagacccaucuucuagcaaaacaaggcagaucaucuccaccauccggacgcagaaucuucccaacugucagcugauuucccgaagccacuacucccccaucuaccugucguuugucaugcuuuuggcugcccugagcuggcaguaccugaccacucucucccagguaacagaagacuauguucagacuggagaacacugaucccaaauuuguccauagcugaaguccaccauaaaguggauuuacuuuuuuucuuuaaggauggauguuguguucucuuuauuuuuuuccuacuacuuuaaucccuaaaagaacgcuguguggcugggaccuuuaggaaagugaaaugcaggugagaagaaccuaaacaugaaaggaaagggugccucaucccagcaaccuguccuugugggugaugaucacugugcugcuuguggcucauggcagagcauucagugccacgguuuaggugaagucgcugcauaugugacugucaugagauccuacuuaguaugauccuggcuagaaugauaauuaaaaguauuuaauuugaagcaccauuugaauguucguaauaguagaaaaugaugugaauuuucuuucuguucggcuccuauuuuucucaucauuuuguuuucuuuaauuggguugaauggaguagauagaaauauuuaugguuuagguaacaguuagauguuuccuaagaaugcaaacugccuuuuccacacaaaggcugggaauaaaauucuggguauucucguauucucauuuaaaggaguuuagcuuucagagagaaacagcaggauugcuuuugaccuuuuagaagauuggucuccaguaaagguggacauuuuugagauuuuuauaauaaagaauuuaauugcucugcauuugucaagua

SEQ ID NO: 192505 - RNA, 17683 nt, Homo sapiens
ggggcguccccuaaggggacggaggccgcaugggccgccgagccgggaaaucuccgcccccagcuggagcggcugugcgggcugcguagcggugcugggucgggccgacgugccacccacccggagccggugagugcagccgcccgcccuccgguagaucugcggccuggcggagaagucgggaggggacaggaagggagggcgggccccgggcccuccuccgucucagccgccugcggaggugcugcccacgccuggaggcccccacugacccucagacccgcgucugcgccccucuccccgcaccccgaggcagaguugggaaagcaguggucuuagaccccccaccucgggcacucggaagagaacggcggagacaaccccuccucuucccuggcuggcgcagcgccagccucgagcuccucgguagcccccgggcagggagggccggagggugggcgcggcaucuucagcgacucuucgaagucccuuccgcgucucaucuuucaaggcuguugcagaggcggcuugcuucccaccuguccaucuccauaaaaaucccuaaacgaaacaugcccacguguccggagauuuucaggacuuggugcauuucagaugaaggcuuuuccagaagcuuccccguagaagaggaucaggcauccaacugguuaaggucagcagcguuuggcacgucuccuuccagccuggcgguuuugucaggauucccuggggagugucuggaaagccugaugaggggaaauaguacaucucagcgaaucggcaccagcgaguguaagaugcgcguuauugaaugugcugcugccgaauaugagaaugccgagauugugagccgucaccauuucuuagauuuuaaaaguauucuaaaauguuuuuuagaaucacugaaauauaauagcuacccccugcccgauaucuacuuaguucuuuucgauuuucaucauaacuuauagagaggcuggugcaggaacaggugguuaggcagcugccccgggugaggcugggagucuccucugcccgaacagcccggguguacaccacucagacugccucauguaggcggcugucaguggacugggaugauuugggggcagggagaguagagguggcccugggagcccugcguggugauuagaacagaaccacagcuguuucucggggaucagagauaacugucuguagcuaugccgggcuuaccuacguggcugggggucucacuuaugauucugagcucugucugcguguuggucguuucaugcacaccucccccacgcuaguggucggcgguccuggagggcggcaucuggucccuucaaaagugggaaauaagucggcagcagugggucagaauggcuguuuuuugagagcgggagcagggggacagagaaagucaggagguguuagagguucacaguccaggcaaaaaguaacaaaggccagcuccugguguggcaggugccgcucaggaauaaaguggauggugcccaugaugugcugccuagcacacuguuggugcuuaauaaguguuugcugcaugaagaaagguaagaggggcugccuuuccugcuacguuucccacacccugccacagcugcucuucucuaugaucugaccgccucccagccacacucccuuuuuggccaugcuugcucuuaaaguuaguuggcagcaaaaauggcggcauggaggaugcuuggcaccuguuaaagaugcuagagauaaaugagcuaagucgguggccucuuuugcccauuucugcccacagggaugccagaagggccguuggugaggaaauuucaccauuuggucucccccuuugugggucagcagguggucaagacagggggcagcaguaagaagcuacagcccgccagccugcagucucuguggcuccaggacacccaggugagguaauacuccucugaaggguuggcucugucgcccauccugcgccuccccuaggaucuauccccauaugucucagggugucacuucccugaguccggaaccaccaagcucggacuccaugcagcucccucuuucagucucacgugucucagccagaaguagauaucgcuguggacuguagaacuguaaagaacacguguggaugagcuggagaccccgauucagagggucuggagugcuccuauucucuccggccgcagcugaugggcaccuuuggcugggaacuguguucuauuccccugagccaguggagaauuaaggacagagcagaaccggcugggcacgguggcucgcaccuguaaucccagcacuuugggaggccgaggcggguggaucacuaggucaggaguucaagaccagccuggcuaacaugaugaaaccccgucucuacuaaaaaugcaaaaauuggcugggugugguggugggcgccuguaaucccagcugcucgggaagcugaggcaggagaauugcuugaacccgggaggccgagauugcagugagaugagauugugcuacugcacuccagccugggugacagagugagacuccgucucaaaaaaaagaaaagaaaagagcagaaccuucagaucuagguucaaaccagcucauccuuccaggggcucacggagcucccuguuuucucaccacugccucccucucuagccuucuuauccugccccaaaccugucuucugaucgaugaaacugccuuuggcucuucuuaguguuucuguccgugguuuucacuugcugcccccugcucaagcacuucuuccuuuuucucccaacucugccccuguucccucaauuuauaaugguaauuccuggucuuccagcuuccacuuggccauugcauccucagagaagccugcccugucugcuuuaggugggaaggagacuccaucucugugcuuccaggacaucauguacuuccuccuguucuucccuuuuuacugaguuguucugcuuguugaggggagaggacagaugcagagggcaggggcugcuccucgccaguauugugcccccagcacuuagcugagugccggcacguaggaagcacggguggugccuguggaugagcucacgcgcucugcugcugcuuagccgugugcucuuaagcauguucaucucauagcucuuucuucuauuguagaauggagauaagccauugaccucuuaaaguuguuguuuuaaguagaguuuaugccuggcacauaacggguacuccauaaguacuaguucccuuucuuccaucuugcccucaccccccacccccgcaacacacacacacagagguuuuaaaaccguuguuaguuagaacuggaagagauccuguagcccuguacccauaguugauuccuuuggagacugaggcucggagaagggaguacuuagcccaagcucagguggcuggcaaggaacaggugagagcacggggucccauggccuccaggacuguggccucuuuguacacacuguccuucgagguuugcaggggcagaauugucucuugucucuggauccccagcacuuaccagggugucugccacagagcuggcuguaagagaauauuucccaaguggaugggugggcagauggaugugcggugaaggaacccguagacgggacugggagcugcuuucccaguaaaccaagcagaaaaccauguugcagggaaccuaagguugcagggaaccuucggggcugccuggcagugcuuugaagugagcgcccuucccugcuucucccugucggcgggucccugacccuaggaacuuagaacugaauugagaacauacggcuuguaucgacacaggccacacuauuaagcuaugcuaaauggggagggcagagcacaucauaaaggcccagguaaugacccugacaggaagaggucccgguggccuggagaagaugugcaggagguaggacuugaguugggccuugaaggcuggaggauuucaguggacugaagagggaggaaagggcauuucaggcuugagaagcaguuacaggcgggccgauggagguggagugagcagggugaguugaugaggcaggagggagcuuggcugcacucugugccaucuguuugucuggcacauccuuuucuugucagcucuccauuuucuauauaggaguuguguuggauuacucauaacagacucagaaaaauggcuacucuagcucaugguuuucuccuccuccaguaauggaacaguccagggugguauaggagcaacauuggaaaccaagcuccuucuacucuccccuuccaagacuggguaauuuaugaaggaaagagguuuaauggacucacaguucugcauggcuggggaggccucgcaauuauggcaguaggcgaaggggaaacaaaggcacauccuacaugguggaaggcaagagagcuugugcaggggaauuaccauuuauaaaaccgucaggccaggugcaguggcucaugccuguaaucccagcacuuugggaggcagaggugggcaggucgccugaggucaggaguuugagaccagccuggccaacauguuaaaccccaucucuacuaaagaugcacaaauuagcugggcaugguggugggcgccuguaaucccagcuacuugggaggcugaggcaggagaauugcuugaacccaggagacagagguugcagugagcugagaucgcaccugcgcuccagccucagcaacagagugagacuccaucugaaaaacaacaacaacaaaaaacccaucagaucucuugagacuuauuuacuaucacgagaacagcccccaugauucaauuaccucccacuggguaccucccaccagguccgucccauaacacaugggaaucaugggaguuauauuauuccacccccaggcccuuccaaagcacaaguccucacauuucaaaaccaaucaugccuucccaacaguccccaaaagucuuaauucauuucagcauuaauuuaauaggccacaguccaaagucucaucugagacaaggcagguugcuuccaccuaugagccuguaaaaucaaaagcaaguuaguuacuuccuagauacaauggggguacaggcauuggguaaauacaccuguuucaaaugggagaaauuggccaaaacgaaggggcuacaggccccaugcaagucugaaauccagugaggcagucaaaucuuaaagcuccaaaaugaucuuugacuccaugucucucauccagggcacgcugaugcaagagguagacucccacggccuugggcagcucugccucuguggcuuugguaggguacaguccgucauccuggcugcuuucacaggcuggcauugagugucuguguguuuuccagggcagggugcaagcugucaguagaucuaccauucuggggucuggaggacaguggcccucuucucacagcucuacuaggcagugccccagugggaacucugccuuggggcucuaaccccgucuuuuccuucugcacugcccuagcagagguucucaaugagggcucugccccugcagcacaccucugccuggacaucccguuguuucuauacauccucagaaaucuagguggagguuuccaaaccuccauucuuaacuucugugcaccugcaggcucaacaccacaugugaaccgccaaggcuuggggcuuguacccucugaagcagcagccuggguuguacauuggcgcuuuuuagccauggcuggaggggcuaggacacagggcaccaagucccuaggcugcacacagcagagggggcccuggaucuggcccaggaaaccauuuuuuccuucuaggugucuggaccugugaugggaggggcugcugugaaggucucugacaugcucuggagacauuuuccuuauuggcuuggugguuagcauuugacuccuaguuacuuaugcaaauuucugcagccagcuugaauuucuccccagaaaauggguuuuucuuuucuacugcaucaucaggcugcaaauuuuucaaacuucugugcucugcuuccucuugaaugcuuugccacuuagaaauuucuuucaccagaugccauaaucaugucucucaaguucaaauuuccauagaucucuagggcaggggcaaaaugccaccagucucuuagcacagcaagaaucaccuuuacucuaguucccagcaaguuccucaucuccaucugagaccacuucagccuguaccuuauuguccauaucacuaucagcauuuugaucaaagccauucaacaaguaucuaggaaguuccaaacuuucccacauuuuccugucuucuucugagcccuccagacuguuucaaccucugccuguuacccaguuccaaaguugcuuccgcauuuuuagaugucuuuacagcaaugccccccucccaauaccaguuuacaguauuagucuguucucaugcugcugauaaagacauaaccaagacuugguaauuuauaaagggaagagguuuaguggacucacaauuccacaugucuggggaguccucauaaucaugguggaaggcaaaggagaagcaaaggcaugucuuacauggcagcaggcaagaaagagcaugugcaggggaacugcccuuuauaaaaccaucagaucuugugagacuuacuguugugggaacagcaugggaaaaaacccauccccaugauucaguuaucucccaccgggucccccccacaacacgugggaauuaugggagcuaaaauucaagaugagauuuggguggagacacagccaaaccauaucacacauuuuauggucagugauguccagucaucaguuguuggacacucggauuguuucaacucuuugacuucuauggauaaugcugcugugggcauucauaugcaaguauugguguagacguauguuuccauuucucuugagaguauuccuaggaguggaauugcuggaccauauaguauguugaacuuuuuuagugucuucuguaguguuuuccaaggcagcugcaccauuuuaucaucccaccagcaguguaugaggaccaauccuuccauuuuuaaccucuugccacagcaccuggggccuccccaucuccaggucaccuggggucacgauggguagguccccuggguucucucuuccuuggggcuccccucugcugcagcaggggucucugcucucccucaucaguuacccuuccugugccuguuccucaucuucuggggggacuuuguaucuccugucugcuccuccucuugguccugagaguugagagcucuuugguuccuauagcggguuuguugggaguagugcuaacagcgcacgcccuggcugcugugucugaccaggagccccuguuccaguguaggguuuccaccucugccuucagguauguccccucagcugggcacacccugucuccucugcccuccacucuucuugugaagcccagcccagguaacggccagcuuccccucaucauguagacucuucuuccgugugcuacgucugcuucuacccacacuuuucuuuucuuuuuuuuuuguacagaugggcguuucacuuuguuacccaggcuggucucgaucuccugggcucaagcaauccucucgucucagccucccaaagugcagggauuacaggcaugagccacugugccuggccuagccacacuuuucucugugcucuuguaguaucuguuuucacaguugucccccucccacccccaccgccuuuuaaaaauuuuuaaaauugugaugaaaaacacauaacaaacuuuacugucuuaaccauuuuaaaguauauaguucagucauguuaaguguauucacguugucuaacaguuucccugaacuuuuuuaucuccccaagcugagacuccauaccuguugaacgcuaacucccccuuuccucccucccugcagccccuggcaaucaccuuucuacuuucugucucgaugaauuuuacuuccccagauaccucauaucaguggaauuauacaguauuuggaguuuuuuugacuggcuuauuucacuuaguauaaaguccucaaaguucacccauguuauagauaagggaagauuggagauuguuguaaucuaauuuugcugcuauuacagaauauuugagacugcauaauuuauaagcaauguaagucuauuuagcucacaguucuggagccuggaaaguccaagggcauggcauuggcaucuugccgugucauuugcaauuggcauuauuccauucaggaggccagagcucuauggccuaaucucaaaguugccaucucuuaccacuguuccauuggggauuaaguuuccaacacauacuuuuugaggaacacauugaaagcauugcagagccuuauucaucuguuugcccuuggagccuagcacacugccaggcacauugaauaagcuuaauuaaugauuagugaauugaaguggcugcagugucacaggaacccaaaagagggacagcagaaauugccauaguugguaugaggacauccugaccuagacauuuuugaccuaguaaauguuuuguucaugaugggcauuugacaguuauuuucaucagaauuauaucaacauuggugaguuuauaccaagaaauauuuucugcagcaaauucuauuaugcccacuuaaauccuugcucaguuuuuuuuuuuuuuuuuuuuauguaggucaguuaaaccauuucuaauauguggcagauaacaaucugugcucagauuuacagauaagcuauucugggauuauuucgaaagguaaugcucuuuuggguggaggacuucaagauuaauuuguguacuaauuaacaaguuaaagaucauaccagaacagugaucuuuaagcacggaccuguaguggucaagaaaguaacacaggcauuuccaguauuaaugccagauauuuugguuuauacuccuugaaagacugccugaauuucaggcuguguagaacugacucauccuggaaucuaggccuacauauugcauaucaggaggugcaauaugaaaauaaagucaaagcaagggcccaggcaugguggcucaugccuggaaucccaacacuuugggaggccaagacgggcagaucgcuugaggucaggaguucgagaccagccuugcuaacguggugagacguggucucugcuaaauauacaaaaauuagcugggggugguggugugcaccuacagucccagcuacuugggaagcugaggcaagagaaucacuugaacccaggagauggaggcugcagugagccaagauggugccacuacacuccagucuaggcgagacuccaucugaaaaaaaaaaaaaaaaaaaaaagacagcagaacauccuuuaacacacauuuucuauauuuauuuucuucuacugaaaucauuuucagugagaugagguggguccuuugccuuauacuuuuuagaguggugaucugauucacugaucaauuuuuguuucaguaucuaauuuuuauugauuacaguuuccuuaucaaguccaauaugcugguggaggggguagcgagggguacccaguuucacaggguguugucuuuagcugcucuguaugugugcauucccacgcaccgcuuauuucuggcauagaaaauguauuacgaauggaaugaaggaaugacaacuuauguucauuucuuagcuacugcaugaaaaaauugggagcgauucccuucagguauuccaggguggccuugccaucuugcauggguguguuucacugccaacuaagucuccuugcucccagucacuuugaaaaccacaugcgaacugcucacaccacuggagcaaaagagcaaaaggcagaguccaaagacuucauuugggaaggccccccaggaggggugagaaggaagaccuuugcaauaggauaaauauccgcauuccccaguuccccucucugggucuguaaggcuuggaucucuguucauuuuuucuagguccauggaaagaaauuauuccuuagauuugaucuagaugaagaaauggggcccccuggcagcagcccaacaccagagccuccacaaaaagaagugcagaaggaaggggcugcggacccaaagcaggucggggagcccagcgggcagaagacccuugauggauccucacggucugcagagcucgucccccagggcgaggaugauucugaguauuuggagagagacgccccugcaggagaugcugggagguggcugcgugucagcuuugguuuguuuggcagcguuugggugaacgauuucuccagagccaagaaagccaacaagaggggggacuggagggacccuuccccgagguaaugguguggccaucugauuuucgugggcucugauagucauagggcccugcuuggugggguuugggacuucagcaguggggacauacugaggacguccagucugccccccagggcccugcugucuuggggagagaggccaccucuguaucuaccugugauaggaaguagacuguggucugcaugcaggagaggguugugcaccaagagguggcugggagaaggggagaauuuucccagcaaauguggcacuugaggggggacugucccugaagaacauuuuauugccugacuccugacuagugugcuuugaauuuagggagaagauuuucccaguuuuauuuuaaguauauuguuuguguguuuauuuuuuauugagauauaauuaacauucaguagaaugcagaucuuaaguauucagcuugaugaguuuuuuugcuuuguuuugagacggagucuugcucuguuggcccaggcuggagugcaguggcacgaucucgccucacugcaaccucugccucccagguucaaccaauucuccugccuuagccucggaggagcugggacuacaggugcgugccaccacaccggcuaacuuuuguauuuuuaauagagacgggguuucaccauguuggacaggcuggcuggucuggaacuccuggccucaagcgaucgccuaccuccgccucccaaagugcugggauuacaggcgugagccaccaugcuuggccccaguuuuuauaaucuaugaauguugagaucaacauuuuaugcauaagacucuaucuagguuuaggauauguccucagugucaauucccagaggaguaauugcuggucagagggaaugcauauucuuagggcuguacauuuuucuggccuuaggaaagugcuagcugagcugaaaucucaugaauguuaggucguuuguguacuucuuaucaauguaaugaagcuuuugcacagaaagucuguuuguuuuugugacauguguugccaguauuguuucaagucuguccucuguccuuugauugugcuuaugaugucucuuggcauuugggauuuuaaauuuuuauaucaucaacgguggguauuuuucuugguugcuuguagguuuccccuuuugcuaaaaaaaggccccuucugcccccagagaaagucacaugccuucuauuuucugaaguuuuauaacuuguaaaaauguuuagaaguguagucuuuauuuguguggccugacguagguaccauaggaugcuaugggcuguaaaaauaacucggaguagcuucuguggucuggagauuuugggcucacaugacuggaaguucagaaggagggugggcuuuggggcugccguuccaagguucuggcuuccuguuuuugugauucuccuggcuuugcacuuuccacgcauugguuuucuccuuagaccagcagcaagaggcuacugcagcuccaggauuuuauucacaccaaaaaauccagaagaagagcagaucauuuuuagaaguucagaugaggaaacuuuccuuagaacccccagcaaaccugucaucaucaggagccugcccuuugcugaguccuggauuagucaccagcuggaggcauugaaaugugcuccccgaaggaggcucaccccuagguuuucagauauagugccguagagugaauguguaucaugccauuauuuuuaaaucucuuuuuaccugguuaggucucuuuucucauguaccuguuuuauguuuacuuugcuuugucucuuuuuucuuuaauaggcuggccugaguuuaucuacuuuguuggucuuugaaauaaauacuauuagcuugccagguauaauacugacuccugucuguaaucccagcacuuugggaggcugagacaggaggaucacuugagcccaggaguaagagacuagccugggcaacauagugaagacccuguuuguacaaaaaaauaaaauaaaauuaaccgggugugggggugcauaccuguagucccaguuacuugggaggcugaagugggaggguaguuugagccagggagguugagacugcagugagcugugauugugccacuauacuccagccugggcaacagagcaagacccuauuuccaaauaaauaaauaaauaaaauuagcuuuauauauccuuucuauauggaaaggguauauggaguauugaaaauauuagguugggugugguggcucacaccuguaaucccagcacuuuacgaggccgaggcagguggaucaccugacgucaggaguucgagaccagccuggccaacaugaugaaacccccaucucuacuaaaaguacaaaaaguuagccagguguggugguaugcaccuguaaucccagcuacucgggaggcugaggcaggagaaucgcuugaaccugggaggaagagauugcagugagccaagauagugccacugcacucccgcuugggugacaagaaugaaacuccaucucaaaaaaaacacauuauaagucaaaaaagcauuuaauaugccuagccuaccaaacaucugggcuuagccuaaccuaccuuauaugugcucagaacaauuacauuagccuacaguugggcaaaaucaucuaacacaaagcuuguucuauaaaauguugaauaucucacguaauuuauugaaugcuguacugaaaaugaagguuuuauagguacucaaaguauggcuuuuacugagugugcauugauuuuguaccauuauaaaaucaaaaauuaaaagugaaccauuguaagucagggaugucuguauguguguaugauccagccacagagugugcucugacuacguugugguaacgauguggggauguguguauguguguaugauccagccacagagugugcuuggacuauauuguaacgauguggggauguguguauguguguaugauccagccacagagugugcucuauguugugguaacgauguggggauguguguauguguguaugauccagccacagaguguccucugacuauguugugguaaugauguggggauguguguaugugugcaugauccagccacagagugugcucugacuauacugugguaacgauguggggaugucuguauguguguaugauccagccacagagugugcucuauguugugguaacgauguggggauguguguauguguguaugacccagccacagggugugcucugacuauacugugguaacgauguguacauaugaccuguucuuucuucccagguugguccugcacuuugguggugguggcuuccuggcauuuuauaauugucaguugucuuggagcucuuccccaguggucacacccaccugugacauccugucugagaaguuccaucgaggacaagccuuagaagcucuaggccaggcucagccugucugcuauacacugcuggaccagagauacuucucagggcuagguaugacucaugggaaaggggugaguccacagaguugcuucauggaaaagucgguccugugggagucagaagaccugagggccacccuaguugugccagugcuguugguuuugaggugccacuugcucaaucuccuuucuuuuacuucccuuguuuuuagacugagggcauuagaucaggcaguuuuuaacuugucucucugcuucagaauccacacccuaacuguguuaucaguugugagcccucugccagcagcguuggagcaucaccuccuaaaggguggggucaugucuccggcaccucuguacccuccacugcacagugcagcgccugcacguaggaggugccugaccugugucuguaggaacugaagucgugcaggcugcuaacagagcagugagcgcguguucuaagggaugcugcucuuggguggauggagcuuccugcccuggccagggcacagagaugacucagucuacacuggguucuuaugcgacgcgagugaagaagcuguuucccucucucuauugcaguggcgugagcagugaaacugugagcauuucaggauagggagaagugcugaacaauuucaaaaauacauauaacagcuaauuagcgggacuaugacagcguggcguucuuauuacucacaguaggggaauaauugugcccaaaauugguugcugaagcaaucaggcagguugguggugacagagucaucuccauauccaacauguggccuugcugccugcucaccacccuucacgagggucggaggaggccaggugguacagcaggcacuugccuugcauuuucauguuaggaccaugggagucccugugcacucaggagcgaagagccgucggaaguggcuuuuuggguauauauggcaagagcuaacaguaacaguaguaauuaauaacggccaguguuuuccaagcagcucugaugugccaggcacauguucuuguccuuacugcuguccuguaggaugguuauagugcuuuucccuuccuucagaugaggaaacugaagcagagaacacaucgcuaguaaauggugcagcugagaugugaauccagguguuuugucaaugaauucuggagagacugauguguguaaugaggagugugacuaugaggcucuuggaaacagcaggaauuuccuucacccacucacuccaaacacacagacacucacuugagcucugucacgcucaccaccucuccuuaaggagaucauuguauaauggcccagcaagcauggacucaguccacuguggguuacuaaagauugcaaugaaugccugguggagcugaaagaguaugguuggaacauucccaagagaguuacugauucuggaaggagggaucgaggcuggcuucacagagaaugaggcaggaguagaaaaauaauaagauaacagcucccgaaacacuuucuacauaacaagcauuaugcuugguauuucauuuauuuuauuuuuugacacagggucucucucugucacccaggccagagugcaguggcacaaucacaacccacugcagccucaaccucuguggcucaagcgauccucccaccuuagccuccugaguaggugagacuacaggugcaugacaucacgccucacuaauuuuuaaaauuuuuguagagacaagaagcucucacuguguugcccaggcuggucuugaacuugugggcuuaaaugauccuccugccucugccucccaaagugcugggauuacaggcgugugccacugugccuagcuaugcuugacauuuuguuuuuaauuuaaaaaaaaauuuuuuuugagacagggucuugccauguugcccaggcuggagugcaguggcacaaucucagauuacugcaagccccaccucccagguuuaagcuagucuccuaccucagccaccugaguagcugcgauuacaggcaggugccaccaugccuggcuaauuuuuguauuuuugguagagaugggguuucaccauguuguccaggcugaucuugaacuccuggccucaagugauucacccgccucugccuccuaaagugcugggauuacaggaaugcgccaggccaacauuuuaaauaauaacaacaguuaauacuuauugaguacucuacauaccagccacugugcucagcgucuuuuggugaauucucauuuaaugcucacaaaaaccagguaagccaucccugccuuacagauaaggaaacugcagcuaauugaggcugaggagcuugucagggucacguggguaggaucugcuugagcugcgauucaagugcaggcagucagaugcccgauccguuuuugauagccuguuugccaugacgggccaugcaugaguuucauuucaucuucacagcaaccuuaaagguaggaauugucaacuccauuuuacagacagagaaauggagucagagaucgcagacccgucuagggucccccaggacauggaagagcugauuucugccuuguuaacuuugugggugguuucaucaugccauguguccuuuguccuucccuuaccuucccccgcuuuauuucagggaacaucauuaagaaugaagccuuguacagagcugggauccauccccuuucucucgguucaguccugagugccucgcgucgggagguccugguggaucacgugguggaguucaguacagccuggcugcagggcaaguuccaaggcagaccgcagcacacacaggucuaccagaaagaacagugcccugcuggccaccaggucaugaaggaggcguuugggcccgaagauggguuacagaggcucaccugguggugcccgcagugccagccccaguugucagaggagccagagcagugccaguucuccuaaggagcugguggugcuccucacggaaccuugccgcuuggggaaccugacgucuaaguguccagaaaggaggaugugggcagggacgggguacagaggauagugugggucagaggugccaguaguauaauauucgucucccuggaguuauguugaaggcagaguuuucauaggguuagauuuuuuuuauccuuuucuaguucaguuaauucauccuguugaauugcaccaucgugaaagaugggaaaaaucgugaugauggguaaggggaaaacuucccggaaggcaauggggcaaggaaaaagaaagccuaugggaaauggcugugcucccaacauagcuuugcagaugauguggguuuuuuuuuuuuuuuugguuguuuguuuugagagagagucuugcucugucucccuggcuagggugugguggugugaucuuggcucacggcagccuugcccucccuggcucaagcagucuucaucucagccuccagaguagcugggacuacaggcaugugauaugaugcucggcugauuuuuguuuacuuuuuagagagauggggucuugccauauuugccaggcugguuugaacuccuacaacucaagcauuccucccaccuuggucucccaaaauguugggaccacgggugugagccaccgcgcccagcuagcuccuguguuuuguuuuuguuuuguaacuuugguugauguuaaggcccuccauuuuggaaagcaggaaaacaggauuuuuuuuuuuuuaucuuguucccuggaggauccagggaugaggauagaguggccugagagcagugcuuggauucagccuccugcuggguccuucugcuggauacaggcaccaagaggcggucguggagcagggagcugcgccuuccuggggugcccggugguguguagagaaaagcugcuuguuuacuccuuaagucaauguauuggugacuguugauuuguugaacaauucaggaaucaagggcuguggagaaacucccucauguuguuggcaacaggugaaugaaccuagagcggugacaugaaaauaaagcucacuguuacucgc

SEQ ID NO: 192506 - RNA, 162332 nt, Homo sapiens
uuacccacagugacagugugucauuuaaucgggaugccaagagaucauuuucauacaaggccagcagauguaauuuucuuugaugcaugaauaguucaucauuuugcuacuagaugacaaggugaucacagggugacuuuagaaugcaaguucacuguuugguauuuugaguucucaaaaugaaaaaaagauuuaucaaauauaaauaucuuuaaaaaguaacaaaagugcuacauaugugaucaaggaaaaaaauuccauuaguuacugccgcuuaaaguagauuaaacuuuacaaauauuaccacauccauuaucaauauggcuuccaauuauuaaauaaauugccuguagcaauacagcuuuucacaccucuccaaggacagaguaaagagaacagcaaagcagucccaucguguucucauacagccacaaugugaguaggaaacguccccugcuuuucucugcuccuaucugggcaagugucugcaucugugauaagcagcacaaccccacuaugaaguccucuagugaccucucagagugagggggcuuccguuuaauggauacaaacacugcaaguuuuuucacucauuuuugaccuuagcuccauccuugaaagacuuuuuugguagcagggaaaggggacacugacaggaggcaaagcaacuuccacgaugaccuccaaaacuuuuccaggcaggcacugcuaacugugccguggaauguacagugguucugaaaacuggacuuagcauccauuagacauucagcucauauuuuuuuuuuccaaugcucucaagcuggguuuuuuuuuuuuuuuuuuuuaaugacuuuugguuuuugucuuuguuuuuaaucauggucccaaaggcagaaggcaguauuuuaucuacuaagucacacagcuugugagaggaaaggaugucugugucaggcauguuaacuucaaacaaaaucugagaucggcuuuuuccauugacauucuuagcacagcacccaaagaaguauaaucuagccacaguguggcuauaaugaggcacggcuuauugcagcuggaaaucaauuauccucacgcugagguggggauucuaguguuccuuugacucuguggauacuccccaaauggugucugucauuccugugccacgaccucagcuugcauccuaucagucuuggggaaggaaaagggaguacagacuaguguuacaagaaucuaaagguacccaagauuuuacacguagucuaauauuugagaacugagggcuaucuaaauaccuggaagcacuuucuuggaaugcuaagacggagcagcaagauuuucuagccucgggggcugggagagggaaguuugguugguugguugguuauuauuuacugggaguuaauacugagagaguauaugcaaaggcugagggcaccaugccaucuucacagaacaagacccuaacagcuaccugacauacaagaaacugcaaguuauacuguaagaacacauguuaaggaccgaggaaagucugcuaaggugcuacgucuaaacuaaguuaacuugucauguuuaaccucccugaucagucaucauccagggccucugucuugauuucguuggcuccuugucgggccaaugccaagauagugugguugacugcugccauuuccacagcuaaugagauggggucuugguggucacuauggcucguacugucauccuagaugugcagaaauaagaaauguuauuaguggauuggaagaauucuuuagucacagagagacaugcuggggcaaggggaggcagaacauucgugggaggaaacugggggaggggcucaugauaaaauagagguaaauuguauuuaaguagacacugaauggauauagguccaaagauuuucaguugauaaucuuaugauucaacaaguaaaaagcacaaaaaauguuuuucaucacugagaauucuauucauucuauuaauaagauugcuggugaugaugaucaaaccugcagugauugauauaaaaccaacaauuuggaucuuucuguuuguaacaaauauagcacuaaucacugaaggccauacuagugagcuauuaaauuccagauugcugcucuuacaaauagauuauuagaauucauggucccucucugaacugagaaaacuagacagaacuuacaauuacaucuuacagauaaaaaaugcauuuuuguaaaaaaagaaaaaaagaauucuccauuacaacaggacacaugucacugccagaaacggcuacgggagaaaggggaggaaggugucgagcucuccugcugcaggcagcugugcaaggggagcggcaggcgucuuaccuagaacuagugugaagcuguccuccccgcgcagcucaauguguuaaacaauaaagcugugaaggaagcuggcauugcaggauguacgucaggcacugaagaugguguuacaaauaagggguauguuucucaccugucaucuucaggggaacuccguaucaaagagcuuuggaaaggguaagucccuuaaggaaaaaaacaaacaaaacauggaaugugcugcccuuagggcaucuguaaaaaaagauggaaaugauccaucuauguggguagacugaaaagaggaauguuuccgaacagaaagacuuacagaauauucucuuggggcuauuaacuagaguccuaaaugggaaaaaaugguaguucuucagaaguguggacaucauuguuuccuucugauguucacagauuaguuuuuagaauuuacaaagggaucagcacacacuugcaugcauucuaggugugugguaaacagaggcuauuaaagaacacauuggacuauaugagcuggcugaggagcaagaaaaaagcacagaccccagaaaaaugagcagaaguuuucuugcuguggucuaggggaagguaccaugcguucucugcauauuccaaauggaaauuuaaauccuaucaaaauuuuaaugaaaucugucaacaucuaugugggggucgaggagggacucccacagucuuaguuacugaauuacuccacgcaguggcuacaauuaaauacauuuuccccaaaagcaaugcagaauaaaucagggcgaggugaagagucaugcagguauugcacuuaugagaggaugcaugugucagugugccagagacucuggaagaaccacuccuuugggcaggaggguucccacugcaguggggccagagugaguggggccuuccaucgugcccugcgucgguacguguuuaggcaugggguccagcugccccuaguauuucucaaacacugagugugugucgugaaugguguaacuugcuuguuuggaucagauccuccucucuucuucuaccuucucugcuucucugccucccucugaacuucuucccuccuccuccuccccauugcguacuugccaaguauccuguuguaugacaauaaauccaugugggugaauaacgaucucucacaaauucaacaggacaacugaaucuuaccacauuccuuucaaauuacaugaaaucuaacuagacacaggagcagaguggagggacagugacuguuuccccucccccaccccaucagccacacccaaggaacuaagcugucccacuauacccccugcucaggcaccaagaaccucgcccagcugcgcaggggcucaccugcucagaguagucauucccgucgacaucaucacuguuugaguggccuccuggacucugcacaucuaucccaugacucuccaggauugcugcuucuucgaaaaaagcaaauagaucccuaaauuaucuguuaccuuaucacaauggcugaaacacugaaugaauuuuugugcuaaggaaauuaauuagaauguaauuaaacaagaaccuguauuucucuacauuuguuucuuuuagacuguaagauggaugaaauucaacugcauguaggucaggggaggcacacauuugccauucuggggucucugcugcugugcauguuaggugcuucauaaauacuugcuaacuaacuaaacagucuuccuaucuugggguucuauagagcauaugagaacuguacugaugaauaaaaaguguauuuacaaaggaaggaaaugaaaugcauucuaugcccauaccacgcucaaugcgcccgaucucgucugaucuuggaagcuaagcagggucaggccugguuaguacuuggauggaagaaaugaaaugcaauuuuagaagcuaaaaaccaacaucccaccugacucaccaacuuaaauuucuuauucuuauuuauuacuguuacaguuuugaaugggaacaaauccuuuauuucuuccuuuuucaguuguauucguaguucccucuagggcacuuuuggcauuuuuguuuucucuguucagcuuuauugaaauauaauuaauaaaaauuguauauauuuaugguguacaaggugauguuuugauauguguauauauacauaaaugauuacaucaagaauccauauuucuuaaaugcucuuuaucucugccuuuugcugcguuccuugucuauuaagucucuuucauuccaaaccauuaaucaauuguuuccuaauauuuaagucauaguccaguaauaaugaagaaauucuggguauuacauucccuuucucaagaucuuacaaguaucuuucaaauguaccacaggaguaaucaauugcucaggggccaugucuaauucuauauucuagaacuuuaagaagaaugaguuuuauaaauaauaaugucauuaccauuacacuacaaauaguguaaauaauacuaacugugguuuauuaaaaacacaaugaaagacauuagggcaacuuuuguuaggcuuagaaguuaggauccggcacgguggcucacaccuguaaucccagcauuuugggaggccgaggcggacggaucaccugaggucgggaguucgagaccagccugaccaacauagagacaccccaucucuacuaaaaauacaaaauuagccaggugugguggcacaugccuauaaucccagcuacucgggaggcugaggcaggagaaccacuugaacccaggaggcagagguugcagucagccaacaucgcgccacugcacuccagccugggcaacaagagugaaacuccgucucaaaaaaaaaaaaaaaaaaaagagaaguuaggauccuuuagacuugcaguuucuaaacugaaguuaaucuuaauauaaacaugacguucacaacugcugcacaagagaaaagcagccucacugauacauuaccaauauuggcucuccucuugaucuccuuccuucuguuagcaaaccaauuauauacuuucagggagguaacucuuuccagaucugacagcuuuuugccugugaauacaugcaauaaaauucagauaaucuauaucugggauccaagaauaaacuaguuuuaagggcuaauauuuuuauuuuguugcuuuugauuacguuuauugccaaaacuacagaugcagagggauuuuuaaaguauuaccugguaccauguacacaccccaauuacugaaugaauaaauauguaaaugaauacaaaaacaacaacuaguaacacaacaugcuucaauucggaaagccauacauaauauuagagaauuccacaaagucaguuggcuagggugucagauccacguccaugugacaguacuaugggggcuucauuuaauuaccauuauuguaucagaauaagauauucuuuuuuuauuuuuuugagaaagggucucauucucuuacccaggcuggaaugcgguggugcaauuauagcucacugcagccuugaccuccugggcucaagugcuccucccaccucagccccccagguagcugggacuacaggcccaggccaccauaccaggcuaacuuuugugguuuuuguagagauggggucucgccauuguugcccaggguagccuccaacuccugggcucaggcgaucugcccaccuuggccucccaaaauauugggauuacaagcgugagccaccacaacaacccaagauaaguuauucuuuaucaaguauccagacaacagaaauuuacuuacaucuuuaaggccuuauguuaacuaauuaccugcugucuuaggacagaggauauuauacauguuuucuugaaggcugaaggccgcuaugacuauccauuacuguaacugguuuggacuacauagcacaauucaaguugcauuuuagauuuaccaucuuugaaguccaaugugauuuuuuauggauaguaaccaugcuugccaauacagaccccccuguaacauuuccuccucaccuuuccuuuuguuuuucggcuauuaauccacagugggugaagaaaccagaaagcagguuuguuagggccuugaugauacgggggcaaaauguuccagggagaguucaaguuucugcacagcuuuagggcugggacuuuuggcauguuugaaacaggguacagauuccuuucacuugugugucacuggagcaguuuguagggucuacauugcuagaagucuggcuucugggugagggagaaugaaggucugcuuaauuucuauaaaacauugauacuuuuguauguagccuuuaggccaaucaaaauaacuggccacauggaaaucaacuggaucuguuaacugaaaaugguuuauguuuaacaaaaucuguaaaaugugaaauaauauuuuagcacaaggaagaaaauacauuugaaauauuuaaguggguuuguugacuuuggaacaacaggacuucaaaaugguacugcccuaaauuuuucuuagcuaaguagaagucaucucaauguggaaaggagauagaaacuaacuacaaaaagaauucuuuccccaaagagaaauauagcauuuuacaauuuauaacaauuguuuuaaaaaauucuaucuuaaucuuauauugacaaagcuugcuuaaauauuuaaaacuuuaacauuauuucauaauaucuuuuagcuaaauucuuagaaaaggaaaucuacacauuaaaaaaauaguaauuucaaggucucauaucucauguagggucacuccuugaaaacucuccuaugugagcauuugauuuugaguaccauaaaaacaucccucagaaguacugugugagcaggacagggcacuggccaccugcggaaggauggcacagacugagccgggagcaccaugccaaggcacgcauaagauuaaguguccuagaugccaaccuguaaccaagcgcugugcugcaccgcagagcaaggcugugccugcgaccuuaccuggcuucuguauaacugcauugcaagcguuugcaauuucuucccucuuugcuucaucuggguauugauucucauugaaguaacugcagaggcaaccgauacagacacaaaguuuuuauuuuucaaacauacucucauuaaaacacuaacucacugaaaaauauauucuguaagaugccacacucaagugucuagguccaggcugucaaauggaauguucugugagaguagaaucuuuuaugcuguccaguaugguagccacaacucacaaauggcuacugagcacuugaaaggaggcuaaugucagggauggaauuugaauuuuauuuaauuuuaacuaauuuaaauuugaauaccuccaugugacuaguggcuauuauaugggacaaaacaggucuacauacugcugugcuucauuaaaagaugucauugauauggaaguuauuuuugauaugugugacugauucaagucacagaguuauauuauuuaggcacugguaacaauaggacuuuuuuuuauugucuaauuguuuguaguagaaaaaauuggaaauuacccaaguauccaucaguagaauggcagaacaaauuaugggauaucuauacuuauauguagcuauuuaaaacuaguaggaaaaaauaaguuagaguucuguccacugacccagagggauguuuaugacauauuucuaagugaggaaaacuauccgcagaauaauauugaaaacaccauuauuuucaauauugguauuauaccaauaauaauaugaaaauaccauuacagaauuuaaaaauuccuauguguacguaaguuugcauagaugaaagcuggaagacuacacaguaagcuuaaauaccaguuacugauuuguggggagggggcuuagugggaggaguuuaaacauuuucuuuuucauuuguuaaaaaaguauguauuacuuuugcacuuuuuaaaguacgauaguacuuuaaaaaauaaauuuacugaacccauccuuagaauucucagacccaucagacugcaugugggaacagaaugcuuauuagugcuacuuuuucagucacccaugaguuuaaaaaaagaaaaggagaacuuucaugguuucaacuuggaaacuuccaaucaggaaaugggccccugucaaauucuagcaccuaccauuuauucagggguuucccuuucccuguaauccagccuuucuuaugccuucagcacuccugucugcauugguggaaaugccauccuauugugaauagcacuggaggccccagcccuuccugaggaucaccugcaaacccagcuccuaacacuacucccuccucucacugcccacuccuccuuggagggcauggcuucacugccaguuauuuauuuauuuaaccucaucugaugcaguccugacucacagcagcugcccccaccuaaccaccuuuuucuucuguaaaacuuaagucauagagcuauauccucccagucuugucaacuaccacccuccaccauggucuucugcuuuauuugagcaucucuuccugcaugauuuucuccuaucauuucugggacuccaguguucauacggaggauuuuuccaagucacuacccucauaauugcuucacuuucacauuucuaauggcuuuugucucugcccuaugccuauuuacuuaggcugagaugcuuuggauuaacucugagaacuaacagcauggcugucaccuaggagccaguuagaauggcagaaucucagaccccaccucagacuuacuaaaucagaaucugaauuuuaacaagauuuccaggugaccuaaaugcacaggucguaacuucugagauguacuggaugaguucauuuacacaaaauauacaaaaacgaaaagcagauacuaaguaccuaauaugugcuugucacuguggguaaagaaagaugauauaguuucugacucugaaguguucacagucuacuacagagagacauguaagucaauauccuguggugaaaugccauaggauguauggacagagcacugaggcagcauggaugaaggcguguucaguguuguuggcaggagccuggaaaggcgucacugaggagugccaucugaguuaggucuagagaaugcacaggagguugcaaggcagagaagaggaggaagagcguuuuauauaaaagggaacagcaugugcaaaggcaaaaugguagauaaaagcuuuugaggacucugggcauagagaagaguuaaauguggcuagaacauggggcuuguacaaagcaaugaugagauacuggccuggaaaggugggauggggccagcuugugaagacccuugucuguuccuuaagaagacuucauacugaaauaaacggggugccuuagagguuuccaagauacacagagauauacucccaucuguuuucuagaaagacaacacuuuaucuucaaggcuuaacccuuggaauucuaccuccaugaucuuaaauucugaaauuccccagucaacuuuguauuuaccuaugccuccucuucaaaauaguuuguucuucacuuucuuuauuaucucuaacugcuuaauccccccacccaucaguuacaaaaacaaaaacaaucucuguuuaucuuuccucuuugggcuucaccucucauuucuuagccugaacuccauggcaugcgaaaucagcaacuucccuuaggagaaacuagauuguuuagcuuuucuguccuuccaccauaccuguccagccaaucuccuacccugcagaaagcaacuuccauuuauuuucuuccauccuucucucaggggaccaaguguuccuggacaaagucauaaaauagggccaauugguuuuuuuaauaaauccacauuuuucaaccuuaacuggaacccucauuucuguugggaauucuauuggucuuuucuaaccaauugccuuucauaucccaucuccugccccacuuaccugaaaacuuuacacucucuuaccccaagcccucaaacugaccacugucacuuuuugcagaugaccuugcuuucucucuuaugaagauggagauuauuuaauaugaguuaauugcuuggcuucucaacuuguacacuguucugagcauuacucauucaucuuauggcagaggaagaugcaugcauucuccuccucuucaaggucaacuucuccgcuuuugucuuugaccucauuccccuuccuuucauuuucucaacucuccuuucuuuccugcauaucucaucuuuucccugugcccauacagugaucuuaguucacuguuuuuauaauacauauuucuucauuauugugaucuccgaagucaggaugcauuuuauaauuggugguguuuugucucccuuacugguacgucaacuaaggugugucuuacaaucaaggccuucuuagauuugaugggauacaguaguugcuaagaccuacggguuccuuuuaagccauagcucuuuggccagugcaccucauugugacaacuuuucuuccaagugacugcaaagccugugaugacacuguacccccuccaaugccugauuaauauuccuaaagcacaucucuagucacuauccuguucagaaauucucaaagguuuauuauagagguguucaaaguccccccgcaaacaaccucuacaucuuuaucugcuacucccauauaugcaugcuaccacccaggaaaauggaauaacucuguaaacuccuugcaucucugugccuuucucuugcaaguauaucagcuuuuugccucccccaccccgcagugcaaaucuuauccaucuuucaggguacagcucaaauaucaccucuuggccaaucaaagguauuuuuuuugcccuaugaaucccaccgcacuucaucuguuccucucuuacauaucuuucaucuuguauuauaguuaucacuguauacaucugucuucuacuacacugaaaaccaccugaugccaggguacaagucugaaucauccucacacgcgcuccccacuaaugauaguguugacgagccaauaaugauagacaaaggcaccaccaacccagugugggggccuccaaaagaaauggaucucacaguaaaugaacugcuaacaagagaaggcaaagagguauugcaaaacggaucuugaaggauacguacuaagggguuagcaaugacuaucuccaagaagcaagaguguuggggaugggggcaaaaacaggaaaauacugguggcaauuaagaaugauuuucacuuuuucuuggagaaauaagaaaaaauuuuaaaaaaaaugacauucugccuuauaugcuucucuguugaauuucugaaauaaacacaugcuauuuuuauaaauuacuuuuuaagaagagaacuugggggagacaguacaauauuuaagaacucguuuaaugaucaauacaauucuguaacuauuuauguuuggaaaguguauuuggaccagcuagaaaauauuaggauugugauuucuguucuuguaacaaauagauaaagccaugcuaucucuggaagcuaaacuagaauucgcgauuauucaugguauacauaauuuuuguacugaguuaaaaagguuuaaaauuaauuaaauuuaauuaaagauuaaaauuaaucuguauuuuuaggaucuaaccauauaaaauaaagaagaccagaguaaaaaaggaaaucaguaacuuucuccaaaucaaaggcuaaagaaaauaagaauugauucaauaugguuuuaaaucucuaagccugguaacuaauuaauccuuucuucucuauuaaagaccuguuauuuuuguaauuaaaaaauguaggccuauuaaaaaauaugaauugucauugaaacaugcuacucuagcuggagguguauacaaaggacuguuagcacaacuuucuucuuucucuauuucuguaauguuucaauguuuaaaaaauauuaauucaagauauacaguauaaucuaaacugauaaaaugacauuuauaguaccucaugguaaauauuuaaguuuaaaaaguaauaagauuuuuuuacugcaaaacucuuaaaacuuuuuugugagaaaagacacacaauauugauauaaguagaagaguuuuuugaagauaaagguagaccaggaaauaaaauagcaaacaacuauguauuacaugacuaugcauaaggcauuguacuugagggguaugaguaauuucaaaauaugggccuugauuaugguucgagaagaagauauaaaaaagcuaaauaauaaaaggagccaaaacauaacugacaaaaugcaucuaucuucuaauuaaguauaaaacaacauguuaaauucagaaaagagugauaucucuguggacugggcugaucugggaaagcucauugaauuaggcaggcuucugaggggugcacaggcugcaggcauuggagaggcaaaggcaacauuaacaguaaagacgaaaauaugaaggcauaaaaacuuaagacauacuugaaaaacagaaggcaacuagugaugugaucugauuacacuauagggcuuacauaaggguggucauacacccugguuugccugagauagugcuguuaucuuggauuauuaacaaaucccaucuuaaucccccagaguguccugcuuuggacaauaaauuauguggccacccuaggaccacacuacauuauguacauaucugaauuuaauguaaacuaaaauccucugagucuuuuucacaugugcucugacaaggaggacauaguaguugcucagaaaaaaggaagcaucaagaggaagauggcuaugguuucuaucuacucacaaaaggagguauuuaagcccaaaaaaauaugcuuggcauauaauagacaguaaguaucuaaucaacagaugguugaauaaaugaauacauuagggaauaaaugaaugggaaaaggaaacaaaggugauaacagaaaacagugguuucaguuaagacuuuugguaaaacccagacuaucucaggagaaagugaggauuucaccauuuuguacaauuaucuucucuaaguacauuuggugguuuggccuaagauauuuuuauuuguguuuauuuuugauauuuguguuuauuucugagcuauauauaaccaaaaugagcugccaacgaagucgggaaauagaucuaauaacuuugauuuugaauauacugaauuaaucauucauuuuaaucaccuaauaauguugaguccuaguuuauaccgggcaauuggcuaaaugguggcaaaggugaaccagacaaagcuuccccaaguagucaccaggagauacagguauguaaagaagauauuaugaaguacuguaaaagaaauuauauuaguuuuaugaauacaguacugcaguagcagagaggaguguauacuugggcagggucuugaagaaagagcaaggguuuucagggcagagagggcggguacagggaaaugcugucaggcagaggaaacaacaccauguccaaaggcagugaaagagucaugaaagagcuuacaauguuccaaaaaugggaaggaguuuaguguggcuagaauacacaguguaugacaggggguugugaaagguuggguccagauuuuaaaggguauggaguuaacuuucuaggcaacugggagcuguaauuuaaagcagagguauucuaagaucaaacuuauuuuuguagggcaauaucucugcugauauuagaggcagaagccaguuaggcagcugugaugauggcuguggagaaggccucaaauaggcugaggccuggacauagaaaggaaaggugagauucaagagaugcuuuggaauggugauaaaaugcauucaagacagcccuaggaacaguacacacuguuauuaaccuuccagcauuuuagauuauuuugaaggacuagaaauuucuguuaccaaguggauaaacuguaggagaacuuggcuauuggacucuaaaggggaccuguuucugaaaugaaacucuggagcucaaaacauacuucuaguccauauaaaauguauauagcccuaaacauuuucuaagacaaaacagaaaagaagcauaaacaaaaguccacagguagcaauaaaaaaaugauaaaauaaauccagagggcacuacacuuuuacaaaggacacugucggcugagugaucagugaaugucuucacagggagaaaccaaaugaucuuuugccagacaaugacaacaaagaauuaaaaugaaaaguggcaaaauaauuuauaagagaugagaaaccauaagcuaguaacaaauggaaauguccuugaaccacuuucauuucaauaacacugaagucuauaaaaauugcagccaaauaauuccuccuuuugugucugcgugaacauauagaaaagacagagacugacucuccaagcaagggauaaugccauguaaaugaacauguucuucugugccuucaugugaacuaucucugcuaaagagauauucaaaccucaucauuucaguuauccaaaauaagguuuuaggauugccagacauuucccacuaacuacaauucaguguguauuucuucaucaccaaguaaacuuacugggcagugggcaggaaaggccugcuuuuagaagaaagauuacucuuucagaagaaggaaaaaaaccagcuuuaaacauacuuagaaccuaagucccaucuccuauuugagaguaucuaugugguaaaugaucucuggaaauaaacaaaacaauuuacauauccaaccaccagggacuggguacuaaauaagaggauauucuuaaaauggauuuagucaaugaaaaucauguuuucaaagaucauauaagugagaaaguauaaaacuacauaucuggcauaaccaucuuuuguuuaaaaagauauguagauguauacauaauacacagaaaaaugacuaaaaugaaauaugccaaauguuaacaauuacuaucuuuggaugguaguauuaagagguauuuuaauuuucuuuauauuuuccuguguaucccucaauuuuauauauuaagcacgugcuaauuuuauaauuuggaaaagcauuauuugaaaauaaaguuugcugucuuaaaguaucggcaaaauggaauuagauuaaaauuauucuuaaauaauaaacuuuagccuaucuuaaugcuaacuuuuagcaacaaaccaauuugcauuuuaaaaguuuguuuugcaaacacacugagguauaacaaacaaaagauguucuuuacuaauguauuuuuuacagaugagcuuauuuuuaacuccacagacuuaauaaaauaaauaauggcucuguccauaucaaccuuucagaaggugugagcacaagcuaaaauauacaugaguuucuguaaguuuucaugacuuugcagcaucuuaagguuuuaaaauagaauagcccgugaaaagagaagaguacuaaacggaaaaauuaguacuggccuaggaagugauucacaugagaaagugaauucuugaagccuaauuuacaaaugccuauggaaucgcauaacacagcucauuacaccuggauuucgauguaacagaguagaucugacaaagaaucaaagaccuuuaagcugaaagcuucuuuauuuugcaggggaggacaugaacuuugcaaaugaggagccagaaagaacugacuugcucaaggucacaugacuuauaacucagguuuccugacuuauuaguucacuggcucaggaacagccacuacucagcuaagacaugguauuguuucggacuucaucucacauauguaaugaaaaucucugugucaaugaaucaccuagaccaaguuccuguuaauuucacaagaguuccuggaagcaaagaugugacgguaucagaaagaaacucaugauagcccaaggaccacaguuacaucucaucuagccuugccuuuuccucuuugggaaaggaaaucuaauugcucuggagacacaaccauaacacugaccuuccuuuuuuccugaguagaggagaauuaaauaaacccugggacuucucacuugaaacagaacaucaacacccauuaaaagucugucuacugcacaguuaaccuaucuuagaagaguuagugccucuucaggcacuagcagaaaacaaagcuuccaaaucauuaucaggaugguaggaugcuuuucuuuacuuguuuaaaaaagaaaaaaaauccauacaugagaauaagaauuauggacaccauguaugaaaugugcccuaacauaaaguuuuucuuuccccaggcccuucacugcaaagacucuauguuuaaauguuucauuuacuugcagcaugcuaauugccacuagaccccacuugccaauugauaaacaggugucaagcauaacacuggauuuagaaggugaguuuuuaguacacuuuauccuauuacugagcuuuugaaacaauacaggcuaucacuuguccuaaaacaugcagcccuaaaugaagugcuuaccauauuagagguuuggugugagucuuauuacuauguaacaauugguuuuccuuuuaauguguauuaucuuuuaaucaugucuaugaagaacaugaaaagaauggagauaauuuucuagaggugucacacaaaaacaguaaaacugacaaauucgaaccaacuuaaagaaaaacugagaaacaguauuucuccugaaacaugucuuuugacuaccgcugaauuuagcaaguauuugcuuagcucuccauuuuauuuaaauaaugaagaaaaagaacaugcacaagagggcaguguuugguuuugcuagucuguggauuuccuaguuuccuaaugaaacgaccaaaugugagugacaacuaaggucauaccagcggaaaccgugguaccuaagucccaucuacuauuugaguaaacugcacuuaaccaguucacaaacuccuagggcaauggcaguaguauacuccuuccugcauuugcuccacuuuagcuagauggcagcugcaucuugcuuucucaguuuugucagccuucacugguaggagguagguuuaccaaagagguuuguaaggugaccuagaauuaaguuucuuauuccugguguacaaggugucccaaggcagggagacuauucuuuuuuuuaaaagugcugaauuauaaacuggucacuuacaaaccugacacgacugaccaauaauuauuauaacauggagaucaacagaacaggauugauaaggaucaauccauuguuuuuuugcaugguuuuucuuaugaucaauacuaugcuucugcaaaaugacuaccucugacuaaaaggcuauugucuguaucuaaaaugagaacugguccucccagggaucaauccaaauucuuucucucaacaagcagcaaaccaagcauggagaauagcauagauucuuuuaagaaucagaggugcacuggucugggauuaucuugauauaucucugaaggcggagggagaaacacaauacuuuguacacauggguacuuauuacuuuuucuuaaaccuagacuucuacuucuuuuuucuuagguuugcugcuguuuuaggugggagucaaucaaacuaccaggauauagauaaaugaguccucaauugccuuuauuuauuuauuuauuuuauuuugagauggagucucacucugcugccccggcuggaguacaauggcgcaaucucagcucauggcaacuuccgccucccggguucaagugauucuccugccucagccucccaaguagcugggauuacaggcaugcaccaccaugccuggcuauuuuucuguauuuuuaguagagacaggguuucaccauguuggccaggcuggucuugaacuccugaccuccggucaucuaccugccuuggccucccaaagugcuggauacaggugugagccaccgugccuggcccucaauugccucuugaaaagccaaauuaauucugauaacauuugaccaaaaauuaugcuacuuauauuaauacugacagagcuggaaaguuaucuuaccaauuguauacaagcuaaauaaauuucuucacagucacacugcagagcaaaaauauuuugaugacaaaccuaguaagaugaugacaauuacauaauaaugucaagaaggacagaaacauagcuuaaucuggccuuuuaauuucauggacgacgugucaaaguaggaaccaauuaaauagaauauuuggaugagacacuacuauaaucaggacuccuagguuuucaaaguauacucuaagaccacuuuuagaugccuccuaccacuaaacuaacacaguccauucaaguuuccucaaccaaacuuggauauucaccaacaaguucagauccuaccaacugagaucuucaaacaccaaacacauauauaagccucuguacauguugugaauguuuaguauaacaauaaugauuucuuaaugccauuaaggccagaaccacauuugucuuguuaauuacuguauugcucaguuaucuauuacaaugauugguacaaaguagaagcucaauaaauauuugcuugaguuuuugaaggcucacuaguuuucugugaagauuuuccaauucgucuauaaguugaucucccuugguauuaauguuuauaauaugaugccuagaauucugcucugggaugaaucauauacuuaauuggucacucauuauauacaacaccaguauuuaccuaacugugcuucauuuauuuguaaacugcggccacagaacauuguaugaggaacguggggucuuuugcccuguuuaauuggcuuggggacuagagaaauaagggguaugccauuuguacaaaaugaaacugcuagcaaagcaucucuaugaggauagagaaaaauuuuaaucugccucaaaaacaucaugauaauuucucuucuggcuauuucuguuugaccaaaaaggaaccaggaaguauaauuugccaauuuuaaaauacauuuaagcacaguucaucuucuuacuggcuaugagaaauggauugggauaacuuuaccugucaauaagugggaaaauuuuguuguuuuuuccucaaauagucuaauggauugaaaugaggucauguccaggcuccugcugucuauuuaaauguuaagaacugccuucuauuuguagagagauacaggagguguaguucauuauguuccacccgagucauuccauaaggaguauaaaagaggauaaacuucuuuuaaaauacaacuuccggcauaauuaaucccaaaauuuauaguguauucuuccagcauguucucuuagaacagcaaugacaucagaagagacaggaaggaagaccagcuugccagggguugcggugguggcaaaacagccuaagggagggcagagugcacguuuuacauccucauucauuauaggccaggacaaacaucacauuuuaaaggacucaacucugcucccacaaaauguuuuuuuaauggaugagaaugauauaauguucuaaggaaaacaacacugaggcauucaaaaguaauuuuccuguuuuuugagucauuuugauuggaucacuuuaaaucuuuugauuauuauuaucaaucaucgaauugauuugaaugccuuacgauuuuaacaaaauuagaaaauacugcacuaccguaucucccaccuugagucuaacauguacggugggggaaagagggugguaauauuuucuaauuuuguuaaaguuauaggaucuucuuaaauauucaaucaaguucaagugacacucuguaauaucagacuuuacauacagcacuaugccagccuauagaccagccgaguauaaccaaacccuagcccaaaggagcauaaaaacugcaccacugaaauaccaagucaacuuuacuuagcagauggugaaauaauucauucuggcaaagauauugcccaaauuuucauccuagcaaugcaccuuuauaauagaagucaguuaaagaaaaacugaauuuuauaauuuuuguuaacaauguaccuguguaacacaaaucagcaggaaaaaaaaauugaucaaaagauuuuuuuuuuuucuaauugaaaaugacuggaauuucaagauguuuccuugaucauguagaaaggagaaucuuacuuaggcuucugucuuaaagaaggcuagaaagauuuuucaaaacaguuucaauuuuuuaauucccaggauguuuuacaaauauuaacagaaaauccaccccccuccucccacccccaaaaaaguuugaaucauuggcaugaaagaguuacuacuucuguuuuauaucugggagaaaaguggcaccaacaaccccaaaaacugaugaagaaaaauguuuuuugguuauuaaaagaacuuacuucacauagauacaaauaggaugcuuugcgaaagacaaauguugcaaaugucgcaauguaaggucauucccaaucuggcugcaaccuacucacucagccucauuucccacccaacugagcagacacucagcagccucauuuuuccagccucugugccuuugcacauggugcucccacuacuggccaugucauucuuccucuucucaccucauugaaacuguacugcucuccaggaccccacuccacugucaccucaggguuuccuuuccuugcaccacucuccuguguccuuauuguacuugguacacaucucuugcaugacauuuuuaaccugacuccuccaauggacugagccugccagggcuaggagcuaaucuuuccacacuccucagcacggggcacaguguugaggagcaacacuauuagaaaagguauguuccuaaagccauaccaaaguacuccuauuagauagguaugguuauuaaagucauuuauaauaagcaauuuccauaaggacacauagcuggugaguaagaggguagggccuggagcaccaguuguucuaacuccaaagucuguguuuuuaaccacuaugucaucagaaaaaaaaaaaaugacaagaaaaaaauguacagacuauuaaauauauaagguaaauuauuuauuucucucaauauuuaucuuuggauauuuauggcuuuuuacguuauuauaauaauauacuguuucuucuuuugcuuaacauuauuucauuuauauuuucuucaaauuuacauaggccauaucugucaucuuacaaugauauucuacuuaauaaauucaucaucacugacuuagccacuugcuacaaagcuaucagaguugaauguaaagaagcuggaaaaacauucgcugaauuuccuauccaaauauaaccaccaucuuggucagacacaugggcucuuugauaugagauaugaagaagauauccucagcuaguucgcucaauucagcagcaacauaauaaagaagaaaaugaaauguaaguucuuuuugcaacuguaaggcacugaaacaaguuuuagagauaaacugaaaaauaaaagaaggugauuucuucuaagcaguaggaaggugaguuuuuaguuuucucauuuauaaggaagaaggaagcaauucuaacuaccuagacugauaaaaagguaggugaacaauaauuucuuuccauuuucagauugcagcaaccucaagauauuucauuucuauaaugcauaaccauaaaaacugagggaaccacaauccaagcugauugcuaaacaaaguauuaagauagaucaugagaauaugcauuaaaacacaguccugaagaacugcucuucugccagagcuuaguuauggacgugauuuuguuuuuugaaguuagucuguucauguuguuauacuaagaaucaguuauuuuccaaagauuuaauucuagggugggaaauaauuucuuauccaaagccacagaaucucagagaaaacaaaggcucuacgcaaaaacaggaaauuauuuagaaucauagagugauauaauuuuaauaacuugaaggacauuuuaagaaauuacauaacauuuacuaauugauuuuaaaaauagguuauugaccggccgggcguuguggcucacaccuguaaucccagcaguuugggaggccaaggcaggcggaucaccugagguugggaguucaagacuagccugaccaacauagagaaaccccgucucuaauaaaaauacaaaauuagcugggccugggguggcacaugccuguaaucccagcuucucgggaggcugaggcaggagaaucacuugaaccugggaggcggauguugcagugagcugagaucacgccauuguacuccagccugggcaacaaaagcaaaacuccgucucaaaaaaacaaaagguauugaccaauuugcuuuuuacaugaaaaaaaaaaaaaaaacuggaaccuaauacuuuauucagaaaauauaagauaugcuaaagcauauacuucaguuuuacauuauaaucaacaaaacuaacaacagaguuggaggguagagggugugcuuaaaagaaguaaguguaaaagaaaagaaaaagaaauaaacagaagucuuuuuggcaaacuaaaguaccagaagguaaggaagaggaagauacagaaaggaguuuaggaacaaaagcaaaaaaaaagauaauaauaguaauaauaauaagggggccuaagagaaacaagaaguacaaagagaagaaauuuggguuaaaugaaauaaggacuuuugucuuccucaucucugugucccaauucuuagucuaaaccuuagcaaccgucaauaaauguuuaccacauaaaaguuaaggaagauaaagggcugagaaguucaaugaguagaauuauucuucaaaucauauuuuacgguucccguaaccguaaguucucaaaauaagcaacuuaaucucauuuauucugugaauguaaccaaguuaauuagucucuuugaauuacagguucuugaucuaaacaacaaacugaacuagaugaucuuuagggucacuuccuuauucuuugcaguaauggugaccaaauauagguaaaugaaaucaaacgaaggcucucagcuuacaccuggacugcuuaaauggaaucaguggucaguagaugcaauuuauauuuuuuuauacaacaagagcaaaagucacuuauuguucacaugacacaagcugcuguccaaagaaacauccagauagguuuuaauguuucagaagagcaauauuagaaaggauuuauaaguauuucugcucuaauuauuucucuggcuagguguaaucuuacugacauuaaaagggucucuaacuccauagauuucugcauaagugauauaaauauuggaacauuauacaaaauaaugaaggauauaaacaaaauagcaucacuaucacaaugccauaacaaacugaggauacugcuaaggaagaaaaacaugauuauuuuugcauuuugcaaaguaacaggauucucuucaagaaguagaguguuuuuuuaauaggcggaaaauccuacuagaaguuauuucuucauuuuuaaaugacaagaaagccucaaauuauauaaagcaaacaagaagaaaaaauauacuaaaugaaaacauagcuucaugaaaugagagcagaaguggagagagcuuccuggguaaauauuuaaaaaaucucacugugguuaauaaagguaauaaaagaauaacaggaagugacacuaggaaaauagggcagguuaauauuauucagagauugcuauaaaagagcacagaagaaacugaucuuccacagucacuugaagcuugaaccuaugagucucuuuugucauuauuuacacauaugaaaguauuacugcagaucaucauaucaucacucagcauaguucagagucagaagacuaggaaaaggaauguucuuugcaggucaggguuuugaugacuggcaaaacacuaggcaaguugcacugcaguugucugaaccacacccagacugcaguuaaauauagaauuuaguuucuggaacuguuagucuuaaccuucacugaaaaaauuaaaaguaaagaggagaaaggaaagagacugaaaccaaagucuauguacuaauaaacuguccugggaagaauuccaaaaugcagugaaaaccaagaaaauuaaauuacagaaaccucaagcaauguucuagaaaucgcuuuacaagcugauuugucucuuccaugcuaguucucccaggauguauagcauccuugaauaaaauccacuugguuacuagagaugcaugucucuaauucagauuuuauacaugucagguuaacagcagugacaccaaauuuaaaacuaugauauaauuuugguucguuauaguauugugguugugaugcuauuuuuguucaugaagacacacuuuuauucuaagaccucauuuuuagaugcuuaaauuugggggaaagagauacucucaagcuaaaauuuuuaaugcugauuccuugcccgggagaauauuuuggauuaauuuuuuaaagcuguuuuggagacugacagggguuaaaacaacaaaaacaaaauauuuucuguauaauuucagaggguucuaggcuuuacuaaugauuuuguuuuauauugcucacugaagaugaccauggacagaauuuaauaacaaaaacacauucaauauacuuauccauaagaaaaauaaaacacgcaauaguuuuaauuacaaacacaaacagagauauucauuugccuucauuagcauuuaauuugcauguuccuggauacacccaaauacagggucaucauucagccacuucgauuaaaaauuauagcaaucaguaaccuuuccacacaaauuuggcccccaagcugguacuauuaaccacuauauucuauugcuucuaccuaucacugcuagguauucucacauuuauuccugcauccagucaaagcuuuuuuccaaguuguugcuucucuuuccuucuugcuuaguuggguugaaaaaccuauaaggagauuuggaggcuuauuuuaccuuccucccuugagacuagaauaggugcaauagccaggucuuauucuuuugugucccagucacauacacuaaugcuccagagacacaccuguuuccaaagauaaaggaauauguagcccaaaaugcugaaagauuaguaaggaaagaguacauuagaagucacucuccuaggccaugaagccuucaacacuucugacaaaaaccuucucuucagaucuacuccuuucacucuucucacccuuaaauguaucuguucuuucuaucccuagcacuuugccucacagcccguaaguacuucauugaaugaaugaacaaauggacaguuagguuugcagaaucacguuugagcauuguagaaucacauuauuugcauaugcagauauuucagacauacacuacagaugacuuuuuuuccccuugagaauauguaaacuacuuaagguaagccuagguuagugcuaacacacagcaaaugcuuuauuaaaaaaagaauaaauauuagucaauuauauauuuuauccauuaaaaucuagucagguccucuuuaaaaacaacaaaauccuuuuuaauuauaaaaauuuuaaacccacacaaauauaauaaacccacaacccccuacauaccagcuucaacaauuaacaaccauuuugccauucuuguuucaucuuuucccuguuauaauccccauaugcucuuaaacaaauggaagguuguaacauauauuaaucuagggacaucagacuuuagaguuaacgaagcccaaguccacaaauuaaaaaccaucaguauauacccaaauuaaaauaacauucuucuuaguuaauaagaacucaaaucugugaauagcacuggcuaaacauccacaugugacugggacacuuguuagcucuguggucuuaggaaguuaguuauucaaccucuuugagccuugacugccucauuagaaaaaggaaaaaccaggccugcagugaggauuaaauauggaggguaaguauaugugaagcuucuaacagugcacugaauaaaugccuuuuuuuaaagcagcuugauauaauucauauaucaaaaacuucacuuauuuaaggcauacaauuuaauaguuuucagcauauucacaaaguuguacaagcaccuccacaacugauuuuacaaaucuucaucaccccaaaaagaaacacauaccccuuagccaucacaucccccacccaacaccccuauccuccccuagcccuagguaacacauuuaucuacuuucugucucuauagguuugccuacuccagauacuucauauaaauggaaucacacaauauuguccuuugugacaauaaauguuuuuggaauuggauauuuuagaagucaaauauguggaauacacaguggaaugaggucagagaaggagaaaaugcacauauauaugaaugaugcaccaagacacacgcuaggaaauauacauaucauugaagugcucuggguauguuaagaggcaggaaaacuguguguguguguguguguguguguguguguguguguguacaugguagcaaguagguaguuuguggacagucuccucugauugcuugauuuuccucauuuccguucaugaugagcaaggucaucauaagagaaugaggauggggaguuugcacagagagaagaaagugugaaauaaucuuacaggagagugggaaaaaauaaaccagaaagguauaguauuaauucugcuuggcagaauuaaagacccacuugagguuagcggucaugaauuuaaaaugagaucagucagcaggguuuuaaguuuuucuccagccacauuucgcugcaaaaaugcaggaacuguauaaauggauauauuuaaccagaguuuauucacacucauggcuuuaacuguaccuaauauauugaugacucccaaaucuccauuucuagugccacugaacucucuaacacagaaaucuugaggugacuucacagucaaagcauuaaacuagaagaagcuuagauggaaaaagaacacuggucuaacaaugguuaugagaaaggcauucuacugugugauuugcacauauuaucucaaauaauucucauaacucuucucauaauaaccaucuccacuuuauagaaagcugaaauucccacagauuaacauaaagugaagcugugacuaauuccuaagucuguguggcucugaagucugucuuuuuacuucaucaugauauuuaacucuucauaaauguggcaccuggggcccagagaugcugaaugauuugcccaaagugaaagcauuuucuaauggcagguacugucucccagaggcucucugacuaucacuaugcucaacucuuacauauuuccugcuuugucauucaaugugugacuagguuagauuguuuuucuuccauuuuuuuucugauaucuaucacuuuuuauccauuuucuauccuuuugcuuuuacaauauagcuuagacccucagcagucaugcauagguuacucuaauagcuuccuaagcuggccuccaucuauuccuccucuacuccaguguucuccaaccuuuuuggcaccagaggccaguuucguggaagacaauuuuuccaccgacggggugggggguagggagggugguuuagggaugaaaaugaagaguucgagcuccuaugagaaucuaaugcugcugcugaucucacagcagguggagcucaggcaguaaugcuugcucugcugccacuugccuccuacuguguggagguccacagcccagggguuagggaccccugcucuaauccauuugcauauggguuagucacuuccuuucucugaggcucuuauauauaaacugcaaauaauaacauaccuacaguauagaauugugaagauuaaauaaaaauaauuucguauaauuaucaauaaaaucaguaacuguauaguaauuaaauuccuauucaaauguaagcuauuacugccuuaagauuuaugaaggcagauauuauaacuuaaauauauuuuacauuuuauuuuacauuuauuucccccugauuauaugcauguaguauguguuaaaauacauacuugauugauuucuuguccauuauccacacuccuaccgcuauuaucuaacagaccaaucuaaucagauacaucuccuacauaaggcccgaaugccaacacuuacgguauaauuaaccacggugcuuguuuaauuauagaaugcacaguauaaccaaguucugaauaaucaaaguaagaaugcuccuaacauuauaaugccuuuucucagauucucuaacucaugaacuccuaucccucaucugaaugcacccaaaauguuaccacuuugguguaguuuuccucuuuucucuacaugcuccuuuugucauaauagcauucacuucucaguuccauaauuacuuacauguuagcucccucccugcugccacacauuugugagggaguacauuucaggguaaccaaauuguugaugagggaaaguucuuuacagaagaauuccagcugauuaauguacaagaaauaaauuucaauacaacaacuugugacuccuuauggaaaaaugauugggaaacaaucgucgauagauaacaaaacagugauucucaguccagccuacacuucagaaucacuuggaaacuuuucaaaauauaucucugccuaggcucuacacccagagauuaagauucaguccaucaggggugaagcccccugauaguuuuaaaagcuccucgggugauccuaauaugcauccagauuuaauaaucaaugcucuaaaacuauuagguagaugguuaauaggggauuuuuuaauaagugaaucaagaagguaacacugaauucacugaucaaucuuaugguuacuaaaauuggggcuguagcgguggaucacaccuauaaucccaggacuguaggagacugaggcagguggaucucuugagcccaggaguucaauaccagccuaggcaacauggcaaaacucugucucuacaaaaauauaaaaauuagccaggcaugguggcacaugccuguagucccagcuacucaggaggcugagaugggagaaagaccugagcccaggagguugaggcuguggugagcuaugaucaugccacugaacuccagccugggcaacagagcaagacccugucucaaaaagggaagggagcugauaaacauguucuaaaauugacugagguuaugguugcauaauucugugaauauacuaaaaagcauuaaauuguacacuuuaaauagaugaauuguaucucauuaaggcuguuuuuuuuaaaucaagauaaauuucuaucucuaugcaaacauacagaagacuacaguauuuuauuuaaaucuuuugauuuuauauuucucuuuuccuuugcacugacaaucuugguuccuaauaacucuaauaugacuauuuguuuuaucuguaccuacaucuauaucuauaccuaucuagcuauguaaauaaaaauaguaccugaauagcaguaucuauaauaccaaauuuaguagaaacaguguaagauuuuuuugguguuucuuuuuauucuuaagcuguuucccacuugggaaguauaggaaauuacuguguuauaaacacauuugagauaauucuuggguguuuaaggcacuauuuugauauacagguuuaauuuuaguuauuuuuuaaaggucaccucccccccucccccccauuuuuucccugauuuuaaauuuugauauauaauuacguaauuuaguuacaggucaaaacaaaguauuuuccgagaaaucuagcuucuaccucucuucuaaguuguuucucuuuuauugauaaccauuuauuuuaugguuuauuccuccauuuuaaaauaaguuauaagcaaauacauaaaugacagcuuuguauuauauacaguugauucugccuuguuuuaaacuuaauguuauauccuggagaucacuguauacagaguuuuuuguucuuuagcugcauaguacuccacuacauggguuucaacauccaauacauggaugugcuauaauuuauugacauaguuacuacaaauagacauuuaggucaucuucuguauuuugaaauuaguaaaaacagugcuguuaucuuuucauauuuuugccaguauaucuuuaagauucuucuuuuucuucuugagauagggucuuucucugucacccagacugaagugcaguagugugaucauagcucacugcagcuucaaacuccugggcucaagcaauccuccugccucagccucccgaguggcugggacuacaggcaugcccuaccacgccuugcuaauuuuuuguauuuuuuauagagauggggucucacuauguugccuaggcuagucucaaacuccuggccucaagugguucuuucaccucagcccucccaaaagguugggauuuacaggugugacccacuggcccuaagauaauuuucuagaaguaggaaugucaagucaaaggguaaacucauagguaauuuuccuugauauugccgaauucccuuccauuaaguuguuucauuuugcauuucuacaaguaacguaugagagugucuguuucucuacagcccaaucaauauaaaauguugccaaacuuuuggauuuuugucaauguaauaagugaagaauaguaucucaauguaguuuuaauuugaauuucucuuacuaucaauuagauugagcauuuuuuuuuuuuuuuuugagacggagucucgcucugucacccaggcucgagugcaguggcacgaucucggcucaccgcaagcucugccuccuggguucaugccauucuccugccucagccucccgaguagcugggacuacaggugcccgccaccacgcccggcuaauuuuuuuuuuucuauuuuucguagagacaggguuucacuguguuagccaggaugcucucgaucuccuggccucgugauccgcccgccucggccucccaaagugcugggauuacagacaugagccaccgcgccuggccgauugagcauauuuucauauguucaaggaccauuugcauuuuuucuccuaucuuuagcccaauaaagauagaguuauuggucuuuuaagagcucuuuauuagggauaauaaaaguugcaauuuuuuuuuccaauuugucuuuuacuuugcucagcuuuuacucccuccaaaguuuuucuuuuaauuuauguaaucauauuuaucaaucuuuuccuuuauuguuuuuagauuuugggucaugguuaggaaauauuuuucccauugccaggauaugaagggaccacucauguuuucuucuauuauuuauauggauucacuucuuugacucauuugaaauuuaucuugauguaugaagaauggaauaauuuuuuacuuuuuuaaaauuucauuuuaauuuuugagauaggaucuuacuaugucgcccagguuggggugcaguggugcaaucauagcucacuguaaccucaaacuccugggcucaagcaauccucucaugucagccuccugaguagcuaggaaugcaaguguaugccaccacgcccagauauuuuuugaauuuuuuguagagaugggguuuugcuauguugcccaggcuggucucaaacucuuggccucaagugauccuucugccuuggccucccaaagcugaaauuauaggugugaaccaccauguccagccuuacuuuuaucuuauaccaacauuugaguaaggcuuacuuugcugguuuuacagucuaugcauauguauuuauuuacccaugcagucaaggaaaaaaauaugcgucauacuaaggauaggaauuuuauaugucauuuuggauaacaaaaaguuccauuuuuacagaacaaaaaucauacugugugaccuucuguacuauuaaguauuuugaaaggcuuucugugcuuuugcaacuauuggcauaaaccacauccucuuucuaguugugccagguaacauaaaauuaagccaaagauaaccaacuccuggauuagauaaagccauuuauuaauuaaaauuaauguuaaaaaacauaaauuaagacuaaauaggagucauaggguaaaugcucaauaucuuuuuaauuaaaauuccgugugauucugugacuaauucuugcugccaaggaaaauaagaaucccuaagucucugagguucaacucugaaaguacauuaggaauaucaccuauugauauuaaugucaucaauuuuuaacuuaauucuuucucaugaugacauuuugugauaaauauauacugguauuuucaugaaaaaaacuaacuggcuaagucacuagcacaauuagaacuuagcaccagguagaaacuaauaccuaaaggaaaauguacaauguugcaauuuaaguuagacauuauuuuaauucucaucugcugugugccaaguucuaaagaaauuuucaaaaagaauaaaaauuucuagaugagaaaagcagagcagauuguaaaugucaggucuccaggacaauaaugucucauucuuucacuuuaaugacucaagcauauaaggauucauuauucaauaaauggcuucugcucuuaucuauaauaaagagagcaaggaaaggaauagaugacaacaucaguggauaaccuauagucucauuuuggauacuggaucucaccuucaccuuaagcaaaccuauuaauuucaacuauaucacaugaacaaaaacaucugaauuucggcauuuuaaaucucccucucuuucagguagugaaguucaugagcugggaaauaaucagaaaguagcaggaugagagauggcaaaagucuuagaugacauauuggcuaucaaaaaauuucauuuuagacaugaaguuacagcugagaguuugugaccuaaacaaaguuaguuggguauaggucuucugacucugaguccagugcucuguccaauauaccaauucuacuagucaggucagauaagaaaaauguacagcuggaacauuauuaccuaauugcauauaaacaaaauuccauugaaacaaaauucuguaaacaucacuuacaaguagaugacuaaaaagauaauucuacuauaggaucuaugcuaaguaugccaaacauuucacaaucauaauuaauuuauaccauuucagauaggaaaauugaagcuacggucaaauucagguuaaaaaaaaaaccacugagugccuacuauggaucagguacuggugacagaaugagaggauaaauuacuaaaacaaagucaaaaauaaguauuuuuaaccuuugggacaaagcuuacuuagaccauacuccuuauuaaaggaaaguuaaaucucaguagucuccuauacaauuauucauuauuuuugaugaaaagaagacuucaaagaguuuuuccaaaauauaauacaaagaucugaauucaaaaaauauuuauuccaacauuucuuaaauuacuggggacacuauuauaaguaaaauaaauugacagaugcuaacuccagcuuuaugaauucucaaugcuaagaugaccuuauuucuauaauacagcauuuaugauauucuaaaguacuuuuagagauagaaccaagauaccaaguuacuuguuugaaaugaaaacugucccagucuauccagaguugaugucuucccuaaguuugggagaucauucguagaaaaaggagacacauaccuuuccauaacagccaggcacuccuuucuccagguaaaucgacucccucgucgcagucggaaaguaccagauguggcagagacugggggaggcguuugucuccauucaggguccucuauuggaaugggggcuggucucauacuuaguguagcgccugaaauaaacaagacacuuuuagcaaauaucuugcaguuuauuuaaaacaauauaacaucuacuuccuaugggacuagggaaguauggucuuuggcuuagugacaacuuaaucaauguaucuuucucugaaaaauuucuuuugaaauuccugcuugauaguuauacucuuuuugaacaauauaccucagauguucagaaucuuuuacuaaccauucaaauaaguuauaagcuuaaggaauuuaugcagguaggagacaaacuuaaaauaacccuaauucuuguaaacucuuuucuuuuuuaaagagugaaauacagcaugaaagaaaauaagaugauauuugauaugcuuuuugucuacuaacuaaaucaggucuccauaggucuaccuguugaugcuauacuagauucuguuaccuccugaacauaauaaaauuucaaugaaaaauaucuauaauugagacauuuuacuaauucagauuacucuuuucucaaauagcuugaacugccaaugaugcauuuauucauucauucacuauuuaacaaaucccuuucaaguggcuugcucuaggcuagaagcuaagaauaaaaccaggaaagcaacauugucugugaccuccaugaacuuauuucauagacuuucaauguaacuugguaugcuuucauagaguucagucccuggcuaccccacucuucuuucacuccuuacacuguuaaauucaucuucccaaaacauaauuaugaucauaucggucuucuaaucaaaaaccuucaaaaaauucucucugccuguaguuuaauucaaaugcuuaacacagguguagaaagacauguuagaacauguagguuuaugcaauauuaauaaauauguuaauucuauguuaaugauauuaauauuuauuucuuccuaauagaauuaauacucucuuuauuguaccuugcaaauaauaccauggauagcauuucuacuucaagacuuacagaucuauuguagauccccuucuuaauagcuacaucuuuagauguauucucuuacacagauguccaaaauguuaaucaauccugauuuugcuuuucaaaccuauuguccugcagucuuucccaucucaguaaauagauacccacucuucaaaccacucagcucaaaauucucaaauuaaucuuucacuucucuaauuaucccaccuauacauaacuaauucauaggcaaguucauuuuaucuucaaaauauuuccaguaucagaucaauuuuuauuccuugcacugcuacuacuuuuagaacacgucagcaucaucuuucacaaucaugguuuccugggacaaguuucaaagacggcuccucacaguaagucauaccucuggcuaaucaugcccuugaaucugggccaguccugugacagguuguugagcaagaaaaucuaaacaauucaaggcuagguuauaagaugcuuugaaauuucugccuaggucuccuaaaaugcuggcucugggggaaaccagaggccauauaagaagucugacuaaccugagacuaugauguuguaaggaagcccaggauagccauguggagaggcuacauggagugaaagaugcucugacaguccccagggucuucugccaacuccacccaggugccagcauuugagagaaaaugccaucuuggacacuguagccacagcaaaugccacauggagaagugcagaaaccaggugauagacagaaacaaggccucagacauucagucccagcacaggaauguggacaucaaccuccaaggucccuaaggaucccugccuccuggucugcacaccuccguauagucccuucccacacugcaccaugauuaggcugugcgaccaacagcauguggcagugaugguaugucacuucaaggaucagaauacagaagacacuaugacaucugucuuggaugcuuucucucuuauucacucaagggaaaacuagcugccgugugaggacacucaggcaguggauggugaggcccauguugugaggaacugaugucucugaccaacaggcagugaggaccugggaccuguccacauccacaugagugaguuuccaaguggaccauccagucccaaugacugcagcccaggcugacagcuggacagcaaccucuacagaacucugagccagaaacaaccagcuaagccauuccuggauuccugaucuaugaaaacuaugagauaauaaaugcugguuguguuaagcugcuaaauuguggauaauuuauuguauaagaauagauaacuaauaaaaauuaucacaaucauccucaguuguuuauuucccuuuaucccccaauacacuauuauuaauuauucaaauguauaaauuuggcagcaaaaaauuucccuuuaauauagagacuucacuacuaauaagaaugagcaucuuuuccuguuuauugaccauuuauaucuuuucuugugaauuucuaucuguuguuccuuuuuuaggggguuauucuucuuaugggugcagagaaaucauagcaauugcuagucauacagaaugcaauuuuuuucuggucugucauuuguuuuuuauagugugcuuugugaucuuaauuuuaauacagucaaauuugucagucuuuuguauuauggccaaugggcuugaauaucacugaguaucuuuauaucuuucauuuuguguuucagccuuuaauauguaugugauuucuuauagcaugugauggaaaguaaauauuuaacuacuuaacauuucugcuuaaacaaguaaguuugucaucauauaaugcuuuagagauuuacagcccacccuaaaacagaguuggcaaauuauacccacugccuauuuuuguaaauaaaguuuuauugaaacaugcucaugcucauucauuuacagauugucuauggcuaugaaugcacuggagcagaagagcugaguagcuaugauagagaucauauaaccugcaaaaccuaaaauauuuacugucuggcccuuuauaugaaguuugccaaccccugguuuaaaaacauuucugcucuacccaacaugaaauucuaaacugaaacccuucuuuaaacaauuuaaaaggguuucauucugccaaaauaaacugagaauucagucugggccuaauugaaaguuaacuaaguuuagacauaagcaggaauuugggggcuggaggguuucacagucuuauagugcuuuucugaaaacaaguagggauuacagcacagcaagagcucuggaaucuaccuaauuaaaauuauauaaauguuauucuauagcaagggugaaaaggacuaaaacagagccaaccgguuaucauggcugaucaagauaaagguagaaauaagacucaguaagggaauacaaccucuuguccaggggcugacccuuguaaagaaagaaagagcuucaggauggagggugggcaauaggucagugaauuccagguaguaggccacauccauaauugcggcaugcuccuuaguaagcagagugguaaauggguacaaauagaacacagaacagaaagaauccuaaccaagagguugaaggaaauaagccaacuaauaauaaugguucuuucuugguauugggguuuauuauuaauauuaugcuucuuuguaauauucaguauugucaagacagucucaagaacugaaggaaauucagaugaaauaaaacugggcaggaaggaaaaggaagaggggagaagaaaaaaggagaaaaagaagacagaaaaguaaguaguggccugguuauuuugaaagaaaucaaggccgggcgcgguggcucaugccuguaaucccagcacuuuaggaggcugaggcgggcggaacaccugaggucaggaguuugagaccagccugaccaacauggugaaacccugucuguacuaaaaauacaaaaauuugcugggugugguggcacacgccuguaaucccagcuacucaggaggccgaggcaggagaaucgcuugaacccaggaggcagagguugcagugagccaagaucgugccacugcacuccagccugggcgacagagugauacuccaucucggggugggggaaaaaaaagaaaucaagacaguuuacacacagaaggugaaaaaugaauaaucuuaaauucaucaaaauaccuacuuuaaaacauaauguuacauuacuuuucagauuuuuuucuggcuccuuuuucuuuuucaauguagcaguaguuaaaaacagcacaaaaaaguacucuggaaacacucuauuaauaacagauuuguucuggaaaccuuaguucaucuugcuuugguugaaauggaugaaaagcaagagcgaguucaaaauuacugacucuaacagaaaaacacaaagacacuagaaugcaggaacaauguauuuaagccuuuaaacuccucugaaguaaaauacaggaauucuggguuggcuaagguccuaacaggaaaaguguguugucuauuuccuuacagaaaucuuuuuuccccccaucuaaguuuccauuaaaacaaaauuuugcaccuucaccuagcaaaucuaaacccaugaggaaaaaaaaaacccaaaacucuuuucauaacuuguuaagacauauaaaaauuugguaaguguucucuuuacauauaucauaauguccuugcugaucaggguuagcucugggugaggggacuauaagcacaucauuacuacgccauccauaggaacuaaccucuccaaaaguaauuucacaucuucccccaugucacacacguuucccugagaucuaacacucugcaagugaaggacuggauguuucuucugaugacauuuaucucauguauuugcugcauaacccucuuggcaaauuuuauuuaauuguuuagaagcaugcagaauaugcaccacaugccaagaggaacucagcaaacccugucugcuauaguaauguuuaaauuagacaagggaaaaagacugugaacuuaauuugauuaaauaaagggacuuuugaugucaaccauccugaauuuagcacucacuuuuuuuuaaaaaauagguauuuucuuauaaguguuuucauaagaaacaagauaaaauguauuugauuaguuuccaucagccuauuuuauuaauaugccuuggcaggcuuucauuuaugcugguaaauucugaugaugagucuguuaucagagaacuacacuauaucaaucggguuaucaguaaaauuaaccuaaauauccauucuauuauuuuucuugaugaguccacuuaaagagaaacuuacaaaaaaccaaaagccauauacaacuggauccagacugaagagguugaaaaaaagaacuuccgcugggugcgguggcucaugccuauaaucccagcacuuuggaaagccgagguggguggaucacgaggucaggaguucaagaccagccuggccaacauggugaaaccccaucucuacuaaaaacacaaaaaucagcugggcguggcggcacgugccuguaaucccagcuacuccugaggcugaggcaggagaauugcuugaacccgaaaggcagaaguugcagugagccaagauugcgccacugcacuccagccugguggcagagcuagacucugucucaacaacaacaacaaaaggacuucacucaaaguauacaaagagaaaugcuccaacgcccaggaauagagucauagaauauacaaacauuuuuguuuucuaaaugcuuaaauuuacagaagaaaaaagaaaaaguaguuuuucauuuugugacuuuucuuaauuuugcauuuucuucucagaauauauguaaagggaucacacuauuuacauuuacccuaaagagcuaucuuuccuagacagaaaaaaaaauuaugaaauaaaagaauuacuugauaaaaaucacugacaacuuauuuucuaccugcuucucaaaagcaggucuggacuguauaaaccuaaguuuuucuuccuuuucuuucuuucuuuuuaaucuuacaaggcagauugauuucuuuuggucugucucccccuuccuauuacacuuuauuuuucaaauauauaauacaaguacauaguaugaaauuuagaaagacacauuaggcuguguaguuaacuccuuaccccuguacucccagucacucaguuccccuccacagagcuauucuucccaguuccuaacacagcuuuucagagauuucuaugcuuagauaagcauauacauguguauguguguguguuccccuacauaaauaugcccuugauacuguuauguaccuuuuuuacuuaugaauuccauaucaccucauauaaauuuaauucauauaaagcugccuucaaaaaguaguuauauggcuccauaagauuccauuguacagaugugccauuaauuuauuuaaccaguucucaacugagggacaucuggguggauuccaaucaggucugaaaugacuugcaaugaaggaucugcuguccuauaagcuaacauaauuuuaguucaucuuaaccaaacauaauaguagcuccaaauucuuuagcuaaaaucaaagguuauuuuagucaacaaaacaaaaucacuuuuaucgagaaagaauucuaugugauauuugccuuuauaauaaaugucaaaaugcaaagaaaaagacaaacaaauuucaguugcuaauacccaauugcuguuaacgcaacaacaacuaccaaauggcaauuacgaacuuacccucuuaucucuagcuaccuuuaaauuaugucccacagaaaaacuugacugagaaaaccaguaguuaggauuugguuuuuaaacaaaaaauagaaaguacuuuuuaaaaggugacaauaaugcaaucuuacugaaaaacaaaugcauauaauuagaggaacgucuuaaaaggaggcacuauguacuuaaagaaaucagcuccuaauuaucagcuagaugaaugcugcugguuucaauucccuaguucuaccuuccucuaauuucccaauacugguuucaagauaaacuaaaauaggaaauuaagacuaaaagcuaaaauaaauaacaauaauuuaaaaaaaaaaccagcuuuggaagaacacuaucagcccagugcuaaagcuggacuccuguaguuaguauuccacaacuggcuaucagaucagcugcaacaaugccauuguggcccuagagcugcaccuuagucguccuuccuauuucuaguucagggcuggacuagagcccagccccgaaacuccagugcgggaauuuggccuuaccaguugauuaucccauuuugcaauccccaucagaauaacagauucaaucaagaaucaucaacgaaugcuaaggucaucggugaaagcuguugcaggaaaggauauucauccaggggcaaagugucacccuaaagauuauucacaaacugcaaagaaaagaucugguggucaccauuuuaacaaaaccaucacacuuggcauaugaauagugcuacaaccuccuaaugcugacaggccucuuaauaugcggcaauauuagguaaacacuaccuacaaaguauuuuucuccaguguuuuauugcaaaaauuuucaaacauacaauagugaaagaauuuuuuaagugaaaaccauacucauaccacauauuuuacuuuaucacauagcuauccauuucccuaaauacaauuccauuuuauuuuccgaugcauuucaaaauaaauugcugccauuaguacgugccucccuaaauaaucuaugaaguaaucuugccuaaaauauucagcaugaauccugacuucagauuuuaauucuaacuuccagcuuacagaaauacagaagauaaagaaauuagauauuugauaauaaaaguaaauagaaaaauccagcaugugggacauucugucaaauuacauggcuuaagaaguucaugucauuaaaagaaaaaaguuugggugacuagauuuaagagauaucccaauuuuccaaccuaaaagagauacuaaagaaagagcuacaaaagacauucuucuaauagcuagagaaaugugacucagacuggauauaaaaugauaauaugaaauuauuauuaauuuucuuagguauaauaaugaggacugugguaauacagauuaucuuuauucuuaggagaugaaugcugaauacacacauauauaaaucuuaacuuuuuuauagaaauaaagcaaauguaaaauguuaauaauaauaauauauauauuuuuuuuuugagacaggucucccuuugucauccaggcuggagugcaguggcaccaucuccacucacugcaaccucugucucccgaguuaaagcaauuucucugccuuaaccucccgaguagcugggauacaggcaugccccaccacaccuggcuaauuuuuguauuuuuaguagagacaggguuucaccauguuggccaggcuggucuugaacuggccucaagugaccugaccacuucggccucccaaaguguugggauuacaggcgugagccacugcgcccagccaaaugguaauaauuauuauaucuaagaaagaguaaacaggugucuacuguguuagucuuuugaauuuucuguacaucugaaacauuucaaaauaaaaacugggagucagaauagauuuuuaauauuauuguagagguugauagguucuuuucuguuucauccugccuggaccauucggauugagaaacugaccuuuagggaaaaaaaucuuaucacauacuuacacacaaaaauacaucucuaugacauucuuuauuucuaccucagagccaaugcuauuauuaugcaauauuucaacuaguguuuuagucugugugcaaaggcuuugaggcugcagcauuacagaacgcaacccaaucuuaaauuuacacaugagggcaggcucacugucacuugccuguguaaaguauagauugagauagucccauaacuucagauuucacuuuauaaaaucaccuguuaguaucuugaauagaucuugccuacuucuuccaacucuagacauaaauuuuuuugucaucuuaguuuucuuaagauuucauucugcuuucccaaucuacugcugcuccugggagucaucagggcagcugcauccuaaaguccaaagauacauccauuacccaggucauuagaauuagaaaaaaaaaaaucauuagcagagaucacuggauaugguacagcaugaauuaaauaaaaauauuaaauuuacauuacuaauucaaacaagauuugcaaaaaaaaaaaaaaaaaaaaagagauacggaaucuuacguaguuauguaguugaagaaaacaaaaucagccacugaacauucauagcguucuuucaaacuauggcuagaaauaucauauaaccugaaagcaaagaggugucuuaggggaaggagugaauaugacuagauaauauuagacaauaaaauaaaauuuauuacagucaggguuuagcuuuuacuguuaagagucuuuuucugcauaaagcaaccauaguaaaguaugaaaccaucuuacugaacaaguuagcacauggagucauuaaaguaauucauuauaucugucuuguuucagaugcaauaaauaaaaggaaaugcuauuuaccaggguuugucuucucaaguugauaccaucgguaaaaugcucuuuucuucuguucacucaggucugaucccugcugcaacagccaaugagagauccggcucugacugauaccuauguagaaagagaaauagguuuuggggggcacugaaauuacagugaaauuaauaaaggaucuuuugguucuagguuacugggugcuuuauucucuguguccaguccauaaggaaguugcaaccugagcaaacuauuauuggauuccuuuguaaagacugacugcacuggcuaggauauacucagaaauuaucucuucaacgucaaggcaguuuauuaauuaagacccgacaauggccucuaaaauuaaucuccaaaaaagguccaugaaucugagauaaagagauuccuaaaguaaaagcuauuugucagaguuuauuauauuugugcuccuucaauuaccacugcuuuccacuccaccccuaauuuagaauaauaaaacuuuuaaaagauauugagcaaaaaagucaagucagcaaguuuuguuacucauuacggauacugaccaaaagauuuaggggcuaggaaacaaaaggucacugaaaauacugucuucaauaagguuuuuuuuuggcuuauuuguuaauucauuuagccauuuuuagagucauuaccauuaguacagagaagaauuagcagacuuuuagaguuauguaugcuacaauaugaccucuuaagaaaucucaacagcuaaagacauuuuuccaacacaagcuuuccacaaaacugaacagaauauaaagcaguaguuuucugcuaucuccaagaagcucuugacagcaauuacuuagaaauguaaagaaucucuacauuugaaaguaaaaaagcaugucuaaaacuuacuaguaugagaaucacaugcucauucuggccauucauagcuauuccaaaaaaugaauaacucaguacaaacuggcaaaagcaaguaacaacaggaaagacaaaacugucuuguaaguccacaaggcaguuuccaaaagaccauucagcuaccagagaagguuaccuauaccuaaaaccucccaaggaauuacugaggguaaccgaauauuacugaauaucaccugugucgacucgucccguuuaaagguauaaugcccaauaggaagaguagcuaucaugaaguaaucacacccucuagcaucagaaaaagcaggagguccugggaucacauuuaacucauuaaaagcaagccccuagaguuucacacacuuaaaaaccuaugucaaaagaaaauuugaggaaaugggagaggggaguguuaaaaaaaaagacugugaagcaaaguucucugacuggaaacaucuuucuuuuuuucuuuuuugagaaagguucucacucugucucccaggcuggagugcaguggcgcaaucauggcucaccacacccucucaccucggccucccaaagugcuaggauuacaggcauaagccacuguaccaggccccaccacauccagcuaauuucuuauuuuuucuguagagacagggucucacaauguugccaggcugcucucgaacuccugggcucaagugguccuccugccuuggccucccaaagugcuggauuacaggcacaagccaccaugcccagccuggaaaaaucuuucaauuucaaaaggcaaaauucaaacagcuuuccaaacccuaagugauuauauucucaaauaauucacacagcaguuuuccaguggacuaaagauucauguaauguaggcacuguaugccucuucuaagaaaaugcaaauuauucuggauaauuaauucggcuuucaccaaaagucuaguuucagacauuaugguuauuuuuuaauacuacuuuuuuuuuucuuuguauuuuuuuggaaacagaguuucacucuguugcccagacuggagugcaguggcgugaucucgguucacugcaaccuccaccuccuggguucaagcgauucccccgccucagccucccgaguagcugggacuucaggcaugcgccaccaugcccagauaauuuuuguauuuuuaguagggaugggguuucacuguguuggccaggcuggucucgaacuccugaccucaggugauccgcccgccucagccucccaaagugccaggauuaugggcaugagccaccgcacccagccuauacugcauuuuuaaagggugaagaaaacaaccaccaugaaaucaacauugauuuucaugucaacaaaauaaaauuauuuuacauggauucuucauauugcuaucauacuacucaaaacagaaaacuugagaaaaaucaguuaagaaaaaauauauuaucagcucuguuaacugguuccaauaugaaaucuuccuuaaucagaucauacauagaacaagccucagagcucgcuagacaacagaacuguccagguucuggcuuugguauagugagaagaggacaaaaucucaucaaacggacauuaguuaaguuagaguauauuuauauaacaaaacacugguaggcuuuaaaauuaauguuuuuaaaaagccauaaaaaaacccagaaaacuacaacaaaaaagcagaaccaaccaaacaaauaaaaagccaucaauaucaagugcuggcaaggcuauagagcauauacgauucucacacugcugauggaaggauaaaauggcagggccacuuugggaaacagaugauaacugcuagagcugaacauacauauacucuaugaccuagcauuuuuuuacuaggcauauaucccacagaaaugugcaccugcucaauagaaguauguucaaaagagacaagaaggcucuuauaaacauuuccauaauagcccccaaugugaaacaacuaaaugcccaucaauaauagaaugcaucggccaggcgcaguggcucacaccuguaaucccggcacuuugggaggcagagguggguggauugucugaggucaagaguuccacaacagccugaccaauaugguaaaaccccaucucuacuaaaaauacaaaacuuagccaggcaugguggugugugccuguagucccagcuacucgggaggcugaggcaggagaauugcuugaaccuaggaggcagagguuguagugagccaagauugcgccacugcacuccagccugggugacagagugacacucugucucaaaaaaaaaaaaaaaaaaaauagaaugcaucaacugugauagcuacacauucugcuauagacuacuauacuaaauagaaaaagauaaacuaccacuauaugaaaccacauggauaaacaucacaaaaauaauguuaacugaaaaaccuauaacacagacacacauacacaaaagccauacauaacuauauaugauucauuuuaaauaaaguuauaaaacagauacgacuaaucuauagcgauggaaaucagaauaguaguuacccauguaggagggagaagguuucugccugggaguuagaaugaggaaaguuuauguggugaccagcauugcucuuuaucucgaucuggagggugguuauauggguguccuaacuugacuuuuaaguguccauuaagcuggacaguuuucuguguauauauuuaaauuuuaaaaagucgccccaaaaauguucuuaaaauucuauguaguuucaaaaaaaugaaguaaauggauauguaucaauauggaaagaugcucaugaaauaaaugaaaagauauauuuuuaugaauauacaauguuacauauucuaaauucuguauaguaacaacagcuaauauauaacuaaagauauauaauaugaauuuaaaguggcagauucuuccuacauuucuaucucuauauuguuuucuuaaucuuccuauaaauaugcauuaauuauuuuuggcuuuucacccuaaauacuaaauacagagcuuuacugguuauuuuacaagcaaauaguugcaaagaauuucugucuucccccuccaauucuacucucugaaguaagcaagguuagcuauuuacacauguuguuccacaauuuucucuaugcauaauuauuacuuuaauaaaacaaaggaagaagaugguguuauagaauauucuccugucuugucuuuugugugaggaagaaauaaacaagaauuucuucccucuaaauuuaaucucaguauucauauaauaauguagaaaauaaguaaagcagguaauuuuuccaaaaaaggcacuguaaacaaaauaaaagcauaaaaggacacguuuuacagugauuuuucuaagcagccuguuaacagauggguaaggcuccuugaacucaugcuuugagcugcuuugguccuucagcugaacacggucucauaagcccuggcagccucucgauacuaucagcuuugauacuuuuucucaggagaaaauuucccuaacuuucccccuacuucccacugcagaagaaaacgucauugcccacaaguuuuaguuccucaaaaccuaucuugucuaccucugacagggcagaggaaaagaaaaaauuuacauauaaccuucacacauugagagacuaaaacuaaccccugauuaauuuauuuccaauaagaaaguuaucacaugguauucaaaggaagaaaaagccuuuccagccucauucacauuauuuucugagcagcugcaucaggcuaccuguuccucaaacaccacgcucccuuccacuagagggcucuccaccauaauccuuucuugucagagucuccaauaccacaaauuuauguuuaauuuuccuuccacuuccugaggagugaaaccacugaccacucccaucaucuuccuccuuggaaugcuggauacaauuccaacaccacaucuuuucagucgacuucagggcugcuuugcuagcuucuuacauguuaguaacccucagaauuccuuuggucaucucaauuaccaacaacauugauuuaaaaugucaucuaaaugccaaugaccuccaggguaccagaccauucuuucaaaccaucugcuagauagcguccaugagauuuucccacagguccucaacacagucaacuuaauucacuaucauccuuaaaucuguucuccuuccuguguucuccaucucaauuuuacuguucacucuacuuuccccccacacucuuacauauuuacuaaauacaaucacuuucucuuccuaaaauuauuuucauguccuuuccaauccucauuccagaaguuuggaaucucagucucuuuugccuggacaauugcaguaacuauaagaaaaauaacaaaccauuuaagauccacaaaguacaaaauucucauaagcuccuuuuuaauuagaagaucauuucacaauugaaaaaaugaaauuuccuucuucaagcaauuuuguacuucagaacugcuaucaucucuauaauucgccuuccacagugcaagcagaauuauguuuaaauuuaaguuaaagcacauauaugcauugucuacaaaaauucaaauaauucauaaaugcacgcagauaaaauaaaagcccuuccuccacucccaccccuuauuuccuauccuaaagguauccuuauuuggugugaauccauccagacuuucuacaugcauuuaauacagaaaaauaugcauucauauauauauauauauauauauuuaauacagaaaaauuuaauacagaaaaauaugcaugcauauauauauauauauauauacacacacacacaaccaguuguuuuaaaaacauacacuugggguuauucuacauauaauaaguaacuuacuuuucucuaauaucuuagaauguucucauauaguacauuguaaaucuucauucuagugguuacaagguauucuauaccauaauuuauuaaaacaugaaccuauuauucgauacugcaguuguuguuaauguuucacuauuauaaauuaugaugcaaugacacucuauguacaaccuucugcagacaaauaaauauuucucuagggcugacucacaggaaugaaauuuuugauucauaguuugugaagagcauuuauguuugugacaaaugucaccuaacuguccccuaaagaagacuguacucucacuccucuccuacuuagauaaaaaaugaaaaaaaaaaagacaagacuguacucaguuuuauacucuaaccguaguauaagcauguuuuccuacauucucaccauuacugaauauuacaaaacuguuuugaaagucugacuuucuuuuuguaagcauaauacaaguccauuauuuuaaaaauccuaagcaauucagaugaaaggggaaaaauuaagagaaaagcgaauuuuaaaaaccacacacccaaauucucaccccuuagaaauaaauacacuaauuccaagaucaucacuccaagcauauauacacacaggacagguagaaguaauaacugaaaugaaaccacacuauagacagaauuuuaaaauauauuuaaaaaguaguuuuauuuuaacacaggauuuuuuuuaaacuggagugaaaacaaaauaucugaaguuuuguaaauguuuccauaagagaaaugagguucucgaaagaguccacuaaagcaagguaaaaagcauuauacaaaaacaguguaucauugggauggauuuuuuuuuaacauaugggcaauauuuaaugguuccaagcuaaaaaagcuaaggaaauuagcagacugugguagcuaaccuccaaagggaccuccaaccuccaaaugauccuucuggucuuacuaccuuuguguaauccccuccaacacugcaucaggguugcucugugcaaccaacaaauguggcacaaaugauggucuaugacuuuugaagcuaggucauaaaagacauuacaccuucugccuucgucuccuucucucuuucccucucucccucucucccacugccccacccacagauaccuaguugugggagaagcuagccauguuaugaaaacacucaagcagcccuauggagagauccacgugacagagaacugagacauucugcuaacagccaaugcaagugagucaucuuggaagagggucuucuaaucucauuuaagccuccagaugacugcaaccucaugagaccccccugaaccaaaacaaccuaucuaagcugcuccugaauuccuggccaauacaaauugagugacauaauaaaggcuuauguuacaagaugcuaaguucuuaauguugcaacagauaacuaagacacauccuuacacucuaguucccccaucuccacauuccagccuuugcacccaacuccucauauuuagaacauauuuuuagacagucagcauuuacauucuguucugaauucauaguugccacagcuguacacucaugguuauagauuuaaagauuuaagauuuaccacagaguuucuuaaaaguuuuuccauuccuaaacucuuaucuuuuuguuuuuaauugaguuauauuuuacaaacaguaaaauuuuaaguauauaguucaaugaguuuugauaaauauacagacgcaugugauaaauguacaugaugcaugcucaaaucaauuuacagauuauuucuaugccccuugaaaagucccucuuguucccuuuccagucaauaccuaaaugucuuguuuuguuuuguuuuguuuuguuuuguuuuguuuuguuuuguuugagauggaaucucgcucuauuaccgaggcugaagcgccgcggcaugaucuuggcucacugcaaccucugccucccagguacaaguaauucuccugccucagucuccugaguagccgggauuacaggugcccaccaccacgccuggcuaauuuuuguauuuuuaguagagacaggguuuugccacauuggccaggcugaucuugaacuccugaccuuaggugagccacccgccuuggccucccagaguaccuggauuacaggagugggccacugugucuggccaaaaugccuuauuuuuaaauauaacuuuggguauagauuucuucacagaguaguuuuuaacagcacaggcuaauuggugcuguauuuuucaacccuuguauguuuguauguuugucuccauuuucauacuuugaggacaauucuagagggaaaauuuugggggccagcuuuccuucaaaaucucuugaauuggagugacaucagugagaauagugaaguaaaaaccucugaaaaccuacuccuccauaaaagcaacaacagcaaaaucugcuguuccauaaaagcacugucaacaauugucagaaucaacuucuucagaauuuuagaaauuaccaaaggcuuccaacaauccaaagagcauuuauuuuaaaaaaugcugaauuuugguaagaauagcaugugacauuuuaacuuggccuccucccaugccugucacacuaucauuauagcagacuuaaaaaccaacauuacugcaaucacagugaaaaccagguguggccuaguagucacuggaggggaaaggacagguuuggaguuccucaaaacacccuucuaagagaacugucauuauuugaccugucuggcaauuaccuggaaaucuuuauuugcaaggcuugcuuuauuugaccugacucaagaucucacucagugugaauagcuucucucugaggaggaaagacagaugugagguaauuugucgaaaacaaucaguggcaauaaguuaacacugcagcugccugaggcaaugacaacaacugaugugaacaagaagcugaccaaaauauuucaacagagaaguggagguaugagauguccacgagagucuucaaaaagcuaugacauauuccuaggaaucuagaaggucaugaacuuguauagggcugugcacauguauagggcuaugaagauguauaggaaagacccgugaaggcucgaagcucucaccucuggcugaccuugagaccuaguacaaagagaaagugaagguuuacgcagaauuauaagcugccugucugagcauuaaagguaugcccaauacacagagagagccccuugacaaaagcugggagacuuauuguuucuagagauuugaggaaauuuuuaccuaauaauuagcugaccacuaagcugacaaggaagauaguucagcagcuacauaccacaaagaauaauaacuuuauaauguuaaaucaggaaauucauuaaacaaacaucaccaacaacagcaauaauaaauccaagggaggaaggaaucugauuuccagaguuuccacauuacuuagaauuuccagguuuuaaaacaaaacuuaugagacaugcaaagaaacaagaaaguauggcucauacacaguagaagcagucaauaagaaguguccuagaagaaauccagauauugaacuuaguagacaaagauuuaaauuaaccauuuuaaagacuaaaagaauuaaaagaaacaugucucaggaacuaaggaaaguaugagaaaaaugccuuaccaaacacagaauaucaauaaacagacaaaaauuauaagaaccaaauagaaauuuuggaauugaaaaguauaaaaaauaaaaugaaaaauuaucuaaaaggacucaacgguagauaugaacuggaagaagaaauaaucagcaaacuugaagacaggucaauggauaugaucuauuauaaggaacaaaaagaaaaaaagaaugaagaaaauggaacaaaggcucaaaaaccugugggauaccauuaggcuuaccaacauacacauauaaugggaauccaagaaacagagagaaaagugaagaauauuuugaaaaaauagugaccaaaacuucccaaauuugaugaaaaacauuaaugcacacaucuaaaaagcucaaugaucuucagguaggguuaacucaaagaaauccauaccuagacacaucauaaauuguugaaaaccaaagaucaacagaaaaaucuugaagugucaagagagaagugacccauuacauacaagcaaugcucaauaugauaaacagcuaauuucucaucagaaaccaugggaaggagacauuaagacauuuucagaugaguaaaauuacagaaaauaugcucucagcagaugugcccuguaagaaauacuaaaggcaggucuucaggcugaaaggaaaggacauuaagcaguaacucaaauacaccugaagaaauaagagugacaguaaagguaacuauguagguaaacauaaacgagaguauaauuaaauauuuugugucuauaacuccuuuuuuauuuauaaaagaaaacuauauaaugcaauaauuauaaucuaaguugaugggcacacaauauauaaauguaauuuauaagacaaaaauuaaccuauuauaggagaaauguuuuucuauacuauuaaaauuaaguugguauuaauugucauaaauuaagauguuaaugguaaucuccagggcaaugacugagaaaauagcucgaaaaauauagcaaaagaaaugacaagggauuuaaaauuguacaugagaaaacaaucuauuuaacacaaaagagaaaguaaucaaacagaggaacaaaaagaugaaacacauauagaaaacaaauggcaaaauggcagauauaaauucuuccuuaucauaauuaaauuaaauuuaaauagauuaaaaacuccaauaagaagacagagauuggcagaaacacaauccaacuucaugcugucuauaagagauacauuucagauucaaagacauaauuagguugaaaguaaaagaauggaaaaagauauaucauauaaaaauaaccaaaugagaacuugagugacaguuaaauauuaauguaagacaaaauagaccuuaagauaaaacuuguuacuagaaaaaauaagacauaauaaaaggcucaauuaacgaggaagauauaacuauaaauguacauauaccaaacaacagagcccuaaaaugcauaaagcaaaaaaugacagaacugaaaacagaaagagauaauucaacaauaauaguuggagauaucaauauaccacuuucaauaauaggcagaacaaauacauagaucaacaacgauuauaugaacaacuauaugccaacaaauuacauaauccagaugaaacgaacauaauuguaggaaaaaacuacugaaucugacucaaggcccagaaaaucugaauagaguuacauagcaaguaaagauauugaauucauagucaaacaucuucccacaaagaaaagccagaaugcuuuacugguaaauucuaccacgcauauaaaaaauaauuaaagcacauacacccauuaacaacucuucacaaacucuucuauaaaaauaaaaaaggaaaaaacacuucugacucaauuccaugaagcaguauuauccuaauaccaaaaucagacaaagacaccacaggaaaacuauagacaggcugggccugguggcugacaccuguaaucccaacacuuuaggaagccaaggagggaggaucacuugaggcuaggaguucaagaccagccugggcaacauaggaagacaccaucucugcaaaauaaaauuuuaaaguuagcaaggcaugauggcgcacaccuguaguccccagcuacuugugaggcugagguggaaggaucacuugagcccaggaggucaaggcuguagugagcccugauggugccacugcauuguagcuugggcgacagagugagacccagucucaaaaaaaacuacagauuaacgucccuuacauaugcagauguaaaacuccucaacaaaaugcuagcaaacugaauccaacaacauauauaaauauaaaggauuauaaaccaugaccaggugggauucaucucaggauagcaagguuuacucaacacacgaaaaucaauguaauacagucacaucaauaaaugacaaaauccacauaacuauuuuaauagacacagaaaaagcaugacaaaauccaacagucuuucaugauauaaaauacucaaaaaacuaagaauagaagcaaacuuccuuacccugauauaggguauauaugaacaaacaacagcugacaucauacguaacggggaaagacugaacacuuucccuaagaucaggaacaagacaaggauguuugcucuugccacuucuguuaaacauuguauuagagguucuagcuagaaggcaagauaaagaaagaaaaggcauccagauuggaaaggaaaaaguagaacuaccucuauuugcagauacaugauuuuguauauaaaaaacccaaaggaauacacaaacacacacacacacacaccccauuagaacuaacaaaugaauucagcaugguugcagaauauaagaucaauauacgaaauaaaccuuauuucuauccauuaacuauaaacaauccaaaaauaaaauucagaaaacaauucuacuuacaauagcaucaaaaagaauaaaauacaugggacaaguggauauccacauuaauauaauguucacaucccuuccucacaucauauauaaaaaguaacucaaaguggaucaaagaugcaaauguaagagcuaaaaguauaaaacucucagaagaaaacacaaauguaaaucugcaugauuugggaauaggcguuuucuuagcuaugauacuaaaagcaaaaacaaaacaacaaaacaauauacacuucaucaaaacuaaaaacuugugugcuucaaagaacacuaucaacaaugugaaaagacaacccagccuccaccugcuggguucaaaugauucuccuuccucagccucccaaauagcugggauuacagacaugcgccaccacacccagguaauuuuuguauuuuuaguagacagguuucaucacguuagccaagaaugugaaaagacaacccaaaaacaugggagaaaauauuugcaaacacuccaucugcuaagggacauaucugauaagcgauuuaucagauauaaguucacguauacacagugcauuacucacgugugucuacgugaacuuauauaaagaauucaacuuguauaugaacuuacauaaagaacucaacuuauauaugaacuaauauaaagaacucaacacuucaauauauuauauaaaccuauauaaagaacucuuaacacuucaauauaaaaaguauaagaagaugaauaaccccagaagaugaauaacccccuuuuuuuuuugagauggagucucacucugucacccaggcuggagugcaguggcgugaucucggcucacugcaagcucugccucccggguucacgccauucuccugccucagccuuucaaguagcugggacuaaaggcgccugccaccacgcccggcuaauguuuuguauuuuuuuuuaguagagacgggguuucacuauguuagccaggauggucucaaucuccugaccuugugauccacccgccgcggccuuccaaagugcugggauuacaggcgugagccaccgcgcccagccaaauaacccaauuuuuaaaauggacaaaggauuuggcuagacauuuuuccaaaaacauacauaaauaaccaagaugcacaugaaaagugcauuacucacuaaaucaaaacuacagcaaaucaaaacuacaaugagacacauaccacuucacauccauuaggauagcuaucauaaaguguuggugaguaugugaagaaauuggaaaugucauacauuggugguaguuuuauaaaauggaaaacaguuuuggcaguuccucaaaacauuaaacauagaauuaccaugugacccagcaguucuauuucuaggcacauuuccaagagaaucuguccacucgaaaacuuaucuacaaauguucauagcagcauuauuauugaaaauagccagugaaacaauccacauguccaccaacugaugaauaaauauaguauauacauauaaugauauauuauucaguuauggaaaggaaugaaguacugaugcaugcuauaacaugggugaaucuuaaaaacauuaugcuaaguaaaaggaagcccgacacaaaaguuuauauaguguaugauucuaucuuaugaaauguccggaaguuugucuguagguauaucugcagagacagaaaguauauuaguacauaccagggcuuggaggacugggggacuggaaauuacugcugaugggcauggguuucuauguuagacuguaucuauacaagaauucccaccauuuuccucuguuuugauccagaauucuuauuugacuugguguguguuuuaagguucuagcuauggcuucacuaguuuuucuuauauuuuuguuuauuuuauugucuuugcuggguuuugauggacagaaguggaccaguaguaucccucaaucuucuaaaguuugcugauuuaaugggcaaaaauccccccugaucucuugcaauuaaauuguucuuauuuaauauucuaagaugcuuucaucuuuucauaugcuuauuggccauuuauauuuugucuugcauaaguuacacacugcuaucccuugcaaauuuuuuauuagguuauuugucauuuuucauaauaacuuguaagagcucauuugagauaccaucauagauaccaaucuuuugcucuauaaugcuacaaauaccugucaaugugaaucuuguuuacaguaucuuuuacuggauauaugcuuaaaauuuuuaugcaguuggacccauacaauuuuauuuuuggggucuuauguauugcuuaggaaagccuuuccuaucccaauauaauaaaaacauucauuauuuucuuuuaacaguaguguagaaucuuuucuccagcuuuaaaaaguauauucauuuaguucuuuauccauaugaaaacugauuuuugauucugguauaauguugguaucuauauuuauuuuuucauuuucaaagaaucaauggaaaaacauuauuuccuuacagauuuaaagggcuuccuuuauuuaagcuaaauuugcucaucuccaaggaucuauuaaugaacucuauccuguacaacuaauacauuuaucugacaauaaaaugacucuguuuuacuuacucuaaccuuauguaguguauuuuaauaucugguagggcaaauuuggccaacucuuuccucccccauccccccgccuuuuuuuuuuuuuggugagagagucuggcucugucgcccaggcuggauugcaguagcgcaaucuuggcucgcugcagccuccaccuccugaguucaaaugauucuccuuccucagucucccgaauaacugggauuauaggcaugcaccaccacauccggcuaacuucguauuuuuaguagagacagguuucauaauguuggccaggcuaguccugaacuccugaccucaaguaaucugcccaccucagucucccaaagugcugggauuucaggugugagccaccaugccuggccuuccccuguucuuuuuaaacaaucucuuaguuauucuuauguauuuuuuucuugcagauaaacuuuagauucauguugacaaaaacaacaaaauccuguugugauucugauugguaucagagagcacaaugaacaaacugguaaccccugaauugaaucuggccgguacagauuauuguugagucugugacauaauauuuguuuuuaaaauuggugcuggaauuuuuuuuuaauacagaacuuauacauggaguacaaaauccaaaaggaacaaaaauaagucaucuuccauccauaccuuacaaccuacccccuucuucauuccacuggagacauacagagcugcuuuauucuuuaauggacaaauaguacuccauaguauagauauaguauaauuuaccuagcuagccuuuacugguggacauguagguuauuuacagcauuuuguuaucauacaauaugcugcaauaaauauucuuguacugucaucauucuagacauaagcaaauauuucuauaggauaaauuccuagauaaauuacacagucaaaacuuuaaaaaauccuacucauacaagaguauguauaucuuaaagaauaauauauuuaucaucaaauugaaaucuaaaucuuuaucaaaauauaucuuauuuaauuuguuacauaaguagugucuauuuuguguggaauaaaggcaaaaauaguuuaaaauaguuacuuaacugcuauuaauaguugaaauuuauguaucuagaagaugguauacuauguucuuucugaaaauagugauaauacucuuauauaccaauauggaaucauuuccaaguuaaaaaaaaaaacuagguguugauuuggcauaaaaggacaauagacauacuuauuugcuaauaaaugcauaaaauuucugaagaaacuguuaacauuagucucaugugggaaggggauauggcugaggaacacagaaaggagauuuagcauuguauacucuucuuccuuuuuuuuuuuuuuuuuuuuuuuuugagacagagucucgcacugucacccaggcuggagugcaauggcaggaucucagcucgcugcaaccuccaccucccagguucacacgauucuccugccucagccuccugaguagcugggauuacaggcacauaccacuacacccggcuaguuuuuuguauuuuuaguagagauggggauucacuauguugaccagacucgucuugaacuccugaccucgugauccaccccacucggauucccagagugcugggauuacaggcaugagccaccgcgcccagccagcauuguauacucuuccaaagguacuucugaaguuugaaccacaugaauaaauuuucuaacauaaaaaguaaauuuauuguucaaaaguucauuaucaaguggcccaaagcuauaaaacuuaugguuaacauauuuagccucaggaaacuuagcuuuaggaaagucaaucuggagagacaugaaugaaaaaugauugccugcugaaaauuaagcaauuauaaugguuaacgauaauaacagaaaaacuucuauggcauuuacuaugugccauuugaaacuuuaccaaaacuaacucauuuaauccacucaagaauccguuuagguagguacuguuguuauucuuuccauuuuccagaagaggagaaacugaggguuaagacauucaguaauuuggccaaaguuacauaauaaguaagggauggaaaucagauuuuugaagccagacaguccauccucaaagucgugcccuugaccauggcaccauauuuucucuauauaccaaauugcuauguaaagaacaguggcuguguggcaaaacaaacgcaauuaacugcaugacuauuggcaaaugagucaauccccuuaagccuggguuuucucauuuguaacugaggaaguuaacaccugcuucucaaguacauaaaacaguuggcauggcaucuaacaccugauaguguuaaauaaguuauagcuaaaaauacaaacccuaaaaaaagaagguuagcuaagagggugcaggcuaguaaaaagcagagccacuggccaucuauaacucacuuggacagcuagauguugauagggauucagcuuaaugauaaagcugaagacuguccuacaaaaacuguucagcaauggaagggcuuggaagcaaaagacaauauguuuaaaacugucaagggagaaaaaaacacuuaagaaaauagcauauucuaguccuuaaaaugacacagaacauuaaaugaaagaucacauuaagaaaguuucuaagaauccuggacuacauuucucaucaagaacaaugaugagcuuggggcaauaucauauuggccucguacuuuaaaaucgacauguucaaaagcaagaugguguucaugaaucuguuugggagaucuggagauaggccacucaauauuuuaaaaacuacuacaggcggcaaaaucucauagcuuagcaaguaaaaacuauguucuuuacucaggcaucacaaggacauaaggaaagggcuacugcuguaucuaaagcuaauuuaauuugguuugugguuaguaaaucuguuauuuuaggcaacuggcaagagaaaaauauuccugccaugaguaaaaucauguagaaaagugcuggcaaucuuuaaaguauuaaggaccuaauaaucucuacuguucuauauucuauucugcugacuucaguacagggcacaagcccuaagauccagguaguaaauuaugagcaguguaagauaaucacuauaauaaaaaaaaggcacauuugcaaagacauuuaagaaagaaauaauaccaauucuacacaaaugcuuccagaaaauacaagagaaaggaccacuucccaacuuaucucaugaggccaacguuauuaugauaacaaaacuauauaaggacauuguaagacuagaaagagccgggcacagcagcucacgccuguaaucccagcacuuugggaggccgaggugggcagaucacuugaagucaggagcucgagaccagccuggccaacauguugaaucccugccucuacuaaaaauacaaaaauuagccaggugugguggcagacaccuguaaucccagcuacucuggaggcugagauaggagaaucgcuugaaccuaggacagaaguugcagugagccgagauugcgccacuccacuccagccugggagacagagcaagacaccgucugaaaaagaaaacaaaaaaacaaacaaacaaaaaacaaaacaaaaaaauagaaagaacacaggaaguaaaacauaaacccagaaugucccucaugaacacagaugugacaauucuuaauaucaccaaauuaaauaauauaaaauggauaauacaucauaacugagugggacuuuucccagaauauaagucaaugugauuuaccauauuaacaagacuaagcaagaaaaaccagguggucaucucaacagaugcagaaaaagcauuugauaaaauacaacaucuaucaugauaaaaacuauuaaaaauuauaaauagaagcuuuccuugaaaggaauccugguaaagggcaacuaugaaaaacuuacagcuaagaucauacuuaaugaugaaaaacugaauguuuccucccuaagacugggaacaagguaagaaugucugcuuuugucacucuauucaagauugaacuguuagugcuaguucaauaaaggggaaaaagaagaaagaaagaagacacauugaaaaggaagaaguaaaauuaucucuauucacagauaacaugauuguauagaaaauccuaaacaaaaaaaauguuuuaaagcuacuagaacaaauaaaugaguuaagcaaguucacaggucaauauaauaaaaccaacugaccuaugauacaagaaacaaggaagcgggcacugaaauuaaaaacaauaccaauauaauagcaauaaaaauauaaaauauuuagagaggaauuuuauguguacaaaacguguacacugaaaaccacuaaaaugguugagagaaaauaaaaaagaccuaaacaaguggagagauaucaaacuauguucauagacuaagacuugauaugauuaagauguaaauuccuaaugucagauugagcuauauauucaacacaaucccaaucucacuacagaugugcuuuuuguagaaacugaaaagcuaguuuuaaaauguacauaaaaauacaaaagaccuauaaagucaauagugaucuugaaaaggaaaaacaacauugggaggaauuacacuuucugauuucaagacuuauaauaaucuacaguuuguauugguauaaggauagacauaaagacugacagaacagaauacaaagcccagaaacagaccuugcaugcauguccaacugaguuuccacaaagauaacaaaguaaucaaacggggaaaggcuagacuuuucaacaaaugguuuuccaacaacuggaucucuauaagaaaaaaaaaugccucaacccuuaucucaacacaaaaauuaauuuuaaaugguccauugaccuaauguaagagcuaaaacuauaaaacuuacagaggaaaacaugagaaaaucuuugagacuuuguuuaagcaaaauuuucuuuuuuuuuuuuucugagacagaguuucacucuuguugcccaggcuggagugcaacggcacaaucucggcucaccccaaccucugccucccagguucaagcaauucuccugccucagccucccgagcagcugggauuacaggcaagcaccaccaugcccggcuaauuuuguauuuuuaguagagaugggguuucaccauguuggucaggcuggucucaaacugccgaccuccugugauucgcccgccucggccucccaaagugcugggauuacaggcgugagccaccgcacuugguccuguuuaagcaaauuuucuuagaacacaaaaagcaagaaccacaaaagaaaaaaaaugauaaauauaacuucauaaaaauuuaaaacauuugcucuuugaaagauauuaagaaaaugaaaaugcaagccucagacuaggaaauauguauaucuuauauuuaaggacuuguacccagaauaaacaaaaagcucuuauaauaaauaaggcaaacaaccugauuaaaaaaaauagacaaaagauuugacagacaugucacccaagaagauacaugaauaacaaaugaucauauaaaaagaugcucaacauaaucagucauuagaaaaaugcaaaauaaaacuagagugagagaucauuauaacugcacuagaaugacuaaacucacagagaagcacaaacaccaagucccaaagagaaugcagagcaguaagaccucauucuuugcuggugggaagauaaaaugguggagccacacuggaaaacaguuuggcaguuucuuaaaaaguuaaacguauauuuaccaacaaccccacaaucccacuccuggguauuuacccaaaggaaaugaaaacauauucccacacaaaaacuuguacacaagauguucacagcagcuuaguucaaaauagucaggcccuggaaacaauccaaauguccaucuacugauuaauggguaaacuaauuuuguuauauccauucaauggauuaguauuuagcauucaaaagucauaaauaacugaaacauguaacaacacucacgaaucuuaaaagcaucaugcuaaaugaaagaaguuggagacauaaaagguauguuuuguaugauuccacugauaugaaauucuagaaaaggcaaaucaauagugaaggaaugcagaugaaugguugccagggacugggggugggagaacaauauuugacugcacagaugcaugagacaacuucuuggaauacugaaauauucauaucuugaauuugguaaugauuauaccacuguauaaguuugguacaacucagaaaccuauacucuuauguaaauuuuaucuuaauaaaggugauaaaaacaaaggaaaaaacaaauuuccccuguacaucuccaaguuuauuuugugagaaucaaaugauauaguuaaauuuagcugaaguugacacagucugacauuaaaaguuuucuucuaagccaaaagaauuugaaacauugcuucaaaauuuuauaggccucucagguaucaaggcccucagcuguaguuugguuagugcaagcaucaguuccuuacuuaagcagauuuaguaacacuaaauauaguguuacaucuuccugacaaaacuauuugcagcacuuugauuuaaggucucacucugaguaaaacuuuuaagaguuaauaggauaauucuuuacugcauaaaggaccauaucuagaauuuacaagcaauggcauuuauuuucucuucagagucucucuucugcaggaaguuauuuaugauauuuaugauauugcuuuaagacuaacagacuacagcugaaucucagguuuugcuauuuuaucacacacagauaccuugugacuuucuuacugggguaucacuuccucuuuuugucauuuauuccuguauauuuaacaauuaacauauuuaauauaacaauuuuuaaauuacauuaggcaagaaauauuucacacaacaaucaaagaaacauuguaucuaaguacaggcuuuuccccauaaucuuaggaaacaagaacuggagagaaacaaaaaugauaauuacugaaugagggaaaaaccacaucugugccuaaccuuuacaagucauugucagggcuugugguaggauaucauuuuuuaaaauacaguuucuacuuuauauacaggugaaagagagaugccauuuuauaccugacaaugagucuuccuaguauuuacaccaaaaauguagacuccuaugcacugcauuugagaugacugaagcccuggcaggacaaggaauuucaauaacuguagagaacugauuuucaaacaacaaaaaauauccuccgaaauuauuuccacuccaauuccucacuuagcugucaacaaaguaagaaaauaugggcauuuggauguggugaaggcugguuuuuuuccugaggggaaaaaaaaguaacuucauguauuauguuuaaaagaaaauaguuuuccaaaaaauuaaagaauaagauagaaggaaaugagauuaaaaaguaagaauuuuuugaacccuggaauaacaucuguuccuauuccccugaggcugcaaaacaaaagaaaaucccaaaaugcacucugcgaaaacaauuauaacgugagugaaugaaguacauucaaagaagauuugaaaagguuucuccuaacaaaaacucuaaaccucuuccauuuggagagagaauuacaucuuucauguagaagcccacucauucuguagauaggugauagccuucaaauuggagauccacauaaaacugguaaaauccauuagguaggaauucauaaaaucuuguuaaauaagcaagauaauuauuucugguuguauuauaauaggacaauuccacagucugugacauauucuaccagcauugcuuuacuaauauagauagaaauuccacuuguuuauagcagcuuuauucauaauugccaaaacuuggaagcaaccaagaugcuauccaguaggugaauagagaaacugugguacauccagacaauggaauauaauucagugcuaaaaggaaaugagcuaucaaaccaugaagagagagggaggaaugugaacuguauacgacuaugugaaagaagccaaucugaagcuccacacuguaugacuccaacuauaugacauucuggaaaggcaaaacuagggaaaccauaaaaagguugccaggaguugaggggagaaggggaugaacaggcaaagcacagagaaguuuuugggcagugcaacaacucugugugauacuacaaugguggauacaugucauuaaacauuuguccagaaaccaaagaaugugcaaaaccaauauaaacuaugaacuuugggugacaaugacgugucaguguagguucauugacaguaacaaagguaccacucuggggcuggauggugauagugggagagugggguguauagaagacaguugugaaccuaaaacgacucuagaaaaugaagugguuguuguuguuuauuuuuucuuaauauacugaaacuuuaguugauuuuuaaugucugaucuuaaguucucugauuagggaacuuaauucuuuaccuuuguaaagaaauugcuauaauuaaauagaauaugcagugguuuuauccuacauuuuaaagauaaguuaaaaaggcagugaucugaguacagcuggaacauuucuaaaaccaguucagaacuugucuuuacacaaauucuuauguuuugggaaugagaaucacuagguacagguaagaugcacaucugauaaaaugcauuuacaacuuaaaaacagaauagaauuugacagcuagaaaagauacauagaagcugcuaugguugaauguuuaugucccucuaaaauuccuauguugaaauuguuacuuucaaggugaugguuuuaggaggcgggaucuuugggaggugauuaggugaugugaguugaauccuuaugaaccagaauuagugccccaauaaaagagacccaagagagacccguucccccugccacuacgugagaacacaaugaaauggcauggucuuuaagucagaaagcaggcucucaccagacacugaaucuggcuucauccuggacuucccagccuccagaacugugagaaauaaauuucaguuguuuauaagccacccaguucaugguauuuuguuagagcauccagcucaaauggaacuaagaaagaaccuauuuagucaaaguccuuuaucuuauacauaaggaaaauaagacucugggucacaaggcuauuuuauggcagaaagaccagaacauugagauucuguuacuucuucauuauacuacuacauuuuaagaaaacaaaauuaugguaaauuucuuaaaauucagaggcgcuguuuuuuucuucuucuguguauuuauuucuucagaggacaugcauccaauuaguauauuucuuuggcugauaagcgcugaucaagcucugcccauuuacucauuuauucugcaugcuugaauuuuuucccaaaggucauuaaaaaaaauuauguuuuaagcauucuuaaacagccuaagaaaacauuuuacccugaaagugaauacagaauacaugugcuuauuacuaaagcaaagacuaugcuuaccaacccaccauuguuagugagaauuuagaaucuuggcugaccucuuacagagguaaaaauccacccuuggugggaacagcugcgacugugaaagaagcuacaaauaacaugcugggaauucagcaggcacuguuauuauauccuguuuauacugucauuuuuccuaucaguaggauauuauuuauacagaccccacccaugaacuucuuguuuaucuuauaauagaaauccucugaaucuauaaaaagaaaccucuguauuuguuucuggaacaagcacauguguuauaauuuugcaccucauuacacuuuuuauuuagcauuuucuuuuguuaugcaccacucguucucauuuuuaucucaagguugacuuauuucacauauuagaguugaacuuaaaucuuuuuaagagaacuuguuguaagauucaggagaaccacauccuaaaccuuaagguagauuucaucagguacauauucuuugaagauacacuugacuaauuuguuuaaagacagaaaaaugcguauauacacugaugagguacugcagggagugagcucuaggugaccagaaggcuuccauacucagacucacucuaaccuaaguuagaccaauuacgaggacaaggcuuuauucaguucuacuaccucacuauucucuagcuggaucucuucucugcaaagagaagccuugccccugaguuuagcuugauggcugggcagucuggguaaaaaauguaacacaauaauacacaaaaaacauaggaguucaguaaguugaccaacaggacaaugaaccaauaugguuaucaaucauccucauuccccaggccugauauaaacaacugaaguagauaaaggaaaaaugcaagcuccuuaagggcaaaaauucacacagcauuuguugagcaaaugaauuauuauuuuuggagagggcacaccacugaagaaagucacacuggacaaauuuucacauguauagcuugugucagcaucaccuguucuccucuuacacuacaagguagcuagguaaacauggaaaguucagaguaccugcacaaugcuagacucuuuguguaaggaaaggucacuccugaagaacauugcucuaaaaugcauaauuaaaaugaguacuacaccucagggugaugaacuaaguguaauuaauuucagaaaaaaagagaggucugcaaggacuaaauuggucaagaaguuaaaaugaggguaacaacagagauaaucuugauaaacagaaauucauaaggcugagaugaggaggugaaagguaucuuuggcacaaccaaaacucugggagcauccaacugggcagaauucugggaauggcaaauagugaaauucagcugggggcauacugaauagaggauggcaacaaacgaaaaggcuggagucagauuaaaagaaauuucauuuuuuagacaauggagaaucaucagaagauaucugaucaaaggaagaugaaugcaagcuuuuggaguagaaaugaagaggaggaagaacaaguuagggugaggcugaaaauggugaaagaaguuuguaacaauaccaaaucccauagauauggcagcaaaagaaagguccacgugguacaauagauaauaaauguguaaauguauuuucaguucuugcuugcgaaaacaggagaugauagccgggugcgguggcucacaccuguaaucccaggagaucaagaccagccugagcaacauggugaaaccucaucucuacacaaaguagaagauaggcugggcacaguggcucaugccuguaaucgcagcacuuugggaggccgaagcggguggaucaccugagcucaggaguucgacaccagccuggccgauauggugaaaccccgccuaccacaaacacaaaaauuagcugggcgugguggcaagugccuguaaucccagguacuugggaggcugaggcaggagaaucgcuugaacccaggaggcggagguugcagugagcugagaucgcaccauugcacucuagcuugggcgacagagcaagacuccaacucaaaaaaaaaaaaaguaaaaaauaaauauuagccgggugugguggugcacaacuguagucccagcuacucaggaggcugauauaggaagaucacuugagccuaggagguggacgcugcaaugagccaugaucacuggccacugcacuccagccucgggaacagagcaagaaacugucucaaacaaacaaacaaacaaaaaaguaaaaacaaaacaaaaauaaaaacgggauggcaucaucaugaccauuacugagugagguaaugccaauccacugaaguuaaagucaguaaaguuuaccagucuccuagaauagcauuucucaaacagaaaucaccugggcuucugguuaaaauguaaauuauguuucagcacauuuagagcaguauucaguauuuuuuguuuuuguuuuugagacagagucucgcucugucgcccaggcuggagugcaguggcgcgaucucggcucacugcaagcuccgcuucccagguucacgccauucucccaccucagccucccgaguagcugggacuacaggcgcccgccaccacgccuggcuuuuuguguuuuuaguagagacagaguuucaccguguuagccaggauggucuugaucuccugaccucgugaucugccugccucggccucccaaagugcugggauuacaggugugagccaccacgcccggccaguauucaguauuuuuacgauucuagcaagcucccaggugaugccaauaaugcuguuccauguacuauauuuugaacagcaagaugggaaaacauaucuuucaguuucccuuuccaaaaaaggcaauacuauauuuaauguaucauguuuaacccauuaugguuuauuccaugccuuuagauaugcucaagaaaugcuuuuuaaacauauguuacuaugauuugcauuaauuaagauuggauggguuucaaagcuacuauuuuaaaaguccuaaaugauucaagauucagggaauucaaaguacuaagaaaugcuucuaccugaaaaaaaaaaaucagcguugcaaugcuauucuguaacacuaaaauuuugucuuuuuaguuuuaggcuggcaaacuggaagauacuauugcuucuaguaauggaggcugaaauguaaguacugaaagacaacauuucaucuuuucaaaguccacaucagugaguuucacuaaaaccugcuugacuuguccuuacauugcauuaagaaccauaacuugguccuugaagauaaagguuaacaacauauuuuaaauauccuacagaaaaacaccuaaauacuacaacaauuaaacuaacgcacuguccuuugguauaagacuucuacaccgaaggacaccuuuaacuaaaguauuuuaccauaagcagaagugucauuuauaaaaauauauuacuaguguaauauauuaaacacacacacuauaaaagauuggcugaccuuagauacuugggaugaaauauaagacuucuaaacucugguguuucauuuuuaaccaaauuaauggccaguaacaaccuuuuagguaaauuagcuucaguauguaucauggucuggagaacagaaauaauaucuuuaaaucauaaguuauuguugaagaucagauccaaguauuucauuguagcaggaagaaaacugaggcacagaggcuaaaaagcccaaauucacauagccagcuaguagaauguuaacaaaaggaggggagaauuaauuuuuauaucuaucaauaugcaaaguacaacaauguugcaacuacaaaauguaguugaaaagaguguccgguucuucuaacgacuaaugcccaguuacuuuuuuuaagggucuuauaaaucacugaaaucuaagaaaggaagaucacacauuaacaaggaaaagacaucugcccccaaauuuaagaacgucauuaaaaaaugcaaucugaauagagaaugacacauauacaccacauacuagggauggggcuuagguggggguggagaaugggaugggauauaaagaacaaagagaagacaauggugacucuucucaguaauguuucaaggaaugcuuuuacauauggaaaagugguuuaaaaaacaacuuucuuuacccucaugaaucauuuuuuaacugguauaaucagggauuauacuuggaggauuacaaagcuuuuaaaaauauguaguauagaaagcaguuggaugugcaugugucauaugcucugucacaaucaaaagcaaacuauaggaaccuuuucuagccacaaaauagggaauuuugugcuuauuaaaaaugcuauaaaauuuacuagcacaagucaaaaaaaucacuagagaaguucggcgauauuggagacaauggguuuuaaaucacaggcauacauaauuaugccuaaguugacagaucugcacugcaaugcagaaaugcaagcaauauuccaacaucugcaccagaaggcagagacuacacaugauuccagaauaaagggcucuucagcucuuaccuguuaccugugcaacaacugcuugggaaauccuccgauuggcaagaaaggcuuugauuuccucuuuuaucacacugcugucccuccuaacaaaaacagaagacaagaccaacaauguauguugaagguagaaauccucaucuuugcuaaaagaaaggugaagcagagagguggggagaacacagaaaggacacaaaaauaaaggguaaacagaccaaacuugugugaaaauaugaaauuacaaugaaccaagaaacaccaaauauucaaguccuaaaacaucacaccaucaaacagacgcuuuagugaagaccacaauagauaugucucauaccagaggaugguuaaucacaugcucuguauaauucacauuaggaacaaggcugucauaugguauauacaaaguuucauuacuggggaaugaauauaucuuacacagacagaaauccuagaaaaauaaagagcaacaacaacaaauucaguugugagcagauugugggcucgcauguuaacuacacaacugcaugaauaauguucauuuaaaaaccuuuaaaaugauuaaggaaaaagcaaucaucauucucacaaccguaaaaauguuagccauuugaagaaaggcuugcucuuuaacuucuuuuccuguauaaacaaaaaauuuaaagugggauccguugaauauaaaguuuuaguacuaaaaaggcauuuauacauuuuguauuauauauaagaauacuuaaaacuacauaauauucuguguucaugggaauacauuauagaccucauuuuuccuccacuaaaaugccuguuacaaauuuuuacuuagacucaacaaauucucaaaagaccagacauucacaaaaaugacaaugaguggcaagacuucuguuuuuccaccagaacaagaauaaacaaaaauuauaguuaaacucuuaaaaccgaccaaucucucuuucaaugcuuuauuuucaaaaggauuacauaaacagagcagugguuucuguucaagcucaaaaguaacauagaauagagguaacuucuuaucuaacacaggggucagcaaauuaccgccuaugggcuaauucuagccugccaccuauuuuuauacaaccuaugagcuaaggaucauuuucacagauggacauuugcaaucaauuugacgacagaaaaugcuaacgauaaacacauacuaagcaaaauauuaucccucccccugcaauuucauucuucugacuagcaggccuguauuuuuaaaaacuguacccaauuauuauuauucuguauugacuuuugucaauaaaaauuuguggcuguuuguuuucugucuuguauauaucucuacauuacauccucuuuuuuuuuuuuuuuuuuuugagacggagucucacucuguugcucgggcuggagugcaguggcgcaaucucggcucacugcaagcuccaccuaccgggcgcaagcaauucuccugcuucagccaccugaguagcugagguuacaggcaugcagcaccacacccggcuaauuuuugcauuuuuaguagagucgggguuucaccauguugguuggccgggcuggucucgaacuccuaaccucaagugauccuccugccuuggccucccaaagugcugggaauacaggcgugagcaguagcgcccagccuacgucucuucauuauauccuuaaauuugccucuuggccacaaagucuaaaauuuuuacuaucuaguccuuuagagaagaaguuugcugaccccugaucugagacaaaggaucacaaaaccuuaacaauuguuuugugaaagaagcacaaacucuuucuagggguucacaucucucuguagacuauuuggagaaacugaaguauccuauucaaaaacaaugaguugugauuuaacuuggaugagggauuuuagcucccugaugagcaguuguuacaugcucuguugaaaggacucuguuguaagaccaugcucccuuuggggaauucuggaaaaaaacagagaggucauaguggugaguuuccaaucuguagcucuacaguauacugcugaucuaucaguuggaaauccugaucaaaaauauuccuaaaggaaaaaauuaaucagcugccuaaugcaguaaaauuucucauacugaucuagauucugguuagauucuucccaaaaugacugucuauauuugaaauauuucuuucuuucuuucuuuuuuuuuuuuuuggagacagagucucgcucagucgcccaggcuggagugcaguagcgcgauacuggcucacugcaagcuccgccucccggguucacgucauucuccugccucagccucccgaguagcugggacuacaggcgcccgccauuacgcccggcuaauuuuuuuuuuguauuuuuaguagacacgggguuucaccguguuagccaggauggucuugaucuccugaccucgugauccacccaucucagacucccaaagugcugggauuacaggcgugagccaccgcgcccggccugaaauauuucuuugacaaauaugcauucacauuuuauuuaaaaauuguguauaugaaaaagaaaaagguacaaauaaauauauuuuaaagucaaacaaaauaacugcugacuaaaaugcagguaauguaaaacaaaagcuuucaaauaugcaucaauaaucaguguacaagagauaacuucagcacuauuucaauuggcuuauauaaauaaaacaaaucauuugguuucuaauauaacuauaaaauuaaucugaaacuuuuuaaauaaaguauugcauuucuauauauagaaugaccuacgaaaaugaagcugaauuuaagagaauauuuauucagguuaaauaaaagaauguacuuuugugggggaaaagaauuaaauggguuuuuugacuacuaauuuacauugucauuuaaauccauuuauuuuaaauuaaauucaucuggacacuaaaucauacagaagagauaacacucaauuauugaaauaggaaauauccaguuuguaaauuauucacagccuugcagcacgauauuauuaaggacugcacaaaacagaaggaaucccaaaaaucugucaaacaguagcaauucacauuuuuagauauuugacaagucucuaaguaccaauaauguuuaaaaacauagaaauagccaggcacggugggucacgccuguaaucccaggacuuugggaggcugaggcgggcggaucacuugaggucaggaguucaaguucagccuggccaacaugaugagaccucgucucuaccaaaaauauuuuaaaaauagcugggugugguggcaugccccuguaaucccagcuacucaggaggcugaggcaggagaaucgcuugaaccccagaggcggagguugcagugagccgaaaacgugccacugcacuccaaccugggugacaaagugagacuccaucucaaaaaaaaaaaaaaagaaaaaaaagaaaagaaaagaaauaaaaagcucuucacuguuuuaccagagagcuuuaucaaaaagcaaaacaaaagacuuaaaagauaagguugugcauuggcaagucauuuaacaaagcugggcccuggcuguaucaucugauaaaauaaaagcacuggccaggugcaguggcucacuccuguaaucccaguuacuugggaggcugagacaggaaaauugcuugaaaccagaaggcggaugcugcagugagccaagauugcgccacugggcaacagagugagacuccaucuaacaacaacaacaacaacaaaaagcaucaauacucccuucacaaggcuuuuaaaauuugucuccuagcaaugaaauuaaauauuguuuguauauauaugucuguaauacauagaaucaaaaauucauugcaaaauuuuuuuuuaaauuguaaaaauacuaaacauugacuauuauuuuaugaaacuucagaaagguucccaagaaaggaagaaacaaacgaucugcuguaaucauauaagaccaaaguaaacaucuguaccagguacuuuaagguagcauuaaaagaguucuauaggcaagcagugaugugucauuuaguugguuucacuagguauuuucaaaauacuaaaugcauucuauuuucauuguguccaauucucuuaaguauuuuuaaaaguuccauucuaguggguuagcuuuguuguucaaacuuugacaucacccccgacccucauucucuccucauucagccuucuuuaaggaccugcuacuccuauuguccucauuguaaucuaugaaaucaccacuuugguagugugaaaacuucauuuacucuaaaucuaauucucucaucuucucccaccccucacuuccucucuucaucugcaauuuuacauccuccuuaaaaagaauaaauccccuccuuccucucuucucuuacaaaaucucacacucuucaagauuucuaugccucaaaucuuagggaauuaaagugaagagcgggcugaucuugucuuugauuccacagcuuacuuacuucaagauaagauacccaccugauuugcaacuaaccaguucaaguccaugucauugccuccuacucccuuuuucaagucauugccaugcuagauucaucugggugauuuccacaccaggaugaaauucuuccuucccacccuccauugccauuauuuuuauaacuugcuaaacuuucacuguuacuuacagaccuuucuuaauaucuggaugaauucaucaguuaugccuguugguugaauccccuuuuacuaagacacaauuuaacugucaucuauucaaagacguucucccugaucuucaaagcuaaaaaaggucucuucuugcaauggcuaacuuuaacauuucaauacuacuacucgcaugcuaauauauuacaugcuguucuguauuauaguuguuccuaaucuugucucaucucuccuacuacccuguaaaguccuuaguccuucagcacaaagauggugccuuauucaauuaugggguuugcauauaauagagcuuaauuuguucaaugaaggaacaguucuguaguuggagauaaaagguuguaaaauggaaagccugaucuagauaauuuauaaaacagcuuuaaauuuuuauucuuaaauagauuuaagcuuaccaaaucagaaaggaaaagaauuauuuauaguagcucgaaaugacauugcuuccuuuucuagaacaaagaauaauaaagaccaccuguuuuaaaaaugauaugcuuuaagaucuuccauauuuucauaguuaauauacacugcacauucuuuaggaucucuuaaagguaaucaucuaucugacagacuuucagagaugaagcaacaccugccaggacagacuauuucacacuuggaaaaauacaaugauguacaaauuucuuucauguuugaauaaaaccuauucccauacauuuucaccuauggagacaaaguauaacuuuaaauuuuaaaaaaucacucaaaaauaaaaguuacuaaauauguaucaauaacauaguaacuggagaucaugaccauuuugucuuaucuacagaacaugcacauccuacuuaggcaaguaaaauacuuagccuauagauaaucaacuuagaauaaagccucaguuuuauacaaaauacuaacauaucauaaaauuuaguacauggguuguuaagaauaauauccuuaauguauggcauuauuaauaaauucugauaagccucauuuaaauuauuucauaauauguacaugaaacacacauuaguaucuauaugcuauauuagcagauauguauacacacauaccccuacacauauauuuauauauuaauagaugcauuuuuaaacauuaaaacguaaaacaggucuuuauuuuuggcuuuaaaguccuuccuaaaauguuauauucaacaaucuguuaaauucauaucguaauuuaccuuuuuuucccaacccuaacucaaaaaugaaaaaagugaaaguuacuuuuucauuguuucuuaaugagucgauaagguguacaauuacaacuugaugaaguucuacaaaaaaaucuccauuaugagcugggcacaguggcucaugccuguaaucccagcacuuugggaggccaaggugggcggaucacuugaggccaggaguuugagaccagccuggucaacaugguaaaaucccgucucuacuaaaaauacaaaaauuagcugggggugguggugcacgcuguaaucccagcuacgagggagacugagacaugagaaucgcuuuaacccgggaggcgaagguugcagugagccaagauugcaccacuguacuccagccugggugacagagcgagacugucucaaaaaaaaaaaaaaaaaaaaaaaaaaaaaaacuccauuauguaucucgaaauuauuaggagugaaguucgugaagucaacgaauuauaagauuuuuaaaacuacaucuuguguaugaguugaggaaugugaacaagcaagaggugaagcacacagguagaaaaggagacaggaaagcauucagauacccaggcucccccaccagagacuaccacuuccaacgggcuaucauaucaccauagcaucuagugaucagcaagggcaguauauuccuaaaagggcacagaauacucagaaagauccacugcucaaaauauuucucuaacauuccacuaaauaaaaauucaugugguaagugauuguuuugaagcagcaaauaucaugggggagggggaugugaagcccauuaaggcaauucauacuuugucuuauguuaauuaaccaccuuuccuaaaaucuuauuaaaaucuacagauaugaaaaauuuauuuggagagggaauguacaccagugacauauugauaauaaagacauaauuuaggcucugccacuuaauauugaaguucucuugggcaaaguauuuaauuuuugugaauuucaguuucucugaucaaccucacaucaugguuuuaaugauuauaagugacaaugugauccaauaaacuuucccacugauccaaggauuguuauuaucuacaaccugagaaucgugagagggggacacaauggaggaaagcaggagugcagcagugggugagggugcaauggcagagaaccagagagauccagaagggccacugagaccccaagaugaucaggagaacccaaaggagcaguucuaauaaagaagcagagaaauggaaaaagauaaaguguccugauuaugcgacaagugguaguacauaaauacugauaacaaaguauaaaccuguauauauuucacagugaaacuggaauggguguaauuaugggauuuaacuacaaaucccagucacugcuaaauagguuuucauuuauuuugagcauauauuugaauuaaaacauuaugucaggcuaugaguuaaaagucaaguuuuuagaccuuuauuauuccagacaaucuucuagagacuuuuacuaacaaguuuucccauacuucuuguuagucuuauacacauuuaagaauuaacuguuaugucaaaagcuuaucaaaacugaugaacagcaacaacaccgaaaaaaccagguuggcauccuuuuuaaauuguugauauccucucuacuuagaauaauuaaaagcuaaucuuguuacauuucaaugagcgaaguaacuuuuauuugcccaaauuguucucccucuuaaucguaacaacauuaaauucaaaagcaacaccugaacuuuggucaccuacuuuaacacaugaaaaagaauucaaagucaaacugaucucuuauauuuuuaacuuuaaaaaaaaaauuagcugggcaugguggcacacgccugcagucccagcuacucaggaggcuaaagcaggagaaucacuucagcccaggaggcggagguugcagugagccgagaucgcaccacugcacuucauccugggugacagagcaagacuccgucucaaaaaaccaaaccaaacaaaacaaugacuuguaacuguaacugcuguaucaaauuauucauuacagguauuaauauuauacuuuauuuauacuguaucuggaauccagauaaaauaguugauuuagcacagaauuucauauaauaaaguugcaccuaaaaauaaauucaggacaguuugaaggauauuucaacauugugguacuauuggacauaucuuccauguggcaauauuauuaugugucacuauuauuccaucuugaaguuuaaaaaucuuuaggaagaauuauaaugauacuuauagguacuauuuuuauuucugacaaauuccuguuacaguuucuuucauaaucuacuguaacuaauuuaucugcaggcucuuucccuucuacuguaguggaaaucuacugaaaacaauaccuuuaucaucucuauuccuagaggaguuuuuacaaaacuccucaauuccaacaaaaguaaauaaacuaguauggaacucaaagucucccaaaaccuguuuugucuccuaauauauuauucauauuacauugucuuacccaucaguaauuuuuaucagacugaagacaugccuugccuuucuuacccuuuacuauucccuuaauuuuaaauacauuuccuguauuuuaaaacaaaugcuauucuuuaccauuuaggucaaggucacccauucauuaaacauaucaggcccuuaacaugugcuagggaaaguuccagauccuggaggcacaauaauggaaaacacaugcuguuacccucaaagugucccaggguccagugugaagccuuuccuaauuacuucuguugaaagcagauuucuuuucggcugggugcaguggcucaugccuguaaucccagcacuuugggaggccgaggcggguggaucaccugagaucaggaguucgagaccagccugaucaacauggaaaaacuccaucucuacuaaaaauacaaaauagcucagcaugguggugcaugccuguaaccccagcuacucgggaggcugagacaagagaaucgcuugaaccuggaaaggcagagauuguggugagccgagaucacgccauugcacuccagccugggcauacagagcaagacucugucucaaaaaaaaaaaaaaaaaaaaaaguagauuucuuuucucaguguuuaaaacucuaaguucuuacacuuauaaaagacaaugugugugugugugugugugugugugugugugugugugugugugugugucaucuauugcuaaaauuagaaccuauauaauagguaccccaaauuauuuucuugauuggaauguugaacagaaaaauuaagaguguacauauucugaucaagauaaaauuaucccucagaaaaaguacuuacaacagauuuuuaaggauuagaaugugucuguuagucagaaauuagcuauuagagucauagagaagauuaguguuugauaaacagaauggaaaaggcuugucaagcagcaaagagaaagggcugaaguaaagaagagaaaauuuaaauuaaaaacauaaagcuugaacuuucuuucuuucaucuccaaaggugggaggaggaaguuacaguucuuauagcuagaggaaguuacaguucuuauagcuaaguagcugaaacgcagcauacuacuuaaaaacaaucuaagaauacagacauuuuuagggacucugaauaagcaaagucacuaaccucauuaauucuuccacuuuaucaucuacaucuagguccucuucugaggcuucaaaacuguaugaccucugacccaugcuguuugcaugguagcgaguuggugacaucuuuccauuggauguagauaaucgcucauuauucucccucccauuuugauugguagugcaaggcuguggggaaguaucauaacuguugcuaggugacggggacauucccgaaugcugcgucuguguggaagcuguagcuguagaggaagaugcugggacauuguuaguacuauucccauaugaacuuccuccauagcuggaccuucuuccaaacuugucacuaugcucuugaucaagacgguccaaaguuuccaaggcauggagaauuucauguuuagucauuccaguacgccgaagucgcugaagcagaucuaucugcucuaugguaaaucuggguucaucuguauaaugagacaugguuuccagcaaacuaaaaaaaaagagauaaaaagaagucucuuuauugacaguaucuaccaaagcacauauuauacagaaugcucagaagaugcaauauuucuacauaagcuucuguauugaaaaugaagguaugucccaugcuagaaugauugugccauggcaaauggauugguacagauacuaaauguauuaguaggugaacauagguguaacauaaaaccuaauuucauauggcauacaauuuacauuuuccucaauuuugguaaauaucagaaccaaaauuuuaguuauguaaauaauaccagaacaauagauuagguacauggagugcaauaagcccaggcuacgugauaacucagaaguguuuugcccaucucaaguguauuacucuacauuagaguauuaauggaaaauuacugaaaaaaauaguuuguauuauauuauuuaccaaauauuagcuaaacagaccuaggaauucucuacaaccucauuuagugagaacaaaugauuugcuaagcuaaguccaagcaaaugcuaauaaccagcaaaaauacuuaaguggaaaacagagguacauuaaaaaaaaaaauaagcaccauuucauucacuacuuagcaauuuccuaaguuuuccaucucugguaaugcauucucucuuaauagcuacccugagaaauagaucuuucaugguuguagccaaacaaugcuauucauuuuucuuaggaaauuacuuuuacauguuuccuuuaacuagcacaagauacuacagcacaucagaaaauguuuucuuagggugaguaacaauauuaagggaguagucaaauacuauaaaaauucucacugcuugaaucccuuuguuguuguuguuguuguuguuuuggauacagaguuuugcucuugucaaccaggcuggagugcaguggcgcagucuuggcucacugcaaccuccaccuccugggugcaagcgauucuccugccucaaccuccugaguagcugggauuacaggcaccugccaccaagccuggcuacuuuuauauuuuuaguagagaugggguuucaacauguuggccaggcugaucucaaacuccugaccucaggugauucgcccgccucggccucccaaagugcugggauuacaggugugagccaccaugcucggccuugaauuccuuucuuauaagaccugaguuuuccauucaagauuuuuuaaaguuguaaucucuucuauuuugauauuuauuguucuagugccaaauauaaugcauggcaugcaguaggcucucaauaaguguuugcagauggaaacagaugucaagaaauuucuucaucuuucucaaacaaacaucugcucugggccaguguccuauagcuauugaaggucucacuguuucuuuguccuucuacaugaaaacuuuauuaacagucacuucuaggcaggaacuggguacgaauuucacauaacauaaucucauccaauucucacagcaacuccccaugguagauguucuuuauucauuucauuuuauguugauggauugauuguugaggaaacuaaagcucaguguaguuuuguacuucacaaaaaaucugaguaaacaguaggaaaaagauuuaagccuagaucuuauugacuccaaaagcacacaucauucuccuuuacaauacauugcaggacuuaacuggaaacauaugauuuggcacacaggcuauucuacuccuuuaagucucauuuaaagccauuuagauaaaacuauucuaauuacugaugaaccuagggguccuaguaauaguuuucuacauuuaaaauccuugcuccaucuagaauuuuuauugacuuaacaaguauaaaaaauuggggcuuuauuucaucccaaauggacagcuagaugucguauguuuuuacugaauaucugucuucuccuccgaugugaaaugcugccuuuaucauauacacaauuuccauaugaaucugcauuaccuuuggauagucuauuccauuucacugauuguuuuaucuuucaaauccuuuuaaaaauaaguagggaaaaaucuagaacuguagaugaaaucuuccugguuuuuaaaacaagcucauaaaaauaaaacaaaaccaaacacacacauucuguggaccuaaacauguugcaggccauuugugcccaugggccacaguaucugcucuacaccuacaaauguuagggucugauuucuuccaauacucacuuguaacaaguuagccaugauuuuaaaaagaccuauuuucaugauuauuauauucuuucuugauggccuaaguucccccacaauauuuuguaaugaaaaaaauuaaacauaaacauuauuauuuucccuugaaaaugaaguagaccuguuuguugcuauuuucagucuucauguuaucaaaguauuucauaaagugaucuuacuuuagaugacuucaauaacuguuuuauuauauggacaaaaauccccaaucauaguauuuuccuauaguauucauaucagagcaguuaguuaucuauauacaguucuucaaaccauuccuuguauggagcagcacucuguauuagcauaaagcaaaaguaaauuguaugaauuucacuuauuacugaaaaguauccauccuaacacuugaauuagaauugucaaaacuaaagauuucacagcauaugaaacaaucuaauauuuugugucauuucagauucauugacuauuagaaccacuuuuauuccaagucauaaaaggagaaacaauaggccaccuauuuacuuugucugcuuagaacaccucauucuuuccaagcacauguucuugggcuaucacucguaauaccccaccuucuggccaguggggugagcacagaagaaagccaaaccuugcucuccccauaauuuucuagucagacgaggggaaagaugaacagucaccauaacuguguucaguugcaggaagauauuagucugguaaauuccucauuauauggaagcagcuaguucaugggaggaagaagcagacauaccaagaaacguggaacagagcgauggagaaagcucugcagcacucacaucccuuguuccaauaaucccuaagccccugauauaucccugcucuucuugcuguuuuguuucaucagagaauacauuucccuuuauguaucaccuuguucaaauuagaugucugugcccugcacugagaguuuccuaaugcaaauauaaccuaaagcaaaaugauccacaauugcuagaaugaucauucauaugaucacuacaaagcaaagugauuaagagcauaacaaacaggaucaaagcaugcaugugacacugaagauacaauauuuuacugagaaaacgcugagucuagaagcucuccuggauauugagaauaauguuccaauguguauuaauauaaacaaaggcauauacuccggcauuucacaauuuuauuucucauaauuuaccuaguuuaagcauauaaucacgaauuuauggcaguaaaugaccuacaaaggucaucuaaguccaugauaccagcaauucuuuuauaacagaaaaagauaacauguaagaauugaauuaauuuucuuaugcacaaggauuguucagaggauaaggaacaucuuucacuuuaaauuacuaaucugaaugcagacucaggccaacaauaauugaaaaugaugugagaagaauuucaccacuguaauaacagacaguguuuaaggcauaaaagaacaauuaaauucaggaauuauggcucaguucauaaacugauauucuaagaaaauaucauaccauaagaccauaauaauaacuuuucacaauacauuuuauccugacuugaauauguaccuaaacccuucuuggauaaggcaugaggucuagaauauacuuucauaagcuaaauucuacaaacauguagagcaaagaagauuaaagcauucacaaauaauuaaucuugaaaucacagagguaaaaaggacauuacuaucuuacuuguaaagcaccaacaguaaaauuuuauuggauaacagcuuuuucuucagcucaauucugcugucuuuauuuuuauuaucuagaaugacuaggcaaaauagguuaguuuuguuuugcauacaugauauuuacugcaugcuaauuuaacacacucuagggucaaucacaauauuuuuaucagagagagaacucuccauccucucaggaaugucaccucaugucaaacugcauaugugaguuacugucacaacuacuggacuucaaaauacauauacacucaagagcuuaacagacacuuugggagcuuaggcuguggcagggcuacucucugucagcagcuucuccaaaaccagagagcucaggcugcaacaggccucaaagcuuuuauaccuugcaggccagcauuuucuagcacugaggggccuuccuuguggucucagaucucagcuaugguggucaagccagccucucccaagaacugcucauguaaagguacaccuccaccuuuagccuucacuugaacacagaggccuccuuucaucauaauugagcaaagacacuuuaauagcuuuggaacacauucauaaugugguuaauguaccucaucuauugaguguauucccugugaagucugucuauguuacucuccccaucuuuaaguacugugaacccaagaaaaaauucucuuuguauggcaauaaacacugugauucaugaaaucauacuuugaucaucuuauuucuaccauaugugacaaaaauccaaguacaaacaugcacauuuauaaagggagauauaaguuagguguggaaugagaaaacuggagaucacuuagacaaaaaucauucauuuaaguaacauuuauugaaugccuacuauguaacagauccugugcaaggcacagaggacacaacaaggaacaaaucaggcaaaaauucauggcuucaugaugcuuacauucauuucaguaacuauuagacaucuuacuauuuucaauagccauuagacgucuuaacucuccugaaugcuuagccaucuaucucagaaacuucuaggcuuugagcaguuaaaaauaauaaguaauuuuauauucaauuuaaaauuaaugucaaaauucaaaguugaaaauagaaaugguaacagagaaggcugauagauugaaaauagccauuagcaaauaaauuuuuuuaaaaaguggggagggaaacuaaggcccaaagaggugaagugccuucccaaggauauagcuacuuagcagaaagucgggcuacaguucacaucuucuaggucuguuccagaaacuuuucacuauaucauagaaucuacuggggugggggugggggaacuauaaugaaaagccuaaauaauaaggaaaaucucucuuaauguuuacuuacuguauuauagaacugucaaccaaaacggaaggaauuuaagcaaaguggagacuccaucaaauuuuagaaaauacuuaugcuaaaggcacucugcauucgacucuaaagaugcacuuaaugagcuaauagauacucugucuucucuaauaucugaaauucccggaauacuuuuauucaaaggccuauuuaauaugaacuggugguuauaguucauauccuagcacaaaaacacucucaacacaauaccacuaucucaauuuguauuuucugccugacuccaaagaaaggcuagcacaucagcuaauaggcuuaacuacaucaucaugcccccagcagguaaaggaaaaugguuaaggugcuaggaguuuuuacacaaaaggcaacaugaagauguaugcuuccaguagucugcuugucacaaggaaucuaauauuagcucucuugaacuguuagucaucuaucuuggaugcuucuaagcuuuaagcaguuaaaaauaauaauuaauuuuauauucaauuuaaaauuaauguuaaaauucaaaguugaaaacagaaaugguaagagaaggcugauagauuuaaaaauucauuucucaccacaugaucaugacacuuauucaccuuaaugucaaauagguauaacauuugauucauuuucuaaaaaagcuuuucaacucuacaaacgucuguugucaaaucuggaucauaaucauagugacaucuuaacuuuacuaaaaugauugugaagauaaaaaucaaaaaggacuugauacuuacaccacuggaaaggaacuaagcauacuuuacaugaggcggaucaauauccuuuccagagaugaucugcguuaucuaccauucuguagaacaaagauagaaaauugagaaacauuuauguuaaucaagugcugaauaaaaauuuuaauuauguaacugauggacagcaagaguuaacacuagcuaaucauguuaaauauuauaucuucugauuugcauucuacugcuuuauucaccauacacuuugaucccuuucaauucagacacagaucuuaacaaaaaaugguaucuacuauucauuguuuagaagcuaaagaucaugaagacaacuuauuagcugguuaaaaccauaguuauagaggcacugauuuccauuaacucuaagauuauaaauuagacaaaaguuaaaaauguugaugucaaaaacucucacauugaaauacauauucaguacugaauuauauuaagcauggccaaaguguccaacaaugacuaaugauauaugcaaaauguacaagguaaaguuagaaaccuuucauauuuguauauucuaaacuguagcacuaaugaaguuccuguuguagauaauuuucuuguugacuuaaaaacaggccaggcgugguggcucaugccuguaaucccagcacuuuaggaggcugaggcggguggaucaccugaagucaggaguucgagaccagccugaccaacauggcgaaaccccaacuguacuaaaaauacaaaauuagccgggggugguggcacaugccuguaaucccagcuacuugggaaacugaggcagaagaaucacuugaaccugggaggcggcgguugcagugaaccgagaucgcaccaucacacucuagccugggccacaaacacauuuuucacuaccugcucaaauucaguuaaaauauaugaggcaccugcuugcccuggcauagacacaagaacuaaauaugaguaagauauggucccaacaguagaggagcuuaggaguucauuaaauggcgggagguggggagaauagagacuagggacaaaaauuauagacacaccccucucaaauaaaaaauauaauacaaaaaaaaagaccaaaaauacaacguuuauaugaguaacaauccagaaacuaauucagguuagagagaacuaggaagauuucuuagagugaaaucuggcuguuauuugaggauuagaauaagacuuccacaacaucaagguguagagggaggugagaaucaguggaggaaagauuccaggaagagggaacagugaaaagaaauuaugagauuuauuuagggaauuaguaggcuuguguugcuggccuuuaacacaguaugugugaggaguagaugaucuagaaggggauccugaccuuuauucuguaaucaugagaaccaugcagcacguuuacauguagcauguuuagcauguagcaugcaccaugaauacagaaaaaaggucaggcuccccuucuagaggggauccuuugacaacuuccaugcuaggaaguuaucaucaaagacccucauuucacagacaggaaaacagauuaagucacugauacaaauuuauguaaccauaagacacugaauuaugucaguuauauuucagacauaaaugggcuuaaaauauucuacaaaaaaaggaauguucuaaaaacagaagaccaagcaaacaagauguuaugaauucucucaauuucauaaagcucuucuggcagaggagacagauuauuuuuuucuaauugacagauguuuucaaguuauuuuaaaaacagaucaggaacuaaauaaaaauggguauuaagaucacauccacacugagugcaauggcucacaccuguaaucccagcuacuuaggagguugaggcaggaggauuacuugaggccaggaguucaaggcuaguuugggcaacacguucaaggcuaguuugggcaacaugaugagucccugucucaaaaaaaaaaaaagaaaaaagaaaaaaaaaaaaaaaaaauaaaaugacacccauucgaaugccuauuauuuauaaaaauaaacauaaaauaacaaguguggcaauaauguggagaaaauggaauccuuguauauugcuggcugaaaugcaaaauggugaagccacuauggaaaacaguauggcaguuccucaaaaaacuaaauacagaauuaccauaugauccagcgauuccacuuuuggauaucuauccaaaagaaguggaaucaggcuguguucacagcagcauuauucacaaaagccaaaugugggaauaacccaaauguccacuggcagauaaauggauaaaugaaaugugauauauauacaaacagaauauugucccagccuuuaaaaggaaggaaacucugacacaaaaacaugaaugaaacuugaagacaugaugcuaagcgaaacaacccaaucacaaaaggucaaauauuauaugauuccauuuacaugagguaccuagaguagucaaauucacagagacagaaaguagcaugguggguaaaaugggcaaggaauaaugagaaguuauuauuuaaggguacagaguuucaaucugugaggaugaaaauguucuggaaauggaugguggugacugcuguauacuguauguauuuaaugccacugaacuauauacguuaaaaugguagauuuuauguuaugcauauuucaacacaauaaaaaaguagaacauuauaauaaaaacuuuauauuaaaaggcauuagggauauaaauuuauggaugcuggaucacauucaagcaccuggccauagaaaacaagcaaccuauaaaagaaaaagagaggcugggccugguggcucaugccuguaaucccagcacuuugggaggccaaggcagacagaucaugaggucaagagaucgagaccauccuggccaacauggugaaaccccgucucuaccaaaaacacaaaaauuaguugggcaugguggcaugcaccuguagucccagcugcucaggagucugaggcaggagaaucgcuugaauccgggaggcagagguugcagugagccaagaucacaccacugcacuccagccuggcgacagagcaagacuccgucuccaaaaaaaaaaaaaaaaaaaaaaaaaaaaaaaaaaaaaaagaaaaagaaaaagaaaaagagaauaaguuuacaauuauaaaauauacaguuuaugaccaagauauaagaguuacaaacacaaagaccaaauaacaugagagguaauaaagcaaaaaucauaacuacuuuaauaauuuuuuuuuaaaguauaaacaugaguuauuucaguauaccuuuuaaaaugaacaaauauaguuggagaaaauuuaaaaaacagaaauuugauauauuaucaauaaacauaauuuuaaagauaaaaagauacuuuguaaaccuucuaacaaagaaguuuuuuuuucccuauguccauuaccauaauugaucacaaacacgguaaaacaaaagguuuaauuucauauauauaauccaaacaaucuagggaaaaauguacaaaaauaacuacuuauaaacuacaagauaaucauaaauaacccuuggaucaaagaagaaaccacaaaagaaauuaugaccaacauaacaauacacugugacaaaaaagaggauuguucuucauaacaaaaauccaggccaggcacgguggcucauuuuuaaaagucaaaagaaaaaauaguacuuaaaaaauagaaaaauaaaauacuguacaccaaaauaagcuagaaaaauggaacuaagaaauaauauuugaaauuaauauaaaaugaagcuacagaaggcauaaguaaguccaaauguuggcucuuugaaagacuauuaaauaauuacacagaaagucuaauaaagagaaaagagagaaaaaaacugguaagauucagaaggaaaagaaaaauacagccauaguauugggggaaaaaaacccuaagaaauuauaaaugcaacugcaugacaauucauuuaaaaaccuaaaagagaaaaacgauuucccaguaaaacagaauauaucaaaauugaccaaaaaauaaacucuuuagucaaaccaaauagaguaaaauaaagguaauuaagaaucuauagaaagaggcaucaaaaucagcugaguucucagcagacuuaaucuauuuaaaaaacauaauucuaauaauacuaaacuauagaaaaauacaggaaauguuccaauccauuuuaugcagccagaauuauucaacagcaaaccuaauaaagguaguauacagaacauaccauuucacuuaaaaauuaaauguaaaagaucuaaguaaaaacucacauuagacuauagaguguaggacauaugagaaauaauacaguagucccccacuuuaucugcuguuuuacuuuggcuuucugugguuucaguaaccugcaguaaccaugguccgagaauauuacguggaaaauuccagaaauaaacaauucauaaguuuuaaaaugugagccacucuuaguaacuuagaaaccucaugcuccuccuucagggcauccacacuguagacccuaccugacccuuacucacucacuagcugucuagcuuaucacacugacuguccugguaucuaacagugccccuguuuaaguaauacuuauucuacagaaugauggccccaaagcucaagaauaaugaugcuggcaauuucaauacaccaaacagaagccaaaagugcuuccguucagugaaaaggugaaagcucucaacuuaaguuaaaaaaaaaaaaucauaugcugagauuacuaagaucuauaagaagaaugaaucuucugugaaacugugaagaaggaaaaugaaaucugugcauaguauacacagagucugauacuaucugcaguuucaggcaucuacugggagucuuagaauguauucccgguggauaagggggguccauuguauaccacuauaauuuacgcagaaaugcaagagugguccaucuuuaggaaaucaacauaauccaauauaucaaccaauuuaaggcagagaaauuacaugauuauaucaauagauguugaaaaggcauucaguaaaacuuagccauuuuaaacaaaaaacuauggaaaagaagacuagagaaaaaaacacucugguaaaaacauaagaagggcaaauauuauucuaaacagcaaaacacuaaaagcauuucaaauaaaauuaagauugcaugcacacacaauaaauauauauagagagaguaucuauguguguaauuucacuuuuauaugcauaaaauaaucuguggaagagauccaauaacagugguuacuuugaaugcaggguuaggaacuacagagauuacggagaggaaugggaaggaagcuguucauaggaagcuuuuuuaaaaaauuauuuuaaccaugugaauguuauuaccuauacaauaaaucaaacgaauaaaauuaggaauuagagugagaagcccacuaaauccuuuauaaguaaacacugacuuaaaguuuacaggaaaaaugguaagacagaaaagaauuaacuggcaaaaauauuggaauaaaagagaaaaauaucuuuuugucaaugauuuggcaauacaaugucuagaaaacucaagcaauuauauuuuuaaaaaacugaaaauuagcugucugcaguggcucacguuuguaaucccagcggcucaggacacugaggcaagaagauugcuugaggccaggaguucaagacuauccugggcaauauagcaaaaccucgguaucuuucaaaacaaaauaaaaccaaacccugaaauaaaagaaauuauuaaauugagauaugauacaauacuuuuaaaauuaaguuucucuaauugagcaggaaacaucuagaaaaagaaugggaaagagauuuucauugacagggauagccuuucccaauauuuaugaauaacuauauugagaaagaagccaaaaagguuuuccuuucaauuuaaaaauaggaccuaggcugggcgugguggcaugaaccaccuguaauaccagcacuucgacaggcugaggcgggcgaaccacuugaggucaagagcucgagaccagccuggccaacauggugaaaccucgucuauacuaaaaauacaaaaauuagcugggcaugguggcacacaccuauaaucccagcuacucagaaggcugaggcaggcgaaucgccugaacccaggaggcuggggcuacagugagccgagaucguaccacugcacuccagccugggcggcagagcaagacgcuaucucaaaaaauaauaacaauaguaaaaauaaauaaauaaaaauaggaccuaauagagcagaaaggcuuuguuuuucaacuuuuauuuuagacucaagggguacaugugcagguuuguuacaaggguauauugcaugaugcugagauuugggguacaacugaacccaucacucagguagugggcauaguacccaacaguuauuuuuucaaccuuugccccgauuuccuccuuccccacuccuggagucuccagugucuacugcucucaucuuuaugugcacguguacccaaaguuuagcacccacuuauaagugagaacaugcaguauuuaauuuuguuucugcauuaauucacauaggauaauggaguccagcuguacccacauugcugcaaaggacaugauuuuguucuuuuuuuauggguagcauuccauggcauaaauguacauuuucuuuauccguuccacuguugauagggaccuacgcugauugcaugucuuugcuauuguguauagugcugcaaugaacacaugggugcaugugucuuuuugguagaacaauauauuuuccuuuggguuuauacccuccacgcccaggccauuguugguucuuugaggacucuccaaauugcuuucuacaguggccuugccaacgucuguuguuuuuugacuuuaauaauggccauucugacuggugugagaugguaucucacugugguuuugauuugcauuucacugaugauuaaugauaagcauuuuuucauguuugcuggcugcuuguaagucuucuuuugagaagugucugcucaugucuuuuguccacuuuuuaaugggguuagagcagacaguuuaagaacuacuaagaaaauugugcaaaagaagaaaaccaaaaguggacuucucugaccagauaaucagaaauacauucaaaagccacuguaaugaaaucaauauggcacuggcauagaaacgcacacacaaaugagcaggacagaauaaagaucuuaauuauagauuacagcacauauggcacaaugugcuaucaaagguuacauuuuaauucagcaggaaagaauacauauuuuuuaaaauuauaauaaaaaaacugguuaucaucuagcaaaaaaaacaauugcauuuuuaucuuacauuauauguaaaaaauaaguaucaggcagaauaaagacaaauguaaaaaauaaaucauaguaauacaucuacaacaaaauuuagaagaugacaggucuuguagauaugcuuaacaaagaccagaaacuucaaaagauaaacaaaacguuaaaaauuuccuauuaugaagaaaaaaaaaacuuaagcaguuaaacuggaaaaaacaugacauguagagaaagagcagauccaaguuaucaaguuuauucaaaaaauacucaaaugcacuagaagucaaggaaauaacaguuuaacaaugagauaucacuucaguaaaaauuuaacagacauaucuucaaucauacuaccauauuucauuggucuaaaugugauuaugacaucauuuggaaagaaauauagugauauauauuaaaauuuaaagagcuuacaccuuuaauuuagcaauccuacuccugagaaucaauucuacagaaauaaaaguaaccauacauaaggaaauauauacaagaacguccuacuuuccaauuuuuuuuuuuuuuuuuuuccuagacagagucucacucugucgcccaaguuggacugcaguggcacaaucccaacucacugcaaccucugccucccggauucaagcgauucuccugccucagccucccuaguagcuggaacuacaggugcccaccaccaugcccggcucauuuuuguauuuuuaguagagacaggguuucaccacauuggccaggcugggucucgaacuccugaccucaggugaucugcccgccucggccucucaaagugcugggauuacaggcgugagccaccgugcccagccccaauuucuuauuucuacaaagaguuguuucgaucaacacagaaauggcuaaauuacaauauacuuuaaucaauuaacacaaauccaaucauuaaaaagaauuagaguuuuaucaaguacuuugguagaauuuauuuaaugcaguguugaguaaaaaauaaaaugcuauuuuaagaaagcauaauaugaucaggauuuaaaaaagaaaacuacaaccaaaauaucccuuuauauguguguucugacaucaguuugcguaucuaaaggcagacauacauaugcacaucucuauguacaagagcauagaagaaaagaauaggugggcaacacguaaaggaacuggggugaagaaugggugugcguauaggauauggaucaggaaggauaugugaauggccucagaagccaaggaaugaaggaaguaaagaaaaaaaacaacuugagaagaaaaaaaagagacuauacuuuuuaaaaagcauauggccacauuuacauauauacauguaacaaauauauauauaugcauauuugauaaaauuauaagaauuccuaccaucagaaaugaacucugaauuaccaaaggacuagaacugucaaaauauuacaugaagucaaguagagcaaugaagacgccuaccaucagcaauguugaccucugaagaaaaacauaaucaagaaaaaucuauuaggaauaagaaccugucgauacuguauugccagaagguggcaagauggcucguucuacccuaguuuuucucuugaauauaaaaaguaauuacuguauaagguacagaaaaaaaguaaacuuucaaagacauaaaaugaaagguaagcuggucucccaccccaaaguccuucuucuuuuccacccacacaccauaguuucuugucauccauccuucuucauacaucuuuguacacguguaaguacaucauuaggguaaaacacuagcaguauaauuguugugacagaguauauacauuuuaaguuaugacagauuuugucaaauugccucccaaagaggcaccaguuuauacucccaucuucaaaaaaugcugcauugugaauccaauauguuaguggugauuuaaaauugaauuuacauuguacagcuuggcauagaucuguuucacucaauaaugguacacacagaaaggacagaauauuuaaaucagggaagaaagaaguauuaagaagaauguaaggcuucuggaagaaagcaaagaauuaagaaaggguggcacaggcagcaagcaagccaucauugggagagaugaugggggauacuacauagaccaacuaguaagacccuuaagcccagauuuggauaauaaaaaauaaucccccaaaauuuaaacaccauuacagagccccuucuaaagcugcuccuuuagucccuuacacagaacccaauuuuacccaucuaaaauaucuauaaaaauaaaaccaaaaaaguuuaaaauagagaaguaugcaaugcucagaaucccauaaauuagacauuauuggcacuuucaauuuacagaugagaauaugaaccuccuuccugacuagauauaaauguuuaaaaaauacauauauacauaaauauaaaaauaaacacagcucauagagguaaaaaauaucaugaaacuccagcaggauaaaaagaaaagugaacauccucuccccuaaacucucagugcuacugaccaaagauaaauaccaguuuccugugaauccuuacaaagauacaaaauaugcauaggccugcauacagcuaacauacaacucuuuuuuuaacuggugguucuuuaaaaucaguuauuauuaugaaaauuugcaaacauguaaaagagcagaaagaggagacaguuaaugaacgcuuauauaccuaucacccagcuugaacaguuagcaaaucauggccaaucuuauaucuccuccucucccugcuccaagagguauucucaagcaaauuccagguaucagguaucucaucauuuuaauacauaaaauucuuagcaaaugccaauaucugauuuccaaauccagacuagacauagaaacuuaaaaagugguugggagaguauaaaaaggcuuaaccacuggaaaaaaaaaaaugauagcuaccagaagagaagaaaauaaaguaaaugaaaaugacuauuuaauuacagcuacacauaacagugacucaucgagaaguuaaagucauguuuaggaucuuuguuuuaaacaggcaggaaacuauguuuuuuaaagcuaaaauggcuaaaagacaaguuuaccuuuuaggaaguuaaucagaagguguugcacucaugccaaacaguuuuucccucaaacaauaaccaauaaaugaggccuuacuacaguuagcugugacuugagagacagacacauggagggucuggggugaaggaugguuggugacacaaggaaaacacauaccauagaaacaggaauuaaaaaugaugauugaaauaugaaucucucaaauaaugccuccugauaguuuaaaaugguaaagaacaacuacuaucacuauuuaaugaacacuucuuugggucagacacucacugggaaauaaguacuuuauaguuaacagcucguuuaaucucagaaucccuucagguagguaauuaagacaagacacuacuugcccaaggucaaucagcuaacggacuucccuugucuuagcagaacuguaguucugcuauaguaggcuucaccuuucuccaaaauguaagauucaaauacucuuuguuaucauuucucugggcaaauguuuacuugugauaaacacugugcaagaagucaagcaucauuaugauuugugauuaaaguuacauauaucacauaucauggauauuuuuauuccaaaagaauuauuacauacaguacuugucaaaaacugauagaccuauagauacucguguagccuuuccuacacuuccagugaccagaaagcuuauuggagaguuuuacugauaaagaucuuccuuuuauaguuucuaaaauuguuuccuguaacuucaaccuauuugucuggcuggacugauaaagauuaaauuuuuuuuuuccacaagucagccuuuuuaaaaaucagcauaaucuuugcaaauagucuccauguuaaauauucuuaguccuggcugggcacggugccuaaugccuguaaucccagcacuuugggaggcccaggcggguggauggcuugaggucaggaguuugagaccagccuggcuaacauggugaaaccucgucuuuaacaaaaauacaaaaauuagccggaagcgguggugggggccuguaaucccagcuacucgggaggcugaggcaggaggaucgcuugaacccaggaggugguggcugcagugagucaagaucaugccacugcacuccagcgugggugacagugagacuccgccucaaaaauacaacuaaauaaauaaauauuccuaguccugauuccaguuggauaugguuuucucauuuucuuuucuuuuucuuuuuuuuuuuuuuuuuaagauagggucuuacucugucacccaggcaucagagcucacugcaaccucaaacuuccaggcucaaacaauccucccaccucaaccuucagaguagcugggacuacaggcacaugccauaaugcccagcugauuuuuaaaaaaauuuuuguagagacagggauccaacuauguugcccaggcuggucucaaacuccugaucgggcuuaaguguuccuccucccuuggccucuuaaagugcugggauuacaggugggagccaccgugcucagccugguuuucuuauuaucuugacugccuucuucagaugugcaugucagaguuucucuuaaaaaguggcuccccaaauucaacacaaaacuccugcagagagccuaaccagagcagaaugaaaggaaacuauuaauucucugggccuauauuuuaaaauuauauucaguacuuucucucuucaccacgucauuuuuuuguauauuaaauuugcagauaacaccugugucuuuugcacauucauucaagaagcacugauuaaacauguaugauacaaccacaccagcuucucuuuuuuccaggcuuccuuuuccuaaacucagcuuuuguuguuguuguuguuaaacaaaauagucuuauuuucacugucuuuuuccucuaagcaggcauugcuacuugacauauuauauauugauuuuauuugucuauuaucuauaucugcuccuaaaauauuauuugggccgggcgcaguggcucacgccuguaaucccagcacuuugggaggcugaggugggcggaucauaaggucaagagaucgagaucauccuggccaacaaggugaaacccugucucuacuaagaauguaaaaauuagcugggcguaguggcaugcgccuguaguuccagcuacuugggaggcugagguaggagaaucgcuugaacccaggagguggagggugcagugagcugagaacgugccacugcacuccagccuggugacagagugagacucugcucaaaaaacauaaauaaaauauuaucuggaacguaacaggcacuaaauauuugcugaacuaacucaugaacagauagaagagguuaaaacaucacauucuuuauggcuucuggacaagaggcuccaggcuacugucauaugaucuuagagcuuuaucaauaaauacagguaaucagaaaagccauaugacugccacauacccucuagaauuuacuauaauagccuaguacaggaauuauaggucuugauuacuuuaaaacacaugguggcuuuuacuguugaucucaauuauguucccuacuuuuuccuauucuaaaauaugucaucuaaaauacaaauauauauuucucuauuauuaauagugaguaacugguaaacucuguugaacuaugcuaggaaaugucagagaagacuuaucccuaggucggagcugagcuaccaucucuaccucuauacaguugugccucuaacguacugacuccaaccaugaucaccuucaagcauagucaguuuaaaugucacuuccccuguggcuucacuguuucagaguuguaacuguacaaucugugguuugacuucagaucuucagauucguuuaaauucaaaacauaucuaaggagccgccacuguuuacaauauacuacauuuagcauucccuucuauggaaaucucagagugcucuacucccauggggucauuacuguuaaguuacaugugaaccuauuccauucuuacugaauuacaguacaaauguauuacagcagguagaacuuucucuccaugucaguuuagugcaauuguucccaaacugugcuguacaucagaaucacauguaagucuuuuauaagcauagaauccccagacaacucuggacuuacugaaucuaaacuagagguggggguccaagaguauuuuuaaacggcuucuaagauaauuccacuuggaaacuauguacugguugacaguacaagaaaaauucucaugaugcaaugccauaucuccuggguaaaauagaaugucaaggcauaaagacauacauacuggcauuccgagcugaauacuugaugaaauacauuuaaugauuuaaucauaauugaagauaaacuugacagcacuuaggauaugccuacuucaaaggaauucauauaugauauuggugaaaguaacucauaagaauucccaaacuagucucuaaccucuguugcucucaucccacauaguaauuacuugccccagccaaucaggucccuuagcccuucugaaccagaauaccuuccuccccuuucuuuucuacuggccucaggacagcaaauaaacuuuacaaaacucugcuaguacagcaccacacauauauuucuguuauccuguauuacaauaauuuguauaccuaucugucuuucccuacuagaaugugagcauaagagcagggauuguuucuuaucaauugcugcagccucagcugcuaccaaugagcuggcaacaagcaguaaauaaaucuuugcuuagugaagaaaugaaagaaaaugcccauuuugaagucuuauuuaaguaagaucaucuuaaggguuccaguccuaaaaauuaguaccaaaagauucugugauacuaaauuuaaaaauaacauaauuggaacauuuuccaagauaauuaauaagaauuuauuaaguauccacugcaagccaaaaugcuaaaguuacaaagauaaauaggcuuuguucuugauaaucggguaaauaauauguguucucaggaugaaagaguuaccacccuacccugucacugauuuaugaucuacaucacagugccuugcaggccaaacucuguuaagccugcaggugccccaccccuccaccaagguagcuaaaaaauaccagacugagaauccagaucaacaucucuauguugcuuagcccaugacagcucuccagaguugacuccaacaggaaaacuuaaaaagcugaguugcagagucuccuaucaucaucauaaauaauuuuaaugucuguguaacuauuauucaaaaaaggaaacuaucuccuggacuaaaacaaacaaaaacuauuccuacuggcauacaucgggaauauuuucauguuaaaaaauuaaaguuuacucauagaacuaauacagaugcccugauuuauuacucaaacauucauguggcuuugaaaccucuacucucuuugcuuugcaggcagaguauaauaaacaauuacuagagcaaaaacuuguggucuugaguuucuggaagauuuaaugucuuccuccuuauuuugcauuucccuuaccccagaaguuucccaacccuuaauaaaggaaauauuauagaauuggagaaagagauuucauuaagcuagaauaagguaaauaauaaaaucuuauauuaagcuagaacugauauuaacaaucauguuuuccagucacaucaauuuauagaugaaaaaaaaucugaucauaggagccagaaacucugauucccagguuagugcuuacacuaauuugcacaauaaauaaaagcaaaaauuccagacauucagaaacucaagaucuacuaaaugcaugucauucaaagguuuuguuaagaguucagaauuguuauaaaugcgcaaacagaagcccuccauagcuggccauagacaaggauuuccuguagaaggggaagaaaauaaaauuuuaaaacauuauuuucacagaauaucaucuuuaaaaaaccuguaacaugagauaaaugguauccucucuacauaggcacuucuuuuaugccucaauccugcgagacccauguauacauucauuuaugcacucagcaaauauuuacuaagcaccuguugcauggguaacugggaaauacagcaaugaacaaaacaaaauuccugcucacauggagguuacauucuugugguaaaaaaauguauuuucaggucaugauaaguacaauggagaaacaaaaaguggggaaagaagauagagacaguggaugguaggauaaugaauuuaaauagaaugcucagagaaagucuuacugagaaaauaaaaucuuaauaaagauuuaaacaagguuagguuaggccugguacaguggcucaagccugcaaucccagcacuuugagaggccaaggaaggaagaucacuugagcccaggagauagaggcuguagugagcauaucugcaccacuauacuccagucugggcaaaggagcaagacccugucucaaauaaauaaauaaauaaaugaaauuaggcagcaagccauguagauauaagggacaaagcauucaagaucaagaucucacagccuaucaguuucaaagaaacugcacgaagacaauaugguuagagcuguaugaacaaaguaacgugagaacaugaaaucaggggcgggggcaggagggacagaucaaaggagaaucuacauuagaaaauuucuauuaaaaauaugaaauauuaucuuagcuaacguggauuaagucaacagccuuaguagggauaauccaauuuaacaagagauuuagcaugaauugcuaacgguagaauuucugauaauaucaacagguuacuugagacauuauuuuuagacagucccagcauccacuaaauuguacuucagaguauuaucaacuacucuucuaacuagcuuugaugcaucaucagucaauuuacuagguagcgagugcugaaaggaagaaaagaaggcagaggaugaaagaauucauaugcucucaauugcaagagaaguggaggaguguuuuacuuuccacaucucaggaggauaugcuaauauauaauucagaauaaccaggugggcagucagauagugguucacaacuaaaagcugaagucuaacaaauuccacagagccaacuuauccuuuacccaauacucaugauacuguaagcaacucaaggacaacaguuuauuucucugaauuccucagagucuacuauagagaguuauuuuagggccucacauuuuauauugccuugcuaacagacauaaaaauuaccucaauucaugaaaaaacgcucuccaucugaguuguggaacauacaucuuucuuacacacccgucuuuaaaaaccugggcuacagauaagcaucacauuuucucucuuucuuauguuccucaagauaauguauucuacuccaaaaugacaaggguuuaucucaauuuuaucuucuaaaguauccauauguuuuaaaucccuuauccugaauuauuuuccucagauaccuacugacaagcuccuggguucucaaacuauaaugauaauuauaaacuacaaugugccauacaaauauacaguguuaauauuuguuauuuauuguaugcaaccaaauauaacgaggucucacaaaguacccauuguacuauggauuuauauguaacuacagguggcaagaccucuucaaucuuuggaauaauuuccagacucaaauuggcuuuaaauucuuuuauguuauuuuuaaccagcauuuuuaaaugagcuaaauuuauaucgcaugcucuuuuuaucugagcuaagacacauaaaaauaaagauuugaaaauacauaucaaacacaauuguauauauuuuuuuuuuuuugagacggagucucacucugucccccaggcuggagugcaauggcaccaugucagcucacugcaacauccaccucccggguucaagugauucuccugucucaagcucccaaguagcugggauuacaggcauccaccaccaugccaggcuaauauuuuguauuuuuaguagagacgagguuucaccauguuggccaggcugguuucaaacuccugaccucaagugauccgcccaccuuggccucccaaagugcuaggauuucaggcaugagccacccaccacgccugggcaacacaauuguauuaagaauauccccuaugggccgggcacgguggcucacaccuguaaucccagcacuuugggaagccgaggcggguggaucaccugaggucaggagcucgagaccagccuggccaacuuggugaaaccccaucucuacuaaaaauacgaaaauuagcugggcauaguggugggcaccuguaaucccagcuacuugggaggcugaggcaggagaaucacuugaaccugggaggcggagguugcagugagccaagaucgugccauugcacuccagccugggugacagagcaagacuccgucucaauaaaggaaaaaaaaaaaaaaaaaagaauaugcccuauggauuugaugaugguuacacaacugugaauauaguaaaauucuuugaccuauauacuuuaaauggguaaauuguacgguaugugaauuguaucuuauuaaaguuacuucaaaaaguggaaaaaaaaaaaccuuuuccccaugaaaggcagagaauaauggacucuuaaaauucugccuuuauacuuuauguugugucauaucccaaaauacuguuauuagauaaauucaaaauauaaucgauaggucaucauuuuaaacugaaauucacagcuggaaaaauucauucuuuacaugauaaacuaaaacaaaauacaaaaauccuacacuaaguggugccaacugcccuccuuagcagguucuuuuauuuauaaccuucucuccaauccuacuguuaucuuacuugagaccuucucuuucuguuauacuaaugcaaugguuuucaaccacucucccuaccuucaguccuauucuuguuauacauaguuaacaaaguaaucguccuaaaaugaaaaacuuggaguuggauaaaguaagagaucacaaagaauaagauuuuaagcaagacugcuguguauuugaccucagguucuaccacuuguuagcaguuugaucuugcacaaauuucuuaaucuuguuaagcccucauuuccucuucuguaaauuguggacaaugauaucuuccucaagggaucaguaugagaacuaaagauacaguagaagaagcuccuaaaguaggcaccuagaaauguuagcacuuuugccucuuugaaaguuugaagcauuaaccuuucuaaaagcuaucauaucuuuagggaaaccucuuaaggacgguaaagucacacaaaauaguauuuguaacaaaaauaacaacauuggaauggcuuauugagaacacuugcuuuugagugggggaguuugcagaaucaaacuaugaugagaaaguuguuuccuaaaugcgcagaaauccagagcuaggcagguaucucucagccaagaacugcuuggaugaggcuugcuuucccccagcaacugcagggacucauugucccaaguuucuuuccaaaauucaguuuuuuacagugccucuaacaaaccuuuuaauuauucuaauuaugaauaaauuaccauuugagaaaaagaaucaaagcaguaguuucuaaccaucuugaaggaauuaccuuuuucuuccuaauagcuguguaaucacuuuugauggauuggaaacagguccaacaagaggaagaggaaaaaugauuagugacaacuguacaccucucuccagugggaauuucuaaaaaauaaaauaaggauguaguacuggagacccaccagguuaagauguuugauccaaugggaauaguaauccaacguuuggagacuuuagcucaaguuauuaauuccucuuccaguaccucacagaacaaaccacauucaaaggaugccaugaaugacuucagacagaaaaacuuuucuugguaagcuuuauuuuauuaauaauacuuaaccaguaucaaugaucaugcucuccugcuccuucaaauaaugaccagacucuagaaagaaucuugguagagaucaugaagagaacauaacaaaugucuguauuuucuguuccuaguuacuaaaauucuaacagucuacacuuaauaauaaaaaugcuuguuggauucauaggauauggugauuaaaugaacacaaaugcaguauucgaaucucaugauucuguacguugugacuaaaaaacaucaaggguaaaggaaacugcaaauaaagauuucagaagacagacaaugaugauaugcagaacugaauauuguaaaaaucaguggaccaucuaggggcaguaucuagccuguagcagaugaugagagacuagaauauguagaaagucagcgcuagagaaacaagccaagaaggugucucuguauguacaacaguagagggcagaaacuccuggcuuauggggcuggaucaauccuguggacguauuuugaccuacacaguauuuaaaaguugggaggcugcauauaaauauugaggcuucuguuuuuacagaagaagugcagcaucugucaccacugacuuuguaaucccuuauguaaucccuugauacaggacaugcaccuuucaguucaccacagggcagagugacagugguaaccccaccaucucuagacaccaaguaucaacucucauuuaucauugaagguuauacugugaaagagacauaauucuuuauacuuaugucucuaugaaaaguguuaacaggguucagagcaugccaccccaaaauacgucacuuuggcauauugauuaucuugaguuaagggcacuagaaaaacagcagauacaagaaggcacucugaccuuccuuuccuuccugaaagcagaagauaacauuuccaugugaaaggugcccucccuguaccaggaggaaggaagacauucuuaucaccagagccugagagcugaggacgagaaaucuguacaaacaaaccuuguuaaacuaacccuuaucugccuagucaguuuuccacgacaaacugcucuagcccaaaucccuuugccuugucauguuuucacaauuuacuacucuuuguccacucaguauauaagcuuuugguccucacugcuuccuugggucuucauuuucuugugagggcucccauguacauguaaauuauugaauacaauuuguaugcuuuuucucuuguuaauuuaucuuacaucaguuuaauucuuggguccagccagagacccuaaacggacacagaagaaauuuuaccuccccuacagcgugaaacacaacaaccuauuuuuuucuccuuauaccuggucuacuuauucauauugccugggcacugccugaucaaucaucaaauaaaaucagauggugaagaagcgguucacaaaaagcaggagucuagaguagaagcuaggaaucagagacaaaacaaaagccaaaaagccaaacaaagccccucagaguuuaguaacugaaaagguagcaggauccaaauuacaaugcaaacaacuuuuaaccuagcaauuccaguaguagagauuuaugcuacagauacacucauaagcaaaauaauuuauguucaguauuauucuuugcaguauuauuuguaauaccaaaagaucagaaacacccuaaaugccaccauuaggagacuacauaaauaaguuauaguauagccauacaaugcaacuauuaaaaaaaauaagaaaauucguuaugugcuaauaugaaacagacuccgagagaaaagaacaaggagcugaauauacacaugucaguuaugaaggagcagcaggaggaggaaaguagggaacaauauaaauaacuauauauagauuuguuuuuacacaugcaugaaauauuucuggaaggauacaaaagaaacugguaguauuaauucccucaaggaggagaacuuaauaacugagggaugggggcaguaaggagacuguccccuggauacauuuuuguacuuuuugaauucuguagcagguuaaaauuauguuuuaaaaauguaacaaguuggcugagcugauuccaaauaugacuaagaaauuaaguaacuacuagaacugguguggcaaugacccccucccuccacauauaugcuauuuugccuuguucaaggaugcuggagauuucagcaagaaccuagagcgggugaaggggugagcagaaggagacugcgcugaacuacggacaauggaauaaauggcauggugucuuuuuccaucuggcuccuugaacuggucuaauucagccuggcaccuccggggcacccugaagacuggcagcucugaagcacuaaagacagcauuucucacacugcuacuaucccucacagaggacccaguagcaguggcauugauagguaccacacugggguggccugagggcggauggacuucccaaggaggcuguaaggaaagaguauucguuucuguucuugaacacaugucacauuccauucaagggcuccuagaaauacugaagaggacucugaaagggcugggggguuuguguaagcaagaggaaacuaaaaguuauucuccaucucugucuauagguaaugaagccuagaagcaaucaaucgacaaaaauauaacaguaguauguagagaaguaaaagaacagaaaacaauacucuggcaagagcgccaaaggaaauucuuacugaauuuuuuuuuaaacuuaggcuacugcucacugaacaggaaguagaacagaaaaaacaugaggauggcuggaaagagguuacucaaggcucugcugggaaccaacacacuuaguuaugcaguaccuacuuucuaaagugaaaucuuucaacugcuuuaaaauguuucuuuucuaagccauugaaagcaaugagaucauguucuugauuaagugccagguuuuuuuccucugcaacccagauuguugaaguuaaaaagaagaaaaauuagaaaaauaaaaaaguaaagguaagauuuggaaacagaaaauaaggggaaaacauaaauauauuuuaauaaccuagugguagaaaauuauguaaugacccaauauagaguuauuuuguuuuuuaaauugaggacaucuugcccuguucccaaaauacaauaaaguauuuauuucaauucaauuuaucuaacugauguuuuccuauuccauuuuaaccagaguuaacauauacaaucucuuuaugccccacagcacaaaauauuuauaaauacacagaugagccauuuguaaaagauaguuugugcugaaaccauagagcuuucugaaccauagaaaagaaaaaaauaugaggacuaggcuuagguaauuuuucuuuacaugcuuuucacaaggggaaauaauauucacuacucuaaacaaugaauaguaagauaauuucuaagauaagcaaaaaguaaaauauaaaagaauuagaaacuaaacuccaucuugaaauacaacuccuauagguuauagaauaaauaacaauaacaugauccauguauuaguauuauacuuuguauccacuacagugccuuccacuuaaaucaggagcuauuuaacguaauuuuauaugugaauagaaccuuuauacuuuucaaaguaccuucacuuuucucauuugaugcucacaaugaccuguuaaguagguagggcagguuucauucaguuuuacaauacuaaaagagacagagaaaaguuaagagauaaauuacguaucaguuggaagccagagacagaaugcaaggguccagaacuccugguccauugcuuguccaaaagaugucugcaaaccauuauuccuccacccacucaauauuuauuaugcaacaacuguguuccaggaacuauuuuagucauuaggaauauaacagagaaaaagaacauacauauuucuacccuuaggaagcuuacaguguagugagagucauuacauaaauaacaauacaaauaaaugcaaaguugcacuugggauaaacauucuaaugggguauugagugcuaugagagcauauaaugugggagaguugacuuugucagagagguugggaaaggauucaccuuaggaacuaaugauaaagcucauuaacuagucuuuuaaaaaaaaucuaaaacaggccaggugcggugggcucaugccuguaaucccagcacuuugggaggcugaggcaggcggaucaccugagguugagaguucaagaccagccugaccaacauggggaaaccccguuucuacuaaaaauacaaaauuaaccaggugugguggcacaugaauguaaucuuagcuaucaggaggcugaggcaggagaauugcuugaacccaggagauggaggaugcggugagccgagauagcaccauugcacucuguuuccaaacaaaaaaaauacaaaaaaaaucuaaaacaauuuuuuuuuaaaagauaaagcucagaucugaagggcagacauuauauagacaaagaagcaaagggaacaucaugcguaaaagaccuacuaugggaagggccaaaauacaagagauuuuuuaaaaagcagccuguuugacacugccugauccccaacuuacugcaaucagagugugagguuagggcugguguuuuuuaacaaguuccucggccgggcacgguggcugacgcauguaaccccagcacuucaggaggccgaggcggguggaucaccagaggccaggaguucgagaccagccuggccaacauagugaaaccucgucucuacuaaaaacacaaaaauuagucaggcgugguggugggugccuguagucccagcuaaucgggaggcugaggcaggagaauuacuugaacccagggggggcggagauugcagugagccgagauggcaccacugcacuccagucugggcgacaagagcaagacuccaucucaaaaaacaaaaacaaaaacuaaacuaaacaaaaaacaaagcaagguuucagugacuccugcccuauuccaaugacuauuucagagcaucaaagauguuucacucaggacuagagggugacugaaaacaaugcaaaaauagaagaacugcuacauccauucaaaagcugcugaauuaucugcauucuagagggugauaucauguuuuguucuuuccuuuuuucuuuuuuuuuuuuuuagacggaguuuugcucuuguugcccaggcuggagugcaauggugcaaucucggcucaccgcaaccucugccucccagguucaagcaauucuccugccucagccucccgaguagcugggauuacaggcacaugccaccaugcccagcuaauuuuuuguauuuaguagagaugggauuucaccauauuggucaggcuaguguggaacucuugaccucaggugauccgcccaccucagccucccaaagggcugggauuacaggcgugagccaccacaccuggcuucuuuuguuuuuuuaaagagacaaagucuugcuuucuugcccagguuggucugaaacucccagccucaaacaauccucccaccuuggccucccaaaaugcugggauugcaggccugagcccccaucauuuuuaauuuagaaaggaagaauuuaugaagguggugccaucugcccuaggcuuuuuggggugaauugaauuuccacagauagaaaaagacuacuccagauaaagaaaugaagugaaugaaaagauaccccuggccaggugagguggcucaugccuguaauuccaacacucugggaggccaaggcagaaaggaucacuugaggccaggaguucaagaccagcuggagcaacauagcgagacccugucucuaccaaaaaaaaaaaaaaauugccaggagugguggugugcgccuguaauccuagcuacucuuaaggcugaagcuggaggaugaccugagcccaggaguuugggacugcagugaacuaugauucuaugaucgugccacuguauuccagucuaagcuaaugagcaagacccugucucuuaaaaaacuaaaaauaacaaaaaaaagauaccccuugcugcuucauaugagugugaauauuuuauuuuacugcagcccuuccuaaguggcacuuauuucuagaaauauccuucccauaauaccugaaaauugcagaggucuugcagcuuacaaaucuuuaauuuuauacucacaacaaauucuauuacauugcaagagcagauauuaauuuucucgauuuugcagauaaaacuagcugagguagguuuacuugugcaaagucacauuucaacacugcucuuuguuuuuaacauauagauuccugaccaacaugauguggaaaaguuaucaaagucuguuaucugaaacauggagaacugaggaggccugcaauaccagacauauaagaacucuaguaugacaaauugaaacaaaagccuguuauccuggcuuaaauuaauaaaggucaugagcaagaggucuccugaggcaaucaaaaagagaaaaugacagauggagauucaaugagggaucugugaugacaccuaauaacugaaguauaaaaaaaauuauggauaagggagaaaaaacuaaguaucauaauauacagagggacaaaaaugaauagauggcagacacaugcuucaccuucaaaacuuucuaauuuuuaaaguuauuuuucaguuuucucccauaaauuaccuucaagaaaacucugaugaucgaucacauuuucuaggucuaugcuguucuuggccauguuuauucuucucuuccuuuucuaacacagggggacucuaaaugauaaaauaauagucuugccuuugagauuaaaccuccacuuugugcaaaauauuacggaagauacaaagaugagaucucuagucucaagguuaguauucuggcaacaccaguagguacuaagaauacuucccaagauuguauugaagaaaauguguuggguugcacucuauuuucauaaacaaaaaggacuuuuuuuaauggaagaacaaaaauuucagagccaugaugaaagaauuccaugucauacagaaacugauccaaggaauuggaggucuuuggguuaugaaucuaucuggccuauagcaaguacucuuaugagauaauaauguuguacacauaagaauaauuuuccuuuaggguggcauaaaguaacagagauuaggaauaaacauuaacugauaaugagaaaaacagaauuucaaugacuauggauaacaaacaacuuauuacuacaacccaaaagauuuaggacaucuguacagaaaugcugacacccacuucaaaaccacuagaaccaguuuauaagucucuuuuuccaucccagcuaugccaaccucacuagcaaucucacaucuuccuuccggucuggcugacuggaaaggugguacacugacaacugaaaaauauacauacagaaagaugaugacagcugauuuuuuucuuucacucuuuucaauacuaccaucuuauauccuguaccaccuaaaaugaagaacaauauuguacuuuaauuguauuaauugaacaaaauucuauauuccuguuuuuauauuaaaaguagaaugaacauuuuuuuuuuaaucuuucuugcccccaaaacccucagcacaacucuuugaaaguggccuugggggcuguuuuuuuuuuuuuuuuaacccucugguucaguggcccuugauggaaaaaauauucuuaaccuguguaauauaauaaguuuaaauuuauaauggaugaaucucuauaaccuaacucucagauauuaaaaagauucauuuucccugugccaaagacaaguggauuugugaagccauagaguucaucucauuugacaugaaaucauucucauguuagcucaaagugucuaauauguucuugggaaccacuuaacuaucuuuuauuucucacaguggauaauuacauguuuuagaguacagcugaaucucaccacaauuaaaaaaguacacggaggaaauuucuaggcaaaaaguacucuaaugaccaguuuuauuauuauuauaguuuaaauguauaauacauaguauauauuuauaauguuauauuacuucauaaaugauauuauuauuaguucuauauuuuaauugcucauaaaaguaauacuggugaaagggacuggucuggcauaaaacuacagaguguaacagugugagcaguucuucugagaaaaaaaaugugauuacacccauguuugauuccuacagucaagaaucagaggguuaaaauaaacuggaguuuauacaucuacugaaacauuaaaaaauuuuacgcuucccuuaggagauaauuacaguuaguauugugaaaaagagacaucuuuucauacuuagcauuuuucaaggggaggaacuauuaaggaccaacuauguauaauaacaauggugaugaugauacauuaaauaagaauagcaagagcacuuuauauauauauucuuuucuauuuuuuuauuugacccucaauguaauucuagagaguaggcaucaguauuaccauuuuacaaaaaaagaaagccaacacucagagaaaauaacaaaacacuaauuuacuaaauaguaucucugacaagugucagagucaagauuacacauuagagguuccuaagcucaguacacucuuuucuauacuauacuggaguaaugcauugcaaaauaaagccgcgaauuauacccaucuuauggugcauguccuuuuauaaugcaaccuuacuacucuuccaucaugucuuuagaaguuuauaauuugauaaaauggaauuuaucaauauucucuuauuguucauguuuuuugguuucucucuaagaaacuuggccuuagcaaaguuacauuuucuucuguauuucuucuagaagcuuuauccuuccaccucuuagguuuaggacuauaaucuacucaacuuaauuucuguauauaguaugaaauaagagucaagaaaugcucccccuuacccucaaauggauauccgguucuuccaccaacauuugcucaaugaauuaccuuagcauauucgccaaaaauuaaugagccauaaacaaaagucuuuccagucucuauucuguucaacugaucuauccuaugcuaacaucacacagucuuaaguuguguaauuccucuacuuuuuuuuaaauuggcuuauuauagguauucugaauuuccauauaaaugacagacuaagcuuaucaaguucuauaaaagccucccagggauuugauugagaucggguucaaccuaucaacaauuuggaaagaacugaaaauuacaaauuauugagucuucugauccaucaacauaguauauaucuuaauuuauucagguuuucuuuaauuuaugucagcaguguuguauguuuuucaguaccaggucuuguauacauuuacuauuuauucuuaaguauuucauuuuuugaugccacuauaaguggcaauguuauugugcuuucccuuuccaguuguucauuucuaauauaacgguguacagaacuaaaaaugauuuaugauuuuuuuuuuuuuuuuugagacggagucucgcucugucgcccaggcuggaguccaguggcgcgaucucggcucacugcaagcuccgccucccggguucacgccauucuccugccucaaccuuccgaguagcugggacuacaggcgccugccaccgcgcccagcuaauuuuucuuguauuuuuaguagagaugggguuucaccguguuagccaggauggucucgaucuccugaucucgugauccgcccgccucagccucccaaagugcuggaauuacaggcgugagccaccgcgcccggccaauuucuguauauuauuucauguauccugugacuuuacuaaacuaacuuaauaauucuaagaguuuuuacaaacauaucccuuaggauuuguuuuacaagcacaauuagguugucugugaauagagacagcuuugguucuuuuuucuguaguccauaugccuuuuauuuuccuauuuuacuggugaggagcuauaguauauuaugaauagcaguaguaccugcagaaauucuugcccugcugccagucccaagagaaaagcauucauucagucuuugaccaucaaguacaaucuaaguuuuggguauuuaguagaaacccucuaucaguuuaagaaaguucuuuucuaugccuaguuuguuaaguuuugguuugcuuuuacauuacgaaugaugucuuucugcaucuauugaacugauuaguuuuucuacuugagucuguuaauauggugaaucauauugauuuuagauuguuaaaccauuguuacauuuuuugauauacaaaccuuuuagucaucagguauuaaccuuuuauuuuuauacugcuggauucaauuuguuauuuuaucauuuucuaauauuuuauuaaggauuucugcauauguuucuaagggacacuggccuacagauuuccuguaaugucucugucuuagcauucuaguaaugcuggccucaugaguugagaaguguuaccuuucucuucuguuuucugaaagaguuuauaugaaauuggcauucauuauuucuuccuuaaauauuuggaagaacauuaauuaauucaccauuaagccaugcaguuuucuuugcacgaaagguuuuuagcuauaaauccaauuucuuuaaaaaacauauuaaaguccacuauagacuuuaauagggguuuucagauuauuucuucuugagugagcuuugauaauuuguguccaucaagaaaucugaccauuuaucaaaguugucaaauuuacaggaauaaagucguucauaauauucucuuauuauucuuccaacguuuguagauucugcaguaauaucaccucuuucauuccagauauugguaauuugugccucuucuuuuuuuguagaucagucuaccuagagguauaucaauuuuauugaucuugauuucaaagcacccagcuuugggagguucacugauuuucuugcuuuucuauuuuauugauuaauguucuuguauuuaacucccucuguuuacuuuggguuuaauuugcucauuuuuaucuaguuucuuaagcuggaagcucagaucgcuuauuuggcagucuauuuaguugacaggucucugaaucaagaguugccauacugggggaacugaacuugagaagccuuauucacauagggaccugauguagaucaagagaucauggacuuggagagugugguugcaaacagguaugguuuuuugguauuuagggagaggaugagugucugcaugugggagaaauaugaauugcaguggcuagaggguagaccaugauagauuauuuacauagauuaucauaacugcuccuucacaaugugacuuuccccuucuuuccaucaaaaaaaaagaguacaggaucugacuggacuuggacccgcuuuuauaaacagaaugugacaaaaaugagguuauaugacuuuugacuauaaaucuugagccucugcuagcuucugcuuuucacuuucuuggagagcuacacagagaucaccauguaaagaaaaugaucuaguuuauuggaaacugccuugguucucugauuuaauaccagaucuccaucaucagggaguaugaaggcacuccaagcaacaguuagacauguaguuaaggccauuuugcaccuucuagccuagccacaccucugccuaaaugcagcuccugaggaagcacagacaaaaucaacagaauaacaacccaaccaaacuucaaaaucauaagaaauaguaaauucuuguuguuuuaagucauguaguuuugaagugguuagucagucuacaaauaaacuacugagugcugauaaaaaaauagaugaaaagguuuuguucuugaagguuugauaauaaggggaaaacauauggaagauuaaagucgacugaaauacugcuaacccuacuuuuuuaaaaccacgaaaguaaaaagaaaaaaaagaugaguaugaggcagaaaaacuuaaauaagggcuuccuauaauuuauacacuagcuuuacacugucuaucagugucuacuaaucccucucuuuagaaagcagaauuuacaagccauucucaaugguagucagaaucacccuucaaccauaacucaaauaaugucauacucccacuuaaaaucuugcaauuggcuuccuacuguacauaggauaaaauuuaaauuccaucucaugaucuauacugccuuauaagauuuggcaucugcccuucacucaccauucccuaggcacaguugccgucuuucugauccuugaauaccccaagcccauuccuccuuuuagauauuucaacuguucauucugccuaaaauauucuuuucacguuugauuccuucuuauuacucagguacuaguuuaaaugucacaucaaagagaccuuucuugagccccuaaguuuaaaauacuaucauaacccugacuuauaugcuucuagcacuuacuacuaucuaaaauuauuuauuauauauguccucccaaccuuaucaaaguagagauuguuucaggcucauucaccauucuaucccaggaucuuacacagugccuggcacauaaaaggugcuuguuuuccuaguaauuacauuauguaaagauaagguauuggcugggugcaguagcucacgccuguaaucccagcacuuugggaggccauggcaggaggaucacuugaguccaggaguuccagacuggcuugggcaacauagggaggucccaucucuacaaaaaugaaaaaauaagcugggcacagugguacacuccuguggucccagcuacuugggaggcugaggugggaggaucacuugggccugggagguagaggcugcagugagaugugauuguaacacugcacgccagccugaguggcacagcaagauccugucucagaaaacaacaaccaccaccaagauaagguauuaguuuuggacuuucacucuaucccacugagaagggggauaagaaagaucaagcucccuauuaauggaaaacuaaguauuuugaaagguacaaguauuagauuaucuaauaaguugucacacuuaacuaaauauggucuucucuaguacaacccccgcacuucaugcuacagaccaggacuacgcaugagcacaggaagcaaaacuaguguuuccacggacaaaguuuagacuauaacugucuucacagaagaacugaaaacacaaucuaaacugucacuauauaacuuucuacacuuguuauuuuucaaucacgaaauauauauuagguguugaaaaauaaucuagcuagauuuuuaaaucugcucaccugaaaugagauguaaaaauuacuauuaaguuuaaugcaaaaaaaucacuuuuuuaguuaacauuucauaccaaaagucaacaugauaacaacaacaaaaaagagaguugaggagaaagggcagacaaaucauucccaaaaugauuucugaugacucucucaguaccaugucauauaaucauagaucauuuaccaaucauuuauauucagaauacacagcuaggugcuaggugacauguucccuaccaucaaaaguuucacaaucuaaaugucgagauaagacaaauauaguuaacacaaaucaaacaauaauuuaaggaugcacaggcuaaauaacacaugguauaaaaaauauauguuacaacugauucaaagaagugaaugaucacugagacucugauuucaaaaaguaagauuucaaaaaggauauaggaggaaagaagggagggagagaauuccagggaaguggaauugcuauaacaaagaugcugagaaagaaaaaaacacaaaguaugcuuaaggauacugauuagacugguuugauuuaaaccuggggcugguaaagguaacagugagggaaaaagacaaagccuaacaaccacagugauauuugcauaauacuucacuuauguuauuugacuaccaaaacagcagcacaagaaaggguagauuguagagggccuugaauaccagguuauaaauaucuagcagcaguaucuacacgucuaagauggaauacuccaucauuagaagauaaagaaacuagaggcagggagacuaguuaugacaguucagcaauaagcuaaaaaggacccagguuaaagugacagcagugggaacagaaaggaagaaauuuauaaggcuauagugauaacuggggaaggagauaaaaaggcuaccaggucuuagaccucaguuacuaggagaaggauggcagaauugagagaaauauuuaaguccagauggggaggagcuguuuuuaguaguaaagagucugguucagacauaugaguuugaagcaacagcagcacauccaguuucuagaaccucugucacucauuccaaagacagucuucuaugcccaccaucacccuaaccaagagaaauauguuucccugacauuaggcccagugcccuucuuucucaaaaagacugcugauguaggaggcaggaaugaggagugacuuaugauuacagagucuccauuggcggggcggggggcgggcggggggcgggguguuagaaacguucugaaauuagaggcaauggcuauucaacauugugaacacacuaaaugcuacugaauuguacacagagguacaguaaaaaggaucaagaguguggguggcaggggauagcagugcuucacuuuaaaauagucaagagugggccucacaaauuuauuucuccaacucggaaauuuccugugagcuccagacaugcauauucaacagcucaucaaauucaagcagguccaaagggaaugcauaaaugccuuugccaucucucuaucccaaacaaauacaauaaacaauaacaaccauccuaguucaauaaagagaaauaaccuccaagaacacuguaaaagccagaccuugaagcuauuuuaguaucuuacacgcucucauucuuccccauauccaauucaaaguccugucaauuuaacauccuaaauauuucuggcauuugucaucugucucuaucaauagccaucaccacugccaccacuacuacccaaaugcaggcuaccaucaccuuuauuugaucagucuuuauucaacuugccuucucacuucccuucucacaaucauucuuuacagagccaacaagaaugagauuuuccaaacauacccuucaacuugcuuaaaacacuucauaugcuuucacugcucuuacgaugaagauuaauuuccuuaaaacuugauacaaaaagccauggguaaucugaccccaucccacccuuucauacucauuuuguaccacgccucucagauuuauuuccccaaaacuuuauuggggcauaagagacaaauagaaauuauauguauuuaaggcaugcaaugugauguuuugauauauguauacauugugaaaugauuaccacaaucaagcuaauuaacauauccaucaccaaacaucauguaguuaccauuauguacauuaagucuccagaacguauucaucuuauaaccaacaguuugcacccuuugaccaacacauccccauuucucccccugcaaccuaccuuugguaauuacccuucuauucuauuucuaugaguucaacuuucccuucuauucuauuucuaugaguucaacuucuaaagauucuacauacaagugagaucauguggaauuugucuuucugugccugguuuauuccacuuagcauaauguccuccagguccauccauguugccacaaauagaaaguuauccuuauuuucucuuugaugcaacaauauccuuguuuucuaaugaauaauuuugcauugugcauaugugugucauacacacucuacauuuucuuuauuuaucuggggacagaacuuagguuguuuccauaucuuggcuauugugaauaauucugaaaugaaccugagagugcauggauagugacuuuauuuccucuggauauauaaccacaagugggauugcuggcucuuauauagucauucuguuuguaauuuuuugaggaauuuccauauugcucuccauaacaauuguauauauauguaacaauuugcauucccaauagaccucucagauuucuugagucuaaucauaccagcugauccuuauacuugucaaauuccaacuaacuacugggcuucugcuuugauugguuuucucuucucucuuagacugguuaacuucuauucauccuucagauauuagcucaagagguauuuucuugggaaguuuucauugacuucccauacuagggcaaacugguaugcauaacacccugcaucuuuacuuuagaacaguuguuuaugguaguaguaguaguucuuuuuuuuuuuugagacggagucuugaucugucaccaggcuggaguucaguggugugaucucggcucacugcaaccuccaccucccgaguucaagugauucuccugccucagccucccaaguagcugggacuacaggugcacgccaccacgcccagcuaauuuuuguauuuuuagaagagacagaguuucaccauguuagccaggauggucucgaucucuugaccuugugauccgucugccucagccucucaaagugcugggauuacaggcgugagccaccacgccuggcuuuuuuuuuuuuuuuuuuuuuuuugagacugaguuucgcuuuuguugcccaugcaacaaaacucccaaccucagaugaucugcccaccuuggccucccaaaaugaguaguaguuuuuuauaaaaguuguuccaguggguacauaugguuuguuuguaccuaccaagucucauguugaaaucugauccucacuguuggugauggggccuaguggaaggugucuggguugugggggcagauuccucaugaauggcuugguguuauucucaagggagugagugaguucucacucagcaccucccucucuuccuucucuuuuuccuccuccuccuacuaccuugccaugugaucucugcacucaggcuagcuuuugccuuccaccaugaguggaaguagccugauacccucaccagaugcagacgcuggugucacgcuucuuguauagccugcagaaccaugaaccaaauaaaccucucuucuuuguaaauuacccagcuucagauaucccuuuauaguaacacaaauggacuaaaagugauaaguuuacuauuuuaaaauauauauuuuucuuuuuaauuuuuguggauacacaguagguauauacauuuaucgguuacaagagauauuuugauacaggcaugcaaugcauaauaaucacaucagcauaaaugggguauccauccccucaagcauuuuauccuuuguauuucaagcaaucugauuauacucuuauuuuaaaauguacaaauaaguuauuuuucacuauagccauccuguugugcuagcaaauacuaggucuuauucauucuuucuaacuauuuuuuuaguacccauuaaccaucccuacuucuucccuaacccccuacuauucuuuccagccucugguaaucauccaacaauuuuauauuuuuugaauggaucaugugauuaaaaacucccuaccucacaaaaauugcuauggaaaaacuuaaaacagacuauugaguucauaguacuaaaaccuucuuuuacaggccaagugugguggcucacaccuguaaucccagcacuuuaagaggccaaggugggagaauccauugaggccagaagagugaccccaucucuacaaaaaguuuuuuuaaauuagcuaggcauggugguauacacuuguaguccuagcuacuuaggaagcugaggcaggagggucacuugagcccaggaguuugagguuaacaaugacugcgccacugcucuccagcuagggcaauacugcacccuugccugggggacagaguaagaccccaucucaaaaaagaaaaaaauuuaaaaagcucuacuuuauaaaguuuacuccagucaauuacagauuaaaguuaacuaugccucuuaggcuagauguggaauaagucaugagguuguuagaagcauucaguuuuuucuggcagaaguauucucucaaacucaaagguaaaauuugaacauuacaaagauauuuaauacaucuagucuaucuacuucuaaaugaauauuuguauuuuauguaucuaaaauauauguguguguguguguguguauauauauauauauauauauaucugccaugaauaaauacauauauguuuaucucuaauaaagucacacugcagccucaaacucccgggcucagguaagccucagucuccugaguagcugggacuacaggcauacgccaccaugcccggcuaguuuuugcauuuuuuuugguauagacgggguuuugccauguugcccagucuggucucaaucuccugggcucaagccaucugccugccuugcacucccaaagugacaggauuacaugcauaagccaccgcaccuggcccagguucauuuuacuguaagaaaucauuauaaaaaaaaccugaagcugaugaaguguuuaugcuuugaguaaauaaacaucauuuaaccaucaagacaccagguuuuaacuguuucuaaucuuucauuuaucacaagugucuaaaaguaguagauucaaggucaccaaaaauaacaauugagagaaaagucauuagcuacuuuuauauuauuuuuaauacauuauuuuuaaaauauaaaaaagccuuuaugaggaucaaauaaaaagauuucuugaaauaaaagucucucauuaaaaagacacaaaagaagcaacauaaugaggaagaaauggaauagauggauacuuguaaaauaaugagagagauuuuuuuuuucacugccagggucaaaaccucaaggcugagucuguauuucugacagggucaaggugguuuaccugcagugcuuuacuaaaaacaacacaucuuauuuucaacuauagaacucuaugugcuuucaaaacauuuuccccauuaccaccacauaacugagagcaaacaauaaugaauauaguguuugccaauaaacaaaagaaaggauuaaacaauaacuacauggcugccauuuaaaaagaacaaaacuagaacuaaagaacacccugaagaaaaaaaacaaaacaguuuucucugcaaccaggcugaucagaugcaaaccuuggguuauucucccuuuaaaguauucuuauucaggagcuaaguucuuagucacugguacaaaacaccccaugcacucugaaccacagacaauacaccaacaaaauguguacgccuguguucuacuaaaaccugauuuguggacaaugagauuugaacgauauaacuuucacaugucacauaauauuauucuuuuaauuuuuuaauuaaaaauuuaacaucauucuuagguuaugacugaacaaaaacagauggugaauccaauuuggcuuuaggccauaguuuaucaacuccuaguaaaaaaaaaaaaaucacuaauaggaaagauaacagguucugcucuuauauguaauucauaacuucacugaacuucacuuucuucaacuauuagaaaaaaaaaaaaaaaaaagaggcugggcgcgguggcucaugccuguaaucccagcacuuugggaggccgaggcggguggaucaccugaggcugagaguuugagaccagccugaccaacauggagaaacccuguuucuacuaaaaauacaaaauuagccgggcacggugacacauaccuguaaucccagcuacucaggaagcugaggcaggagaaucacuugaacccaggaggcggagguuguggugagcugagauuacaccauugcacuccagcauggacaagagcgaaacucugucucaaaaagaaaagaauaccauauacaagaaucaccucaaaacggaucaaauaccuaaacauaagaauucaaauuauaaaacucuuagaagaaaacaggggaaaaucuuuaugacaucagauuuagcaaggauuucuugggcaagacaccaaaagcacagguaaccaaaaaaaaaaaaaaaaaaauuagauaaauuguauuucaucaaaauuaaaaacuuaugugcagggccgggcaugguggcucacaccuguaaucccagcacuuugggaggccgagggggcagaucacgaggucaggagaucgagaccauccuggcuaacauggugaaaccccaucucuacuaaaaauacaaaaaaaaauuagccagacgugguggcgggcaccuguagucccagcuacucgggaggcugaggcaggagaauggcgugaacccgggaggcggagcuugcagugagccaagaucauuccacugcacuccagccugggcgacagagcuagacuccaucucaaaaaaaaaaaaccaaaaaaaaacacuuauguccaaaggccacucuaaugagacaaaaaauaaccuacauaaucggaaaauauauuugcaaaucauguauaucugagacgagauuauccaaaauauauuaagaacuacuaaacuuaacaacaacaacaaaaaaacagccuaauuaaaaaaugggcaaaggguuuaaacaggcauuucuccaaagaagauauauaaaugaccaauaagcacaugaaaagauacccaaggacauuagucauuagagaaauacaaaucaaaaccucaaugagauaccacuucacacuacgauggcuaaaauuaaaaaaaacaaaaaauacaaaagaaaaaaauguuggugaggacgugaaaaagugguacccuuguauauauugcugguagggauauaaaaugguacagccacuguguaaacaguuugggaguuccucaagaaguuaaacagaauuacaagaugacccagcaauuccacuucugguguacuuuaaagcaucucuagauuacuuauacuaucuaauacaauguaaaugccauguaaauaguuguuauacuguauugcuuagggacaaaugacaagaaaaaaguauugguacauaucccaaagaaauggaaacagguguucaaauguaaacuucguuagcuccugguuuuagcucuuauuucauagcaauauccaucaauuuggacaauuugaauggauaaaauguggcauauccacaaaauggagcauuauucaacugcagaaauuaaugagucaugcuacaauauagaugaacccugaaaacccuggcuaugcaaaauaagccagauccaaauaguaguauacugcgugauucuguuuauaugaaauguccagaacaggcaaauccauagaaacagaaaguagaccugcaguugcuaggggaugagggcaggagagaauuaggagugacugcuuaauggguauaauuuccuucuaaacugaacccuagaugaaaaacuucugaaccagacaguggugacaguugugcaacacuguaaauguauuuaaugucacugaauuguacucauuaaaauaguuaaaauagucaauuuuagguuauguguauuuacauaauuuuaaauuuuaagaaaacaaaagaacaaguacaaaaaagggauaaugcccaucuaccuguaggcuuuuuuauaguauuacuugauguguaaagagagaucagacacauagcaucacuuuaaucacaauaaauuauuauuauuccaggaaacuauuauuaugccacaaaaguaugguugcuaccaaagcacacucuggauaaaugagauuucacaguaguaacucauagaauauauuagaaauaauauauuguuacuccucuucaaacacaacuuaauguguucaaagucuccauuacagauuaagaauaauuuaagaaaauaacauaaaauuaaugccuggugaguuaacuagaggucugagaacugucugaaauuauguggaaauuguguauguguauuacuguaagaauucauaauuuuuagauuucaacgguacccagguuaauaacuacugauaagccacaaagaaaacauuaaacaaagaauguuuugcuucauuucucaaagcacagauuugauuuugcaaagauaaaaguacuuuaaaaaguagaauucaaaaauaaaagcccaacaaaguguuguccuauuacaguugucccuugguaucuuugggcgauugguuucaggaccacccuccgucccaccuccccacagacaucaaaauccauggaugcucaaaucccuuauguaaaauagcguagcauuugcaaagaaccuacgcacaaccucugguguacuuuaaagcaucucuagauuacuuauacuaucuaauacaauguaaauaccacguaaaugguugucugacuguauuguuuagggaauaauaaggaaaaagucuguauuuguucaggacagacacaaccuuuacuuuuucuuccccauauauuuuugauccauagcugcauaaauccauggaugugggaccaacagauauacagaaccaacuauauuuccaggcaaaauuuaaguuuggccuccucccuguagcuuuuccugaugacauuaguucauaauugucucccuuuucuaauacuccucuucuaaguauuacuuuugugaugguuagcuucuuauguacucauuuguugauuuagcauaauucaucaccuuaguauguacuaccuugaucccaagcauuucugcauauaggucuucucuaucuccauaaaugagaagcuacucaagugauagagcuuuuguauuuuacuuauuuaguagcccuacaacauaaaagacaacacauaacuauuuuauuuuuauaagcuuccuaugucuuuuaaaauuaaauauaagcauguuuuaugguauauguucuguacuucaaaugaggauguguauuuuggaguaauuuugcaguuaucauaacacugaauaaugaaugaaacauaugcaguuaucaaauccaucauuaaaguaucucguaaucauguugguucauuuggucaaccauaucuacuaauacuuugugguauuauugguaguauucauucuugccuauuuuacuuacauguagagaagcuuuauuaaaaucuuucucaagucuacagguuuccuuuauacaguauauucacuacaugacaaacuaaaaauaacaggucauaauccaucauccugauaucaagugauggucaaacgucuauggaaauauuuuugguuuagguaugauugagacagggucucacucuguugcccaggcuggagugcgguggcaugaucucagcucaccgcaaccucugccucccaggcucaagugauucuccugccuuagccucccgaguagcugggauuacaggcauaugccacuaccaccuggcuaauuuuuguauuuuuaguauagacgggguuuuaccauguuggccaggcuggucuugaacuccugaucucaaaugauccacccgccucagccucccaaagugcugggauuacaggcgugagccacugugccuagccagguuuagggaugauuuuaaaugcuuaugaaauguuuguuuuaaagauuuauuuauaucauaauguuauagugcauuuaguaccacuuauuacaaaucauucuggaauccauaaaaguuuucuuauauuuuuugucugguuuauguuagaguauguuauucuuuaagucagauauaaaguaaaauaacauaaaucucuacuuaaauuucacuuacccuagcuucuccacuaugauuauuucaucuacugauugucuggucucucaaaagauagaugaauacuuuucugacacucuccucuaaaaaaucaaggcagauuaagcacuuuccuucuacaccaccuugagcauguuucuauuauggcaacaaucauacuucuuggcucguuuauauucauaucucuuucaucagacaguaaaccuagccacagucuccagcaugguagguacucaauaaaugcccauuaauuucuuugaggaaauauuuggguaugagggcacuaugcauaaaugaauacaugcuuacagagaaucauuuaaaaagauaaaucucacgagauaaucuaaucauauaauaucuuaacaguuacaucuuuuccauuauggcaacacaaaaaauucucauaauaaaauguaauauauuuaaacuucaggcaaauacugccuaggguuuuaauuuauaagcaaauaugaagggcuuaugaguuuggaugaccaauuguauuauucacaacuauauuccaaggcccuaccauaguaccuuguuuauaguaggaacucaauagugauuugauaaauuaguuaauaaaaacagguuaacgaauuugaugcagagaggcacaaguuaguaaaugguaucuggagcuaagaaacaacgaauauaaauaaaagguuaacauauaaauuugaaacuagguugucaaguuuaccugguugauguaaaaucuuggaagaaguguagaaaaaaaugcugcaucugucacaauaaauguucuuguuuauucauaagccagcccugugugcaauacaucucuaggucuagcuauugaaaaacacacacacacacacacacacacacacacaaaacuucacuuguucuuuauaauauuuagcauuugaaauacacuuuugacuauggcuuucauuuuaaaauuaagcuauaacacugaucucuugaguauucauuuuacaaaagaauuuaaaauaggauuuuauuguuuuagcuuugcuuguucuugcuuaggucauguguaacaaaauuugauuuacaaaaauacaaauuauauacuaccuuccaaggaaauggauuuugccaaaagaaaauaaaaauguguguggguauuguguauuacuaugacauccaaaauuauaaacaagucauucaaguuguggacaucuuacaucuuuugccuauacaguuggcccuccauauccaugaguuuuacaucugaggauucaaucaacuauggaaaucugcagcuaauaaacaauccacuguauuguuuauugaaauuauugaaaauacagcauugugcuaucuguaacgcaauaaauacugagauuaaguauagaccaaauauucaauaaagaaauaaugucaauucuacucaauuucuuccagaaaauauaagggaagaaaacauuucccgaaucauuuuaugcagucaaaauuaucccaauaaaaaggccagagaauuaaauuacaugaaaauacaguauuguguuggcuauaauacaauaaauacugaaauaaauacaguguuuuccauccaugguugguuaaaucugcagaugaagaacccuuggauacagaagggccaucuaagggacuugaacaucagcagauuuugguagccaaagggaguccuggaaccaauuccccacaaacaaaggcacagucaaaaacauaguguacaguuagaaggcuaacuguaucuguuacuggguuaauccuucaccaauggagaaaaauuuaugacaugaacacugagcagucaauauucugucacuuuccucucuguuuuccucaagaaaaagaacuucccuguuuucuaauucccuaauuuuucuauuuagaauugauaguauaaagaaauacuuuaaaaguugcuauaguuauuuggaugucuucagaaguuccugcuguuuuuaaaacaggguuaugacuuuacacacugaauacagguguguaaacaacuuugauaauauaucauaaauagcagcagaccuuauguguuuauucauguuccagaaaaugacuauguuauugaugacagugauacuuacuacuuuaaaauacuuauguuaaauggaaggugggaagcacuuaaacucggcgugcuggugguaaaaugauguuuauaaacucaaauacagcacaaacauuucacgaguuaugauuuuuugauaaugaaagagggaacaucauuagagacccuauagagguuaaaaguaccaaguaauacuauaaacaagucuauguccauaaauucaguaacucagaugaaauggaccagcuccuugaauacauacacuaccaaaagaaacaacauggccaggcgugguggcucacgccuguaaucccaacacuuugggaggccaaggcaggcggaucacaaggucaggagauugagaccauccuggcuaacacgguggaaccccaucucuacuaaaaauacaaaaaauuagccaggcgugguggcaugcaccuguagccccagcuacuugggaagcugaggcaggagaaucucuugaaccugggaggcagagguuguggugagccgagaucgcgccacugcacuccagccagggcgacagagcaagaguccaucucaaaaaauaaaaauaaaaauaaaaauaacaugaauaguugaauagcucuuaaggaaacugaguucauaguuuaaaaauaucacaaccaagaaaacugcaggccuggauaguuucacuggccaauuugaccaaauauucaaugaagaaauaauggcaauccuacucagucucuuccagaaaauagaagagaagaaagaauuucccaaaucauuuuauaaggccagcauauuauccuaguacaaaagccagaggauuaaauuacaugacaggaaaacuaauaucccugaugaacacagaugaaaaaauccucaacaaaacuguagccaacugaauccagcaauauaugaaaagaacaauacaacaugcaagguuuauucaguauucaaaaaucagucaauguaauucuccauaaucacagacuaaauaagaaaagaugaagaaaaagcacuugauaaaaguuaauauaauaucuuauucaugaccaaaacucggagcaaacuagaaauagaaccuccuuaaacugauaaauggcauccaugaaaacccuaaauauaucauauuuaauaaugaaagauaaaaugcuuuugccuuaacacugaaaacagacaagucuguccauucuaaccacuacuauucaguaucauaccaaaaguuuuagucaguauaauacaguaagggaaaaaaaaagcacagacuggaaaggaaaaaguaaaaccuuuucuauucauacgcaaugugauugucauguagaaaaucuuaagguuucuagaaaaaaaacucuucaaacuaacguaugaauuuaucaaggcuauaagauacaaggauaauauacaaaaaucaauuacauuucuacuuauuaacaaugaacuaacaauccaauaaaaauauaccauuuauaauagcaccaaaaucauaaaauauuuaggcauaagucuaauaaauagaugaagaaucugaauguugaaaacaacagaaaaaaucaaagaugaucuaaauaaauggagagauauacaguguucauggaccagaagacuuaauauugcuaagauguaaauucugcccaaauugcucuaacggccaacacaaucccaauaaaaauucuagaagaucuuuugguauauauuaacaagguaauucuuuuuuuuuuuuuuuuuuugagacagggucuugcucugucacccaggcuggagugcagugauaugaucucugcucacuguaaccucugccuccugggcgcaaguguuccucucaccucagccuccugaguagcugggacuacaggcaugcaucacuaaguuuggcuaauuuuuauauuuuguagagacaaagucucacucuauugcccaggcuggucuugaacuccugggcucaagcuauccucccaugucugccuaacaagcuaacucuaauaucuguauggaaaggccaaugaaugagaauaguaaaaacaauuuagauuuaaaaaaaaaaguuggaagacucauauuaacugauuguaagacuuacaauaccguaaugaagauaguguguucguagaaaagggacagacagauagaucaauagaauagaauaauagaaaguccagaaacagacucacacaaauauggucaauuaauauuugacaaagguguaaagucaauucaauggaaaaaggauagccuuuuucaauaaauggagcuagaacacguggaaaucuauauccaaaaacauaaaaccuugcccauaccucaaaucuucuacacgcauuaacucaaaaugggucacagacuuacauggaaaacccaaaaauauaaaacuucuagaacaaaacacaggagaaaaacucuuugugaauagcauaggauuugugauccuggguuauaucccauggguaauuccugauuggcacauacuauucaguacauuucauccuccugguuacaguggcaggaaucauggaugaucagaaggcccaauacaaacaaugaaacucauggugacaucugcugagggauucuggggaaaaauuuccccuuacuuagagggcagauacugaaaauaugcugucuucuuucuuaaagauaugaacaagaaaacacauaaaucugcugacugcaguggccaacuugagaaaaugagagccagccuuaagacaaaguagaaacuauaacugcuguccaaaacaguagccucuggcuacaugugguuacugggccuuugaaaucuggcuaguccgaauuaagacauguuguaagaguaaaauaccaguuuugaagacuuaagaacguaaaauaucucaauuuuuauacuaauuccaugugaaauaguaauauuuuggaaauacugaguuaaauaaaaccuguuauuaaaauuaauuuugccaggcacagugucacaugucuauaguucuagcuacucaggaggcugagacaagaggaucacuugaacccaggaguucugugcuauagugugcuaaagcugaucaggugcccccacuaaguauggcaucaauauggugaccacucaaagcaguagggaaccacccaaguugcccaaggaggggugauccagcccaaguuagaaacacagcaggucaaaacucucauacaccugugaauauagccacugcacuccacccugggcaacagagcaggacucugucucuuuuuuuuuuuuuuuuuuuuuuugagacagagucucgcucugucacccaggcuggagugcaguggcacgaucuuggcucacugcaagcuccaccucccggguucacaccauucuccugccucagccucccaaguagcugggacuacaggcaccugccaccaugcccggcuaauuuuuuguauuuuuaguagagacgggguuucaccauguuagccaggauggucuccaucuccugaccuugugauccgcccgccucagcuuccaaaaguguugggauuacaggcgugagccacggcgcccagucagacccugucucuuuaaaaaaaaugaauuucaucuguuucuuuuuacuucauaaaauguaguaacuagaauauuuaaauuuuaaaauguaauaggcauuauauuccuauuggauagaguugcucuaggaaguugagaaugcaaaguaaaacaacacaacacuacaacaacaacaaagauuacugaugacaucuuagaaccucuggaucaauuuuugccagaagucuuaccugucuuuggauuuugugauauauaaacaaauaaauuuccuuuauaguuuguugguuuccauagaauuuguuauuuugcaacugaacauaucuaauccagaaguacuucuauagccaccuuugaagaaauaaaaauauguucugcggaauuuccuuugcaguucuuucacucuauuugcauaugcuuauaaugcauucacugguuuuuauaaagcauuucauuuccauuauagguauuacaaguauaacacuguguucaaauaaaguagaauauauucuaacaaggaaguucucacugaaauaagagcaaaaaaagaaauuuucacugaaaugaaaaccacauauuuauuuuauuaauucaaauguuacugacccucuaacuuagguuagggaugucaaauaggcuucaaugucacauuagcugucauggcugucugcagugcugugguucaaagaaugcuaagcugaaguuuauacagauguuugucuugaucaagacaagugaaggcguguguucagauauuuacuuaccuagcaaaacagugccuguccacaguuuaaagugggaaaagaugauucugaugaggcgauuuuuuuaaguguuuaauuaguauguuaaauuucccacuggccauucuuuaauagaugggguaucuauuugaucccacauuuacaauuugauccuuaaguuccuaaauacagauuuuacuauauaagucccaaucguuuucuaauauccucuuugacaaugcagguuuauaaaauucucgguaguuuuucuguagaugaauauaaauguacacacugaacuuacccaucucaagugguuaggcugauuuuauuuaauacaaggaggcuaucucuuuuuaaaacagaucaggccaggcacgguagcucacgccuguaaucccagcacuuugggaggccuaggcaggcagaucacuugaggucaggaguucgagaccagccuggccaacauggugaaaccccgucucuaaaaauacagaaauuagccggaugugguggcacaugccuguagucccaucuacuugggaggcuggggcagaagaaucgcuugaauuugggagaugcagguugcagugagccgagauugugccacugcacuccagccugggugacaagagugagacuccaucccuccgcccccgcaaaaaaaaaaaaaaaaaaaaagaaucacuugaacccaggagguggaggcugcagugagaucacgccacugcacuccagccugggcgacagagugagacuuugucucaaaauagauaaauaaauaaaaauaaaacagaucaaaggaucucuauucacuuagcagacguuacuaagcauuuacuaugagucaagaacugugcugggugcuauggggagagaaagagaaaugcaugguucuuaacccuaugcaguuuacagucuagugggaaaacagacaaauaauuacaauaaguuguaauguguacuauagggaaaguacagaguauuccagaagcauguaagaaaauauccuaaccuaaucuagggaaguauuuaaaguaagacacaaagaacuaauggacauugccggguugagaaguggggaaaugggauggugaaggcgaggugggagggugaauucaccuacuuagagagaacagcaugugggguaacaggcaggaaaaagcuugcccaacugagaaacuuaaagaagauuagcuggaacaucaaaugcaaaaagaaaaguaguaauaauguuagagauaagugagugcaaauauguuggagagucuuacaaagcauauuaaauaguuuggacuuuacccuaagggcaaggguuuaaaaagacuuaaggauaacauuauccaucuugcuaucccguggggaaagagggcaagaccagcacuagggagugucauuaggagauuuuacaguaaccauucuaggccaucacugacaaugacuuggaucagggugacuauaggaggaaaagggagaaauggugaaauggugauauuuggaaacagaauauagaagaguuaacaugaaggaaguaagaaucagagauaauccucagguuuuuagcuugaauagguguuugaucguuggugucauuuccuacaauaagcaauacuagaaguggagaaaacuuaaguauguuuuuuaaagcauaaaaaggcaucuuugagaugacuuugaaacaccccaaaagaaauaucuaguauaaaguucucucuggaacucaacagagaggccuaggcuagucuguaagugguaaaugaggcuauaaagguagaugagcuugcuuauggaguauguuuagacaagaauagggccuggagcagagcucugaggaacuugaagggcaagaagcagccuccaaaagaagaaaacccaaaacacagaaguaucaaagaagccgcagaagcaaguguuucauaaagaaggaaugaucauugacaaaaacugcugaaauaucaaaccagaaaacugaaauuuguccaugaauuuuagcgaaauugugaaaaagaguuuuggagauuaaugaggguauacaccagauucugguggauugaagaguucaucaagaaaugggguugagaauagucaauauugucuauagaugagaaaacagaaacauggcagaaucuggaugggaaagugagguugagggagcuuguguuuucuuuuuaagaugggaaacacucgagauucuucaauacuaauaagauggaguaccuauuuuucauuaagaagcuugaaaaugccagauauucauaucccagcuuccuuuagaaauacaguacagaugcuccucaacuuagcguaaggucacauccugauaaacccauaguaaguugaaaguauuguuauguugaauacacauuuaauacaucuaaccuaucaaacaucauagcuuagccuagccuaaucaaaaugugcuuagaacaguuucaguauaguguucaauaaauuaaaugagauauucaacacuuuauuauaaaauagccuuugguuagaugauuuggcccagcauugugaaaagguagcauaucacauauggccaguugggaaagaagucaaaauucaaaauaugaaguauaguuuuuacugaaugcauaucacuuuugcaccaucauaaaguuaaaaaaucauuaagucaagccaugguaagucggggaccaucuguacaguugucccuugguaucugcagugggcugguuccaaaauacuccccucugcccucccccaacccugcagauaccaaaaucuauagacgcucaaaucacuuauguaaaaugguguagugcuggugucacaaccagaacgaacccucuuaaauagagaugaccacugcagcaggggcaaguuuuaggagcagcagcaauaaaagucaagcagcagcuaggcgcgguggcucacgccuauaaucccagcauuuugggaggccgagguggguggaucauuugaggucagaaguucaagaucagucuggccaauguggugaaauccugucucuacuaaaaauacaaaaauuagcagggcaugguggcaggcacuuguaauccuagcuacucgccaggcugaggcaggagaaucgcuugaacccgggaggcagugguugcagugagcugauaucgcgccacugcgcuccagccuaggcaauagagggagacuucaaaaaaagucaagcagcagcauucaguggugccagcagcaguaagcaagcaacaguauugcuguccuaaucagacugcaccugugguguggcucugacugguuucugccaaggacagcacccuccccccaggucuucucauuguacaagccuggcugcagucuuccuagcaauucuaagagcuuccuaacaucuauuuaauaaauuuacuucuagguuaaauaggccaaaaucaguuuuuguugcuuccaacuaagaaaucugacugcuuaaggaauuacaguaaaagaugauguucugucagugguaugguggcaaaucgacucccccaguacaaccaccagaauaucagguuugaaacacugacguggucauuuagcaucacuaagcaagugaacucuacaauuagauaauuacuuucugaaauagagcugaagcagaguaagguacccugucacugcucucucauuucauuagucucugugauucuuuaaaaugagcaugaauuuuaagaagaauugaaagguuccccuuucaaaacaaaucaguaagagaaagaaaagacaaggguuaggagaaaauaucugcaaaacauauuaauauaucuauaaaagacauguaucccaaauacauacagaauucuuacaguucaauaugaugacaacccaacuauaagaugagcaaauaccugaauagauauuucaucaaaaaagauauaugaauugccaauaagcacaugaaaacaugcucaacaucauuaguuauuagggaaaugcaauccaauaccauucccacuagaauggcuauaauaaaaaaagauagacaauaacaaguguugacaaggaugugaagaaacugcgacucuaauacauugcuggugaaacaguaaaauaguuuugcaguuucuuaaaaagcuaaacauagauaccaugcaagccaacaauaccacuucuagguaccuauccaagaaauaaaaacauguucccccaaaaaguugcaugcaaaugucauaaaagcauuuuuaaaaauauccuccaaucuggaaacaucccaaacaaccaucagcugguggacaaacaaaaugugguauuuuaaaacaacugaaugcuauucagcaauaaaaaacagaauauugauacaugcuacaaaguggaugaacuucaaaaacauuacacuuagucaaagagaccagaaacaaaaggccacauacugucugauuccauuuacauaaaaugucuggaaaguacaaaucuguaaacacaaaagguauuuugguugguauaaacacauaaagcauggugguugucuggagcugggguuggggcuaggaauagggauuaaguauaaaagaacauaaggguucuuguggaggugaugaaaguguucugggacugaacaggcuugaggcaggagaaucaccugagcccaggaagucaaggcugcagugagccaugaucacaccacaguacuacagccugggugaugaaagacccauuugagccaaaaaugggucucaaaaaaaaaaaaguucuaaaauuggauugucgugguguuuugcacaaguuggaaaauucacuagaagucauugagcaguacacuuaauacagaugaauuuuacaccaaauaaauuauaugucaguaaaguuuguuguuucuuuuuuaaagaaguucucaagucucauuuuuuuuuggucuucauagaaggcuacuaagcacuuuagcaggcgaggcaccuguagauuguuugcaggagcugugucuggugugaaagacaacucuucagcuuagcaaugacuccuaauacuacauagcauuuguauauucuaggacaguucuucucaaagucuggucuguagaccaguauugauccaugggcacuguuacugucugaaacugguccaugacuaguuacagaaauugagacuaaguguuuagaaauuuuaauagcaauuugaccaauuaauauaucuccugaaacugauauuuggacuuguaucauauuucuuuggcuauuuuuuccacuuaauuuuucuaguuacccauuuuuauuguauuuuacaaaagacacuaucagccaaugagauuauaaaaauguugcguuaccacaaauaguucaaaaaacauugcucaacaaaguuuuucuaccauccuacaacuggccaucauauagacugguaggucaauuaucuugucaaacuaaccuuuaaaaaauacauaaacaugcuuucaaaugccccaacuacccuggugguacaaucaacaguaauuuuuuuuuuuuuuuuuuagagauagggucucacucugucacccaucuuggaguguaguggugcgaucauagcucaccacaggcuccaacuuuggcucaaaugauccugccuuagcuuccugaguagcugggacuacaggugcaaaccacuacacgcagcuaauuuuuaaaaauuuuuuguagagauggaaucucacuaugaggcccaggcugguuggucucaaacuccuggcuucaagcaauccuccugcaucagcuucccaaaacacugaaauuacagggaggagccaccucacccggacacaacacuaaauuuuaaguccuucuauauaacccagguuuuuuuuuaagacagagucucgcucugucgcccaggcuggaguccaauggcacaaucucggcucacuguaggcucacugcaaccuccaccucccagguucaggcaauuccacugccucagccucccacauagcugggauuacaggcaugcgccaccaugcccggcuaauuuuuguauuuuugguagagacaggguuuggccauguuggucaggcuggugucaaacuccugaccucaggugaucugcccgccuuggccucccaaagugcugggauuacaggugugagccaccacaccuggcccauaacccauauuuuaauagauguucauuuguuuuuccauuuuuauaaauagacuuucaaguuuauaauuaaaagauaaaaauucaagcuauauauaauuaaugucaauucuucccuuucccuuaaaaaaguagguuugaauuugcaaaauaaaucuacucuuugaauucuaauaaauuaugguccuaggaaagguccuauaaaacaaaacaagacaagcuaauuauauuuucauuuaaaaauaacaguacaaaccaaauauguuccuauguccauuuggaaauuaauccaaaacauaauauauaaaucaguauauuuuaggcugggcacaguggcuuaugccuguaaucccaccacuuugggaggcugaugcaggcaaaucacuugaggccaggaguuugaaaccagccugggcaacauggcgaaaucucaucucuacaaaaaauacaaaaacuagccauacaaaaacugugguggcauguaccuguggucccagauaaucgggaggcuaagguagggaggauggcuugagcugaugagaugagguugcagugcaccaagaucaugccacuggacuccagacuggacagcagagcgagaacuugucucaaaaaaaaaaaaaagaaagaaagaaagaaaucaguauauuucauauaguauacaacacgaugucccaaauguaugucaaugaauuaaaucaggcaauauaauaaccaaggauacacauauacucaagagaucucuaggagaggugcuuuauaauucgguggucagcaaauagcuggaagacucaggacaacagcagaacagaagccaucuaggaucccacagacaugcugagaugccuguaggccucuuaagacacauaaucaggagcagaggcacauaacaaaucacugauugcacuaauuguuuuuauacuaccuggaugagauguuuagauaauguacacuauauaauagagauaaacuuaauuacuaucaaaaaucaauacauaucuauaaaaaggaaguaauucaaaucccgaguguccaacacaaauuagcaguauuugagcacaaugaacuaaaauguuucagccaccuuugguaacagguaguacaauggagaaaauguaaaacuaggagauaagugaccugagcucuacccuggcaauaagacuuuagacaagaacaucuuacucccuucauuucccuauuggacacaagugauaaacuagauuauuucugguccuuucaagaaauauacauuacaguuugugauuuaaauaccaacaaugcaaaacaccaccaccacaaggaauacacugccuuaaaagguuacugugcuucuucuaaaaugaacccuauauagacgauucauuuggaaaauaaucuuucauuuaugccuugaaaagaaauuaauuccugccauaaagccauuuaauuauuuuucaaauaauuuugauaacauuuuucaauaauuuugauaacauuuucaauaauuuugauaacauuuaacauuauaacugacuugcaauuuaccaucuugaucacuuuggaauuauuaguuugauaacccauuaaaaaccauuuuuuucaaggccaggugugguggcucacgccuguaaucccagcacuuugggaggccaaggccagcagaucaccugaggucagggguucaagacaagccugguucaauauggugaaaccccgucucuacuaaaaauacaaaaaauuagcugggugugguggcuaacgccuauaaucccagccaccugggaggcugaggcaggagaaucccuugaaccugggaggcggagguugcagugagcugagaucaugccacuguacuccagccugagggacagagugagacucugucucaaaaauaaugauaauaauaauaauaagucaucauuuucaaaaagcauuuacuaagaaucucuacauacgucauguuugaaaagugagaggaaauggacauaaaauuaaacaauguuucaaauacuaaguauuuuauaaauguaauguaagauaaccacacaaauacacaaaauaacuuuuuauacagugauuuuucuuuuaauauaagccuggagggaaggaauuauuauauuuaaaaaucucauuaacuaagaguuaacucaggcaugcugcuccaaguaaucucuuauccuucuauaaucuuaaaguuucucuagauaaagaaaccaccaucauuagcagaaagugcaggaaagaagggcuaacauuuuccccaaaaacuacagaaauaguaauuaacaacuuuaacaagucuaugcuaauucagcuuuaaauccucuagcucugagaagauuaacaauccauucagguuagauuucccaauggguguugguuacuagagaauucauuagaguaucuaaaaugcugguuucuggaccucucugauuaaucucugauuaaauucuaaauaacaucacuuuuauuaggcaaugagucagccugcauaaauucauguagccaaaauuaugcauauauucugaaaacgcauauaaucaaagcugaaaaaaaugugcugguaauacaaagauuggaaauguguuagaaucaagucuuuagugaaaauugagaugcuggguuuaaguauuuuaaagaaguuuaagaaauguuuuggcaaagugcaggagacuggcugauggggcuuaguauauaaaggcccauaugaaaguaauccagaaauacagcagacaucauggaaguuaaguuagucugcuuaaaacagaguuguuaaauaggauaaggccagcugguagcagcccuugaagcauacacaaaaauaugauuaaguacauuucaugaaaggaaccgaaaccuagcaaaauaacugaaucacuucuagauaggcagagcuuccugauuaucccaaauaccuaaagauuugugaaguuacucagcaaggcugauaaaucaagagugaagagcauuauuaucuuuugaaggcuauaacuggcaucaucacuguccucccugauccccucacaaauccuaccaacuugggguaaaacaaaauucaacugaaaucuaaaacuauauuaugcuuuuaggcuuuuuguuuuugcuucucucucucucucugcgugugugugugugugugcgugcgugugugugcgcaugcacgcgcgccugguuuuuuguuuuguuuuucuuuuggcuuauuuaaguagaaguuuucagugaacucacuuugaaaacaauucuuuucaacaacaacaacaacaaaaaacccuucaguuccuacugcucauguggaagcucuugcucagccuccaauuaaccaaccaucauaaucaaccaauauucucuagauuccccuucuaaaacaaacugacaaggaugcuuauuaggcuguuucaaacacuccacugugugccaaccaagaguaagcugguuuauucccuuacuguuuagacaagguguucuugcaacuguggaauuugauuauacuaucuaaacuaacaaaauaagagugugaagaggccgggcgcaguagcucaugccuguaaucccagcacuuugguaggccaaggaggguggaucacgaggucaggagaucgagaccaucguggcuaacacgaugaaacccugucucuacuaaaaauacaaaaaauuaguugggcgugguggugggcaccuguagucccagcuacuuggaaggcugaggcaggagaauggugugaacccaggaggcagagcuugcagugagcaagauggugccacugcacuccagccugggugacagagcgagacuccaucucaaaaaaaaaaaagagugugaagaguuguuucuauuaaaaguaagucacacacacacaaaaaaagguucaauguuuggcacaauuuaagacgauuaacuugaaaaaauaagaaugcuauugaauugaguauaggugagacuacuguaaaagauuugggagaaaugggcugggcacaguggcucacgccuguaaucccagcacucggggaggccuaggcgggcggaucacaaggucaagagauggagaccauccuggccaacauggugaaaccucgucucuacuaaaaauacaaaaaucggcugggcaugguggcgcacaccuguggaggcugaggcaggagaauugcuugaacccgcgaggcggagguugcagugagccaagauugcaccacugcacuccagccugaagacagagcaagacuccgucucaaaaaaaaaaaaaaaaagagauuuggaagaaauaaaauauuaagauuugacucauagauuacaaauguccuuaaggucuuccuccauuuaaaaaaaaaacuggaaaucauaagugauacauuauggguaugguuuaugcaugaaaaacugauguagagugucaacugauagagucacacacaaagaaaaggcguuggcccuagaucagaguuucucaaucccaguacuguugacauuuuggaugggagaauuaucuguugggagcgggagauauuggccuguaaacugaaggauguuuggcagcaucccuggcuuugcuauuacccacuacauggcaauagcacucccauugcaguaguggcaaucaaaaaugucuccaaauguugcaaaaugucccuggaggguaaaaucaccaguugaaaaccacugcccuguaaccaaauaacuaacaaaugcauguaugucuauauauuuugauuaaaguaaaauguuuaagucaucaauuuuuaaugcuuuuuacuauaaccaaguuuuuaaaaucaauugaucaacuccuaguucaaguuaagucauuuaagaugucuuuugcauacacaacaggaagaaagacaaaaaauaauucuucaccugaucaagugccaaaugagauaucuuuguacaugaugauagucccaccucauccauaucuuuugcugagaucaagacagaagcacaggauuauugaggagguuggagcaaggaaaaaagaaagaaaaaacagcaaagggagaaaaaaaaggagaugcaagaaacaauucucagaugguuggaauaguggcacgaggagaaagcuuauuaccucuugccuucuuagucccauucacaacaauguuuaccacaggccaaucuaacaccaaacaagagguuccuacuaaaauuacucaccaagguagauaaaucaagagugaagaggauuauucccuuucaaaggccacaaguggcaucaucacugcccucccugauccccucacaaauccuaccaacuugggguaagacaaaauucaauuguaaucuaaaacuauauuaugcuuuuaggcuuuuuguucguuuugcuucucucucucuguguauauguguguguguguaaaagaaagcuuaaauguauguguguguguguguguaaaagaaagcuuaaauguccacugguggguaaaugguuauauuauacuucauuuguuuacauuaagaaagugagguaugucuuuacgugcugacaccauuauauauuguuaaagaaagaaauauaagugguaguaugacaccaucauagagaauacacuuguaaccugaaagcaaagcaaauuauuaacaguauuuaucuuuugguauggcacguugcauuuugcauaacugccacaacaauauuuccaucauacaugcucuuugagaauguugccacuccucccaucaaaagguggaguguagucucuguucccugcucuccaacacaggcaggccugcaugacugccuucgugaguagaaugcucuggaaguaauccucaaguuuccaaggauagaucauaaaaaacaauaagccugacuuccuuucucuuuugggacaccugccuuuggagcccugaggcacuaugugagaagucuggcuaccuugaagccaccauacugaagagaccacacagagacagggagaugccuaaggagacauuauguuuuccccauaaugucucaugaguaagcuagcucagaugacugaaauuacugaagcaagcauaccccaugugcaguacugagaucugugccucacgguuggguccucuuucugauccuaucaaaaccaaacuaugagcuuccugaacgguaggccuacaucuaacucauuguuggcuaaauaagugggaguuaauaaaugaacugugaaaaugaaggagggaugggaaagaaugucauuucucugauccaguacccucaguacuagauagauugcugugucuaaguucuugacaaguauuauuggcuguagcugguaccagcgacagggguaccagaaauuuuagguucacuaucuucugaggauaaauucaguccccucaccccugcccccuaccagcggcaagucagcagaaaauucaaggaucuuacacuucaacuaggaauccaauucauauacauaacaugaaaacuaaacuauuuagaaugucacauaccuuacaaguaaauacaaaaaauuacaauaaugauugaguauguaaaugcagcuuauaugucgaguaaaugacuggucuaagugugucgagguucacugggauaugucucuucagacagaaggauuuaacuggguuuuaaguauaagguuuuaacuaguaagauaaggauauacaaauacauuaaguggguaagguagcaaaugccaagaaacaaaggcugaaaauauacagcagaaggaaagguaauuuacuugaaugcaauacagaaaaugacuucuggaauaagaaaauaagacauggaaaagggaggaaaggaaauguuagcaaacccaucacaaagcacagggacgaaaauuuggcauauggcacaauuugaacuaagguauaguaaccucuuaaaugacuugaugaaaaguuugauaaaaauuauucuaagagugcugugcaccauggaauagaguagggaaguggcaggaaggccaguuuuacugcugcaaucaucucaacaagaaguaaugaggauggcaacuauagacaauaaaggaaaagaauaaucuaagagauguuauggggugaaagaaucagcagaucacugacaaauuaggugagaggaggagggagaaaaguacaaaaagaaaaguacuaaagggagauuuaaagccuucaaaucuaggaacuucaagaccagagguaauuuuaacaagagagaaaagaaugauggaagaaacacuuguauagaaaaaauuuuaaggggaaauauuacaucaaaugcagcuaagagcuaaaaaaggaaaacucagaagaaaauaaauacacaaagaaaaaauaaauuagccagaaagggauuauuugcaacaaauagagaauucuaaagauuaaggaggggaguauuaccuaggaaaaagaacaggacaacuaauaauaagauaagguguaacaaccacuacucuaagcacuuugcaaauguugaaucauauacucacaagaauccuauuauguauaugaauaaauaguauuauuuaucuaugcccaguuuacagaugagacacauagagguuuacacaaaauuacaggguuaaguaguggagaucagauuugcaccuagacaauauggcuccaaaguucauguucacaaccagcucaauauucuaagaguaauuaagacuccaaaaagaaugacagaccuuaaaaggugagaaauuaauucaugagugcaaagguucaagagauggcugauauuccaaaguauauaagguuaaaaaacaaacaaaaaaaacucgcuuaccagauccagaaaauuagaauaaaggagaacuuaaugacaaaaggugggaauaaaaaaagacugucuucuuaagaguucauauacaaaaauacagaguuuaagaaaaugagcugaugccauaaccauaaaaacuagauguuuagggcauaauacuguuaaguacaacaucuagaaaaauaaucauauuuacgcaaaauauagcccaugucacgaucuacugacauaagcaaucagagaggauggacacaguguuuaauaugaggcaggcaaauaucaggaaagaaacacucccaauuauaaacagauauuugagacuuccacagaacaaagcauauaauagguucuaaguagacauuaugcugucuaugcauuuuccaagcauucugaggacuauaccaauuagaauuaccugauauacuuaugaaggauauauauuccugggcccaucucagauuuuaggaaucuggggguagaacucaggaaacaaaauauauauauauauauauauuuuuuuuuuuuuuuuuugagacggaaucuugcucuguagcccaggcuggagugcaguggcgcaaucucagcucacugcaaccucugccucccaguucccaguucaagcaauucuccugccuuagccucccgaguagcugggauuacaggcgcgccaugaugcccagcuaauguuuuaguauuuuuaauagaaacaggguuucaccauguuggccaggcuggucuugaacuccugaucucaugauccgcccaccucagccucccaaagugcugggauuacaggugugagccacugcgcccagccagaaacuaaaauuuuaauacuuuuuccaggcaauucuucaacacaaaaguugagaucacuguuuccuucuguuguagccuaagugcuuagaacucugugacuccccaacuauuuaucuccuguggcuuuguaaucugacuccaaucuucuagguuccuuaguugccuauccuugacuuguacuuauuucuaaaaaucuuggcccugguuugguaauauaauaaagacuuggauauggaaauuuuagcucugaaguccauauaaacuccaauacugacauaggaauaaaaagcuccaguuccuuucccugaaaucauggagcuuuuguuaaauaucaccuaugguguugacuggacauuggauugacccaguaugucaauucuuuuguugccagaucugcagagaacaagaugcucacuacuacagacucaacuauuugaauuccugcuuauugucucuaaagaaagaaggcacaaauuuucuugucagggaugaaugacauuugcuaagagaacaguugucacuauauagauagagggugccuaugagaauguuccaguuccuagaguagugaugaaaugaguucuccuaagaugucucuagaucuuaaugaugggacaaaagaaugucuacuugauaugaauaagagcuucuuuauucaauaagggauagucuuugauagcagcaaugaggauccugauacaauggcuucuagauacuuucaugcuuaguagguuagugauccaaacuguagagauaguacguucauguauccagggcuaccucucauucuccuuccuuaauccuagcuaguucuuauaguccuacuuugucaucuuucugguuugccugaggugacuagaauaaaaagcaaaucuuaaauuauaggagucuuuugcuauuuccagcaaacugauccuugcagaaaaggauuaaauccaaccuaucuuuguaucccacaaaguaccucaucacgcacugcuagacuugacauguuuaacugagugccuuguucaacaccaacaagagaacccuccucauaaaaagcaucuaaaagcuuaagccucauauaaaaggugcuuuccacgcuaccucccaccaaggucacgggauaaggauagacauuuaagucaugguggucaugcaaugcauucagauuucucucuugccaacugaacuaaaagaaacacacugucaccaucaacagguaaacucuaguugaaagaacaguucaagucaacaccauggcaaaucaaauccacuuaccagucagagaagcagagacuaugaaaaaccagggcaauacaaacagaacuggaagggagaagugagaaagggagaugaagcagacauggaaggagaugcugagacaagaaaccauuuaucaccagaacgagagcuugagagacuagcuucucagauuccuaacguuucucccauucacacaaggucuagucacucuucuucaacccaaaacagcugaaucccuacaacgccuguccuugaagccaaaugaucccuaauucaagcauuauuuuuuaguacguacaccaagacaaauagaaagcuagaaacauaaauccaaggaggaaaaaauaauucuaccaggaaaaaacugaaaucacagguagccaaaaagcuuuguaaauaugaaucuuauuuaucaggaaguaccaucaauauuugucauauuccugcuaaugaaacaaauuaaacuuugucuuuuuuuaauagaaauuaucacaguauugacaaaugaaaaauugucucaaacccagagaagacaaaaaucaggugaucuaccuuuauuuguuaauacauuugaaaauauuuuguuagccuguuuaaagcagacuuccguuguugucuguaauaaucgauaguauauuggauuaacagccucaucuuuuaagacaggcuuuauaaucauauggcugauuaaggggcagcaaaguauaaccaacccuguaacuauccuuuaacuuguaccuaacaaaaauaguaaccauaaccuccccuuuuauucuguaaagauccuuuuucugaaaauaucuuugaacuaacuuccuuuaaagcuaguucccuugcaacaaguacaaaauaaaacuaugacauaugcugacaaucaauuaaucugacaaguuugcauuaacacugucaaaaccaaacuaaugucaaaauagcuguaauuuugguuaucuaacacagauucuaacauauccucucuagcaacaaacauaccauguaagccuugaauuuauuuaaaauuuaaaucuuuuuuuguuuguuuguuugagauagagucucgcucuguugcccaaucuggugugcaguggcgccaccuuggcucacugcaaccuccgccucccagguucaagugauucuccugccucagccuccugaguagcugggaguacaggugugugccaccacgcccggcuauauuuuuguauuuuuaguagaggcaaaguuucaccauguuggucaggcuggucuugaacuccugaccucaugauccaucugccuuggccucccaaagugccgggauuaccggcaugagccaccacgcccagccucauuuaaaucuuacacauuuuauuuguggacaauuucaauguuaucguuaacuuuuaccagaaaauuuuaauggguccuaauauuauaauuccucauuuaaaaaaaaaaaacuagccgaccaguggcuuacgccuguaaucccagcacuuugggaggccaaggcggguggaucaccugaggggggauucgagaccagcaugaccaacauggagaaaccccgucucuauuaaaacuacaaaauuagccgggcaugguggcgcaugcccauaaucccagcuacucaggaaggcugaggcaggagaaucacuugaaccuggguggcagaaguugcggugagaugacaucgcgccauuguacuccagccuggguaacaagagcgaaacuccaucucaaaaaaaagaaaaaaaaaaaaaaccuagccaauauucagauucucauaacaaaaaaaaaaauugguauguuugcaaugucagguucaucuaaaaaauaaacuuuuaaaagaaaguuuaaguggaauuuuucauaaaaacuuucaggaugugccaaugcaacacuuaaugacagagauacacucugagaaacgcaccauuaggcaauuucauuguugagcgaacaccauagaguguacuuacacaagccuaggugguauagccuauugcuccuaggcuacaaaccuguacagcauguuacuguauuaaacauuguaggcaacuguaacgcacuggaaaguaucuguguuucuaaaccuuggaaaaaguacaguuaaaauaugauauaaucuuaugggaccacugucauauauucaguccguuuuugacugaaacaucauuauguacuacaugacuguauuacauaaggcaaagagugaaauuacugauccaauaauugguuaucuuucuccuuagcuauauugacaaaacaacagaacuuaugaagaggaggagaaucauucaaucuuugcaguaagaguucuguaccuugauuuugguggugauuaugcaaucuacacaccugugauaaaauggcauagaacuauacacacacauuguacugaugucaauuuccugguuuuaauauuguauuaaaguuauguaggauguaaccaauaggggaaacuggggaaaaguuacagugcccucucuauuuuugcagcuuccuguaaacuauaauaugccaaaagcauccuaaggacuugccagcacuucaagggcucacaauaauccuaugaaguagguacuauuuuuauccccagucuauugauggggaagcugagguacagacauuuuaaaugauuugcccaaggucacauagcuaguaacuggcaaaaaccaggauuuggacacaggugguaugacucucaauuuuugauuuaugucaaagucugaggagccacuaaaggauuacaggcaaaguaugguugacaaucaaauucacauuuuauuuuggcaagauaacuccuacuaggagcuuagaaugacuaaugaaaaaaauucaaacaagauuaguuaagagacugaugcaauaaaccagaaaggaugaagauaugaaauaagagaacauuaauagaaagaaauguauacaaaauacgaaaccaacuugacuucacgauuggaugaagagugagaacuucauccaauuucaaggcuugacugacuacacacaagccaaggauuucauguuuuaacaauacaauacauuaucaaaauuuuuuuuuuuuugagacugagucucacucuguugcccaggcuggagugcagcggcgcaaucucagcucacuacaaccuccaccucccagguucaagcgauucuccugccucagccucccgaguagcugggauuacaggcaugcaccaccauacccagcuaauuuuugucuuuucaguagagacaagguuucgccauguuggccagacuggucucgaauuccugaccuuaggugaucugcccaccucagccucccaaaguguugggaugacaggcaugagccaccaugccuggccuauauuaucaaaaucuuaaagcagaacaauucagucuuaagucaucccuguuucagcaguacccacagcauuucacuuucuugcuauaaaaauugugacuagauacaaauuaaaguuacugccacuuggcaacuccacgcuacuuaauacguauacaguaaugaggcuacuaauauuuucaauacaccacauguggaccaucucuggacauaagauaaacaaagaagcagccagagagaauacauacucagcauguggaauuuagucaacauuuuuaucacaauccacacucuaaauuuaagaaaaaccuaagugcccuuugacuggauuagaaucauuuuaccacuuaacaggaaggagucuagugucacccauuuuaagggugaaaaaguuaaaauaauugaucacuucaaagcuaaaaucagacuauuguuacuguuuuuuuuuuuugcaaauguuaaaaaaaaacuauagccuaagaaucugucaaauauugcauuaagauuacacuaaucacuggaaaaacuuaauguaacuucaacuuuauuaccacuauaaggguaaaaaccaugcuaaagccagggcccuuccaggagcuaaaugcucuuggaaaguguccaaaacaauguuauaguaaauuuccaacuuguuucaucuaaggucaaggaaaacaaauuaucuaaagcacuggauuauguuugaauacacugcaacuaaaaguuuacaucaaauaaucccauggaaaaaucuuuacucugcgccuaugaugggcccuaaauccaguaagggcaaugugggggaauagcugcaccuaggaauccaugcuacgucuuacuuacuaauauuuugagaaaacuuucaauaucaauagcuuccauuuugagagaacuguauuuuaacaaaaucugugaaaauaaugguuuggaaugauaaugaaaaucuccucagcuucuauaauguggacaacaugugcugguuacucuuugguuucuagcuucagucaaaguucaaggucuucugcuauuuguggcucagauucuuucuuaugggaggcaugucugauagauauacaccaauuucauaaauaaauaaauaaacauaaaaguauuuuauguaugaguguauuguggguguacauauauggcacucuagacaagccaugcuuuucacucacaacaaugcuuuaauaaauuacaguucuacuacagugggaaguaaaagccaacuguuaacagaaaaaucuagccaaagaauagcaaagugagcuacaaaauuaauuccagaagccaaagaacuaaauaaagcugguucacaaaacaaacaaaaccaacacauuuucaaugagcacuauucgguuuaucuauaaauguucauguauuuaaaaaguugagugguaugccaacuuucacuuaugacaacauucuacauaaauaccugauucccaagagaaauaauucagguuuaaagagcuguauacaaaaauaagagaagcaagagcuacaaugaaaugaacagaacuaaauugcacgggagcccuaaaugugggaugugcugaauacaguguacaggagacucaaaauacacaaauuaagccuaaauauucccaauguauucaauaucuaugaaacaagcaauagaauuccaaucaacacuugccacaaaaauugccauaagcugguugcuauuuuuuaaaugauguaacaaugacagauuuguugccacauauuuuguaacuuaggaacacugagcuauuaaguuucuauuagcgauguuuuaacugaggauuugggcuagaagacugaaaucuguuuguacagcagugaaaacgaagccucacuaaaggcauucaacuuccagcuaaaggcuccuuuccuugaugcguauuugugaccauacauaguguucacuaaaugcaguaaacuaaacuagcaacagauuaguuaaaagcagcuuagauuuucaacuucccauaauacaggcaacaucuuuagaagcaaucacauuaaaauaaaugugucuuucacaguuacgggaugaaauuguaagcuggacaagcacccaugcccugguuuucuacuuuauuuguaaaccauaugacucucacaugcugagaauguuuuaugcuuuaaccugcaguaaaggcuuuacaucauuuuaaugcccaguacuuaaaaugcaacagaaucacccccaacaaaugcugggaauauauuugguuuacauguaaugauuuugaucccacuaguagccagaaaaaguuuaaugaaugcuuuuucaaguaaauaacuuugcacuucuauagacaaaacaaaaagaaauuuugagguaaggguagauggaagagaaaacacucguguuuuuccaauuuaaaauauuaacaaacauguugguuuuuuacuucuaaaauaauuauuaaacauuuuuuaaaaaacuccaugacuauuauaauaugcuucagaaaaauaaaacaaaacacuccguuaaguaguuacguaggauuuuucucugguuuuugcaaaguaguguuucaaguuaagauacaagcuuaaaacaaaugauucugaaaauccuggucuaucacaaacuaauggcuuaguuuugaaucaacauauuguauauucuacaucugagauuuagaaaucacauuuuuuuuucuauucaggucaauugaaauauacaugcuaccucacucuuucagucccccuuaucugugugaaugaccaacagcaaaaauuuuaaaucaaugguuagaggacauaucauaaaauuacacacucuaucaaugugguuuucaguuaucauagaaucuaaaggucccuuacugaugauagguggcagauucaagaauugauaaguuuggggaauauauucaauucucaacagucgaaauagaaauuaugccaauuucuuuacuuuaaaaauccguuacacuaaaaaaauugucacauaaggauuauugaagaacuuaauaaggaaguacaaaauaugaccuuaaauucuccuaguguguuauuaaauauuaaaaacugugagaaauaagagauguugcaauccuuuccuuuuuaacucuaauugaaauuugaaaaaaaauuuagaauucaaauuucccaacuuugacuuagaaacauaauucagcuagaucaagcaacuuaauugcacaauuuuaaaauaaguuuaaugcaaagcacugcaauccugaugugauaauuaccugcagcauaaaugcaaaauaauaaaugcauuuaacgaugcauuuuaugguaaaaccacaaaaagcacaaccauauuagcacaaacuaaauaaaaagacacaggcgguauuauguccaacagaaagagaaauguuguacgaagccaagaaagaaaggaaggacuuaaggaaggaaggaaggagggaggauaggaaggaaggaagagggaagccagagguuucuguaccugcaggauaccagagaaaugagcuagucacaucacucuaccuuauaugauacaugggugauuuuuuuuaagcuucagcguaaauaaaaacaguaaucacuuuauaccauucaacuuuacauaguguuaucuuuaaugccaacugcauucuucccuuuacucacccaaugcuucuucacuguuccauuccaccagcuuucaggcaaaugcaagacagaacaggguggaguagaagaaaaauacaagcagcgccuuucggcgcacccccucucccgcaaauaauuuccaacaguuccuccugcuacgaaaauaagucgcccuaucuccagauacauaacagacauuccgucuccuuaguagacacacacagacgcguacacaauccagcacucccgacccccaccccaggccccccgaaucuucagcaauuauucaucuaauucacacgaagacaagauaccucuaccuacuguuucggggugaagguggguggaggacgccuuucaaaguagccccaauaguguaaccaaaacacgguuccggaauaaaauauuaagaaacacuuuuccuuucccaccuaucuaccgacuugaggaugcaaaaaauccaucuccacaucacaccaucucuacaguucucguggcuggaguuugggguggagauucguccaggggagggggcggaggcgaguggcagagugugagcgggcgacgggacacaagcgaguuguugagcccggccgccucgcaccacgucgccagcccaaacgcccagcaccaggaccucacgcccgccccucagcccaggcccagagcgagcgaggacucgcgcugucuaacuucccaucuacagacaccgcuccaagacgagcagagcacacaaguacacgucacacaguuuaaacacacuuacacaccccaaacaaaccaacacaccugcaaaucaccucacaguuuccagaacuccacaccggagaccccaccuccaggauucaaaccuuccgcucaucguagaggaaaccagaagaguuggggggcagucgacgccuuuccaggaccggaccccacgaacugccccaccccacagcccgcgucugggucacccacucggaagcccccugcuuccucccuccucucaauccggccgcuuacgagacccauccccagcguccgcucacuuccuccccaaaaccccuccaaaaaaauuguuuuaagugaagagaaagaagugaggaaagagacuugagguaguccggcuucaaaaccgcucgacucaccucagaauccucgcugaguucucuccgcccggcacagcccccuccccaacgucccaguacgaagggcugagauagggaggagggaaggcgggagggggaggggugucuuccgcguggggcgcccgucgggaggggacuggggagggguugaggccggcgcaggaagaggagaagggggaggggaggccccuaucucccagucucccccugaaaaaccucccuugucucaaucacaucagacugacugucuuugucuggcugacaaccgccauauugauaucaaca

SEQ ID NO: 192507 - RNA, 122524 nt, Homo sapiens
aaggaagacaugauaucaugcugggguggagagggaggaugcauuggcggcugggaugaauuugagcugacggaaggaggcguucggagaggaaagggaggaaaaggaaaggcgaccacaguucccaugaugccuggaggggagacuacauuucccauuauuccccuggaagggacgugaggaugaaagacugcaagucccgcgaugcucucggcuggcagguggcggagauugcaccggaagacgcuuccuggguuugaggaguucagugacugcuauugaaccaccaaaaguccauuaugaaacuggugagucuucgcuccuaggucagagggcaaaggugaugcuauaaccuuuuggaccucuuuuuuuccuacguugggcagggaaucgucgcacgggagggguagcaauuauugagcuggaaaguggagugggcuaaggaaagcugcuuuuuguuguugagaagguuugaauucccucucccccaccccaucccucccaggaggucuuuuuucacucguuagugggucuuuuuguucagacaagagguugacugucacaguccuucgcccaugaacucugugggcucuguuaaccagguuuggacguccugguucccacgugaggguuauaauaggcuguuaacaauccguuuccauucgauuggcgcuugaguauccugucucccuacuguuguugagacuggcuagauuuaagcagacaguaaaaaacauccagcagaacguaaucacuuauuaaauauccuguuauauagacuccucacugcccuuggaauucaggacgaggucagaguguggagaaguugagucuuaaacccugcaugggauuuagaugggcagagaaguguuauaugguauuccauucuaagacuguagggacuucaugagccaaggcugaaugaagcgugcucgguauaccugaagucuuaacaucacacagcucaagcaccugguucauggaggcuccucagaccuuugauuugagccauuugacucauugugcacacaagucuaacuaguuuauuccaacucgauucaauuaguuaauaacauaguguagaaaggcaggugugaaacacuguuucucaaccuuuuaaaacccauauuugugcagccaaguuauugucaagcuuuacuugaggcaggagaaucgcuugaacccgggaggcagagguugcaguaagccaagaucgcgccacugcacuccagccuugcaacagcgcgagacucugucucaaaaaaaaaaaaaguuuauuuuuuaccauuuauauaauuaucugaacaugcuuugccaaaccacacaacacaccuacccucaucuugauaaucauugugcuacaggcauauauucugcaaagccagcuguuuucugcgaagucagagaaaguauuaaaaguggauucaauuccgaaauuguccccguauaaaucuguuuauauaaggggaaggaugcgggucacuaaaccuugagaauagcaacuuaccccugggucaguguguuacacauuuaauaaugcagaauuaaaagucauagccguugcccuacagaagcaugcaaccuaagaagaagauagaaaaguaaaccaaaguuauuauuuauuuauuuagagacagggucuggcuuuguggggcccagacugaagugcaguggcgcguucucagcucgcugcuaccuccaccuuucggacucaagcgauccucucgccgcgucagucuccccauauagcugggaauacaggcgcgcaccacugcacccugcuuauuuuuuuuguagaaaugggguuuaaccauguugcccaggcuggucucaaacuccuggguucaagguaucugcccaccucaaccuuccaaagugcuggaauuacaggcaugagccaccaugccugguccgaaauuauaauucacuguguucauggugaaauagaggcguguucaggguuuugggaauucagagaacagaggauuggggaggucaggggacagcuuccuggaaacgugacucuugaacugauaaggauaaguaagccagggccuuccaugaaagaggucagcuuauaggagcauaagagcuugguaccuuauuggcuaaagcauggacccuguguucucaauaaagagcaaauuauauuuaauguguucaguuuaagaaggcagggaagugugaaauaguuuuucccauaacaacucauuagugaggguaucaaaaagccaggguuuacuuuacauauauuuuaguuugcucauaaaauccuccugcuuaauuuauuuagaaauaugaaaccggggauuguaaaaaaguggaaaauuauuuuuuccauuaagaaccaaagaugucucagaggaaaaggaaguauucuauugauacucauacucccucuuuacuuugcaacuauguauuacauacuaaaauuuauuugguaguugauagauaaauguaauugagaauucccaucaacauaccaaaagcauuguugcucaguaaguuagaugggugugucaugccucccaaaugguuggaauaaguccucccauggccuaaaaguuuuaauuuuguguacugcuucagaaauauguaauaggcuguguuuuaaauuuauaauuaugaaacaaaaacacauuuuguuuagcauuuucucauuuuugagauucacuuuccagaguacccuucccacacacaaucuaugaccaccucuuauugauucugcuuccuaaaugcagcuuucuuaaauagguucuauuucucuccaguccaacuagaauacugucuuuguaaucggaauucaacaagaccccuuaucuggucucucugcauucagucuuaacccucucaaauucauucuuuccucugcauccggaaguuguuuuaauugcagaguuccaugaaacccucucaguaucuuccuuugcccuuaggauaaccuccuacacuuaacuugguugaauauguuccauugccugccucacucuuuuuugccuggcuaauuucuucauauauuucagaucucugucuaaauaacacuucuucagggccucguugaauuaaguaccccuguuauauauuugauggcauacuuccuauuuguagcacuuguaauuauuggcgugugucuguccucccccauguagauucuguguaaauaauugguaaauaauuucugaagguuuaucaaggucuauggauacccuugagaaaagauuaaagagugaaauuaaagagauuacaauaagcaguaaccauugaaguaaaaaaggaaugauagcuaccuuuuauaaagcaauuauugugugccaggcaaugugcuaaguauuugcuauguaguuucccauuuaauccuuugauccaggugacaguauucccauuuuacagacaaaaaaugugagcuucagggaggugaaguaaguggcuuaaaguuagcauggauuaaaaaugauagagccaagaucgaaacccagguuucccuguuauuuagugaggguaggaacucuagcacccugcaccaugccuagguuaucucuuaaaaaaaaagaagguagagugcauacagaaaauauauucaaggcuauuuuuaaaaauuagcuuuaaaugcaagugugguucaauuaagaucuucaggccaggugcagugguucaugacuguaaucccagcacuuugggaggcggaggcaggcagauggcuugagaucaggaguucuagaccagccugagcaacauggcaaaaccugucuuuacaaaagauacaaaaacuagcugagcgucguggcaugugccuguagucccagcuacuugaggggcugaggcaggaggaucacuugcgccuagaagguugaggcuggagugagcugugauggcaccacugcauuacaaccugggugacaaaaugagacccuaucucaaaaacaaaaaacaaaaaaaaguuuuuaagguuauugguuaaaaaaaaauuuuuuuuaaguuugaggacuuucuugaugagcuaaaggcccccauaucagagcauacuaauuuggugcugaaguuaguauuuuuuaucuuccaaauuuagcuccugugauaccauuuauaauucucuaacuuugcacaucacccucuugguggcuuuucacacacccacaugaaaacaauggaugccauuauaacguaauacuuggguaucuccuucuuagauaccaacucagaggauuucaguggcuuuccguauuuauaauaugcaauauucaggcagcuuuauuuaacugaagaaaacucauuggcauuuucaguuaaccagaaucauuuuagaaagcagaggaaaauuagaaauauaucuuuuaaauuagcacauuuuagagcauguucuguuauuuguauagauugagccuaacugaguacgcugauggccaguucagcuaaggauagaaacuggaauucacaaagguccuuaccgaaagaacauggaacaaaaaauucugagcacguugacagaaauuaaguuugaaacaucauggccaggaacccagucauuuaaauagaugaagagucaagcgaauaaaauaauccaaagcaguucaagaaugcagccuguguguuguacuuccuacagauaguaccugagauggagagaaucuucuggcuuauucagucaacaaagauuuuuuaugcaaccacaguauacccuuggcauucacaauuuuaacgcuuuccauuuuaaccauuacauuugaccccugugacauggaauuauuuauaauuuugcugagacacaaauuugaaugugacuuuaagauuaauguuaauccuuugggaggggccugagugccucagaauccauggcgcucugcagaggccggcuuguuaaaagucuuaaaggaaggucauuuaaaugcuuguuauacuauacuuauuaaauuugaaggagaaaauuacaugcuguaguuguguuuacaaauuuuaaaacuugagaaggccacgaaauacauucuucaguggucuuugcuccuuuguucaaaaugcuguuucauuucuacuggcucaaacuuuuaacuugccauuucuccugggaaaacagauggagcaaagaaaugaauucauggacugcucccaguggaagacaaguaaaacaccgagugcaauuguagauuauguagaagauugcuugaaaggggcaaauccugccccaaggucaguuuaagaaaucauuagaaaggggcgugguuaauccucaccuuggaucugagaguguuggauucuuccuccaguuuacaugguuguagaauccuguuggcuuccuagguuguacaugaaaacaggaaaucucgggcuauaaauuacaagcccucaacauuuuaucggugcuugauucaacuauugcaguacaaauuguuaaaaugucagcuugacuucacugucuuuucuguuuuucuuugcugguuaauaagagugcccuccugugucuuuaggauguaaugucauuucaagcuuuucaaaggucauauuuuaucauaaccucaauagguuuuuuccuucaugauuuccucaaacucugaaaagcugcgugugacauaaggcuaaguuacauaccuuucucaguaauggucugugauaaagauggauauuuuacucuuaggcauuucagaguccaaaauuauuauucugaagauuaaauauuuuauacuuaacaaggcaaaaaaauauaucgggccaagcacaguggcucacaccuguaauccuagcacuucaggaagcugaggaggaggaucacuugagcccagguguuccagaccagccugggcaacauagugagacccugucuguacaaaaaaaacuaaaaauuagcuaggccuggugucuugugcccguagucccagcuacucaguaggcugaggugagagguuugcuugagcccagggauuugagguuacagugagcugauugcaccucugcacucuagccugagugacagaacaaggcccugucuccaaccaaaaaaaaaaaaaaaaaaaaaaaaaaaaaagauacacugaugacagacuuuugguaguaguaguugaauugaaaaaaaaaaucuggcuuaccuauggucaaucagcaaagccagaagacuguacuaauagaaguauuacagcauuacucuugcuauaaccacgguaccacaguagcauauuuguuuugugacugguuugcucugaguacucauaucccucuggcauuugcucugauguucagcaauauuuaguuaacaguucacaagggcccagguugcagcauggccaccaagucauuccacauggaaaauacacuccugguuugcugaacaccagcagagguccaggcauaaaccaacccucaggucuccaucauucauguauuuacucaacaaaucuucugaacaccugcucuguaccaggcauugcucaagauacuaagcauauugcagugaacaaaacagauuuauccccagccuauauggaacgugaagccuaguggguuuacuguccaauucaagcaguauuacauugaauguccugauuagagauacccuugggcucaggcucaaauauuuuuguuacauguaauggucaaaacuguauuuaauuguauccaguaauaugcuuucugaaaauuuuaacagauaaggccaaauugcucacuaguuuuccauuguacagguaguauaugagaaugcauuuuccccacccuugccaaugaugcuguuucuuuacuuuuacuauuugucuucugaauguaacuuucuucuuugaucuauccucacaugcucucagucuacuauagacuucauccguguuuaguaaagugucccuggaguagugauugcagacgugggaagauggaccagaaaggggaacacauuucuucagauaaaaauauggugccauaagaaucuucaaaaggaagcuuguaaaagaucuaugguguugcuuuggaaaugccagugcauagauguaggaauuaagaugaugguacugugagaucagacagauuggagaggcagcuggggaaguguggguagauggcagaggaaauccccuauacuccccagaaaggggaaggccagugagaggaagccuggaguugacacaucaggcagggcuaagaaagggguacgugccagaaauuugcagggaucgcaagaaaaggcaagaguaggaaaagaaaggacaggaagggaaaauagagaagacccugcaagagaaaggcacuggcuugaaagucgcaaguugcucagugaucaagacuaguaacuguguggugggaacuuuacugugagaaaaacaacagguuuaaauggccccugauuuaccaugaauuugaaggaaaugccucaaagauuuaaaauguuuaaauuuauugaaagcacauuugaaugaacuuuuagcucucucaaagacagguaaucagacaaaugauguucaagaaagcuauucuuuaauagguauuguaaaacuaacaccuuuuuuggcuuuaggguaguuuauuucucaucacugauguuuaugaagaggugggggagguguauaauaagaugucuugcauaauccauuucucagauuuauggcuuaaucagagucucuuuuucuaaauacauuaugucuacauuuuucuuuuuuuuuuucuuuuuuuuuuuuuuuagcuguuaauaucgcuugcauauauuucuuuuuuuuuuauuuuauuuuauuuuauuucuauuuuuuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuucggccuuccgcaguguuugugucccuggguacuuaagauuagggaguggugaugacucuuaacgagcaugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagaauuuuucugaguacagaacaaaaugaaaagucucccaugucuacuucuauccacacagacccggcaaccauccgauuucucaauuuuuuccccacccuucccgccuuucuauuccacaaaaccgccauugucaucauggcccauccccaaugagccgcugggcacaccucccagacggggucguggccgggcagaggggcuccucacuucccagugggggcggccgggcagaagcgccccucaccucccggauggggcggcuggccgggcggggggcugacccccccaccacccucccggacggggcggcuggccaggcagaggggcuccucacuucccaguaggggcggccgggcagaggcgccccucaccucccggacggggcggccggccggaaggggggcugacccccccaccucccucccggacggggcggcuggccgggcagaggggcuccucacuucccaguaggggcggccgggcagaggcgccccucaccucccggacggggcggcuggccaggcggggggcugauccccccaccucccucccggacggggcggcuggccgggcggggggcugaccccccccaccucccucccggacggggcggcuggccgggcggggggcugaccccccccuccccccucccggacggggcggcuggccgggcggggggcugacccccccaccucccucccgggcggggcggcuggccgggcagaggggcuccucacuucccaguaggggcggccgggcagaggcgccccucaccucccggacggggcggcuggccaggcggggggcugauccccccaccucccucccggacugggcggcuggccgggcggggggcugacccccccaccucccuccuggacggggcgacuggccgggcagaggggcuccucacuucccaguaggggcggccgggcagaggcgccccucaccucccggacggggcggccagccgggcggggggcugacccccccaccucccucccggacgggguggcugccgggcggagacgcuccucacuucccagacggggugguugccggacggaggggcuccucacuucucagacggggcgguugccaggcagaggguuuccucacuuuucagacggagcggccgggcagagacgcuccucaccucccagacaggguugcggcccagcagaggcgcuccucacaucccagacagggcgguggggcagaggugcuccccacaucucagacgaugggcggccgggcagagacgcuccucacuuccuagaugggauggcggcggggaagaggcgcuccucgcuuccuagaugggauggcggccgggcagagacgcuccucacuuuccagacugggcagccaggcagaggggcuccucauaucccagacgauggguggccaagcagagacgcuccucacuucccagacgggguggcggccgggcagaggcugcaaucucggcucuuugggaggccaaggcaggcggcugggaggugguuguagcgagccgagaucacgccgcugcacuccagccugggcaccauugagcacugagugaacgagacuccaucugcaaucccggcaccucgggaggccgaggcuggcggaucacucgcgguuaggagcuggagaccagcccggccaacacaucgaaaccccgucuccaccaaaaaaaaacgaaaaccagucaggcguggcggcacgcgccugcaaucgcaggcacucggcaggcugaggcaggagaaucaggcagggagguugcagugagcugagauggcagcaguaccguccagcuuuggcucggcaucagagggagaccguggagggagagagagggagagggagagggagagggagagggagagggagagggagagggagagcuaugucuacauuuuucuaugccauuaaaauaaaggcaagcauaaugagauauucuagcuuuauaagucuucuuuccucuauuuuuuuccagcauguggaaauauggguaaaaagcaguaguuuuaauauguaaaugauauuauuauaguuaccuuuuuuuacauuguuuaaacagcuuuuuugagguguaauauguaauauguaaaauucuugcauauaaaacaaaauucaaugacuuuuaguagauuucagaguugugccucauucaccacgauccagauuuagcgcauuuccauuacuccaaaaagaucuccguuacuaccuccaggccucggcaaccacgagucucgguagauuugcccuuucuggucauuuuauguaaauuaacucauuugauauggggucuuuuguggcuaagacaucuucuuucauuugguguaauguuucugaaguucguucaugugguagcauauaucaguuguuucuuuuuucuugcugaauaauauuuuccucuauggguacucuccauuuuguuuauuccugcaccaggugauggacauuugaauuguuucugcuuuuuggcuguuaugacuguguggacauaaguuuucauuuccaauuucuccauguuuucacuucuuuuucuugcaugauuguacuagcuagacccuccaguacaguguugaauagagguaguacaagcaggcaucauugauuuguuccucaucuuaggaagaaaauauucaguuguucacuccuaaauaugaugugaacuguacguuuuucauagaugcccuguaucaggcugaugauauucccuucuauccagcuuguugaguauuuuuaucguaaaugguucuuggauuuuguaagaugcuuuuccuucaucuaucaaggugaucaugugguuuuugucuuuauauuaauauauuacuuuaauugaauuuugaauguuaaaccagacuugcauuccuggaauaaauuccacuugaucaugguguuuaaucuuuuguauauguugcuggauuugguuugcuaacauuuuguugaggauguuuguguauauauucaugaaggauauuggucuguaguucucuugugauaucuuuguuugacauugguaucagguaauauuguucucauagaaugcguuggaaaauguuuccucuuccucuguaccuccucuauguucuacaagaguguaugaagaauuaguauuauuuccucuuuaauuuuuuuuuuuuuugagacgaagucucacucugucacccaggccggagugcggugggcaaucuuggcucacugcaaucucuaccucccgggcucaagcgauucucaugccucagccuccagaauagcugguacuacagguaccugccaccacaccuggcuaauuuuuguauuuuuaguagagacaggguuuuuccauguuggucaggcuggucucgaacuccugaccucaaguuaccuggccgccuuggggccucccaaagugcugggauuauaggcgugagccaccgcgccuggcccaacauuuuuuuuuaaguaaacuauacaagaguuuuuuguuuuguuuuuuuuuuaaaaaaaaaaaaacagugaaggccaggcacaguggcugacaccuauaaucccagcacuuugggaggccaaggcaggaggaucacuugagcucgcaaguuugaguccagccugggcaacacagucagacccugucucuacaaaaaaacaauuuuuuuuuuuuuuuagcuggaugugguggcacacaccuguagucccagcuacucaagaggcugagguaggagguccacuugagcccaggaggucgaggcuacaguuaaccaugaucgcuccacugcacuccagccugagcaacagagugagaccguauuucaaaaaacaaaaacaguuaaaugauucccucccacucuuucagucuuuauccuccuuuccagaaggaaucucaguuaucaguuuccuuuguauuuuucaaagauauucuguggauuuuuguacauguauauaguuuucaucccuauuuuauuuuuuacaaaaauaaugagauauuauccacauugguuuggcauauugauuuuucuuuuuuaaguuagagaugugucuuuaagauuauuucauauaaauaucuagaacuaccucauuuuguaagacugcauaccuauaccuaaugaacagaaucugcauuuaacaagaucccaguucuuuugguuucaagauacuuuuuucugaacaaugagauauuuucaauacugcuuucaaauacuuuuagaaaauauuucuaacacccuuuguauuuucguugcuuguaggaagcauuuagaauuguggauauuugccugaaagauauuguuccaccaccaacacccucccccaacuauuuuaaaaaucauucaugauuaaaguuuagggcaugguuuuuguuguugauuuaaaacauaauuaugaaacuagugucaauauaucucaaaaauacauucauacuguugcuaaaagaaaaaccgguugcauaguguucuguuguuuaaauauaccauaauuuaucuaaccaaacuucuaucaauuaacauuguuuccagucucuugcaauuacaacucacauuuuacagauuaucuccuuuuugagccucuuagggaguacaucuguagcauacauuucuacuggugaaauugaugguucaaaggguauaugcauuuuuuauuaagguuuauugcaaaaaugcucccauagagauuuaucaaauugcaguugccaguagcauauccuaaugcuuaccacuacaauguaaugaucaaacuuguuuuuuucucacugaaaagugaaaaaauauuaugucauuauauuuuaaauuugauuuuucucacauuauguaugcaauguggagcauauuuuuauauauuuauaaaagcauuuguauuuccauuuccugcucaguucucuuccucuugaucuauuaauauuccaguaguaaacuauuuuacccuauguaguucuggaguauauuuuaauaucuuauaguauuuguuccuguucauugaccugugccucagaauuuuccaggcugcucucagacauuuauuuuuuuguauaaaacuuagauuuuuacauuuuguauaaauuuagaauuauuaguucacaguaaaauccuuuuuguguuuuuauugggaucagauugaauuuauaaaauuuaaggagagaauugacuaauuucuuuuacuguaucauugagucuaagaauaagacaugucuuuuccuuuauuucuuuuuuuaaauguuucuuuguagcauuuuaaaaccuuuugcuaauauagcuuuuagauauuuauuguuaaaucuguaucuaaauacuuuaucuuuuugauuguuacugaaaucuuuuccugugugguuuucauauaagaaggcuauuuauuuauuguguucacuacacaggccccuuguugaauuuuaauuuuuaauacccuuuccaguugauucucauggguuuuccaggugcauaacuuugcagauuuuuuuuuuacacuucauuucuuucucugauguaauugcaguggcuuauacgugcagaaugauuuggaauaggaguuuugguaguaggcgucucuauuucugauuagagugggcauucuuuuuaaacuuaucaggugacugugauacugacuuuuggcuugaaauuuuuauguauuuuaauuuacgugcuguagcugacugcuuucuuguuccuuaauuuucuagucauuaguaaagagagacucuuuuacauagccuaacaauaaguuauuuuucuaaagagaaaauguauuuguguuuuauuguguguccuaggcaguuaauuauaucuuguaagcccuuuccagacuuuugaguaaacaauggauuuuauaacuuaaagucuuagguggugcauaacagacucauagaaauaauggauuucuacacaugaucccuagccaaaacacagggaagaaaugaguaauagauuucuaugaccuuaaaagaaaauugcaagguuuccuuggaaaacagaacagccagaaauaguuucucuguacuucagagauaggccugauaaacccaagaaauguaaacaaucaaucuguuaaaauaaacguaauggccacccacacacaccccccaaaaaaaaaucuccauagaaacaaaaaggggcucagagcccuaagugguggcuuauuuuuaaaugguuuucgauugaagcuauguauccaguaggaggaaacuguugaugacuauguugaugacugugugauaguuauagcuaacagauaagagaagcaauaacaaaaauccauuguuuggcuauacaauugaacaaauguuauuaaaugccuaucuuguacaaaacauucucagugcucugagacauaaagaugaauaagacauagauccuaccuaucaguaacucacuauugaacaaacuguguauauucaauguaugugauugagaauauaacguuuuggugauagccccugauacaggcaguggggaccuauguaagguuaggauuauagaagguuaaucuuaucagggguggguagggggagggagagcaucaggaagaauagcuaauggauucugggcuuaauaccuaggugauggguugauuuuuugcagcaaaccacgauggcacacauuuaccuauguaacaaaccuguacguccuauacauguacccuugagcuuaaaaguugaaagaaaaaaaaagaugaaugccaaugggagaaucacaguucccuagagaggcaaaaucugaacugaccuugaaaaguacuuugauaaguauuuucaagaaggaguguuauguguuauuacaaguagaaggaacaguuaaaguaaaaauaauuuggagaaguuccauuuccccagugauguauguguacaauuuauuauguauuuuuuuugcuuuguagugcucuguagcaguguguacaaaaauggauacauuucccccaagacauccuccuauuuggauaguucagaauaucaacuacugauaugguuggaucugugucuccacgcaaaucucaucuuguagcucccauaauccccacguguugugggagggauuggugggagaugguugaaucaugggggcgggucuuuccugagcuguucucaugauagcaaaugugucucacaagaucugaugguuuuaaaaaagggagucucccugcacaagcucucucuuugccugcugacauccauguaagaugugacuugcuccuccuugccuuauguaaugauugugagaccuucccagccacguggaacuguaaguccucuuuuguaaacugcccaaucucagguaugucuuuaucagcagugugaaaacggacuaauacagcuacucaugaaauuaguuucauuauaauguuauuaacaucugaaagauuuguguauuugauuggaacaacagaucacuauaaguggggcaggggcagaccuaauaaaugucuuagaagggaaaguuaggcaaauugaagcaaaagcaugguggguuuuacuacaagacuuagugguuuagacaguaaagaauaagaauuauggggguucucuguuuuccaggaaaaguuucaaggaaguuuaagaguuuaaaguggccgggugcaguggcucaugccuguaauccuagcacuuugggaagcugagacaggcagaucacgaggucaggagaucgagaccauccugacuaacacagugaaaccccaucucuacuaaaaaaaaauacaaaaaauuagccgggcaugguggcaggugccuguagucucagcuacucgggaggcugagguaggagaauggcaugaaccugggaagaggagcuugcagugagccgaggucacgccacugcacuccagcuugggugacagagcgagacucugucucaaaacaaaaaaaaaaaaacaguuuaaauaugaauuuuuaaacauguagagccuuuaauuuuuucccuuuggaaaucugggaccaaggaguuaaaagagcuuuauuuuacacaauuaagaaaaacuggaaugugaaaucagaaaguaugacuucauugcaguuacagaaaauauuuaggaaagugacauauaaucaaaacaagaagaauuagggagcuuagcaaaugcaucaaagcaaauuccaagucagaauuaccuacauaggagaaaagauauuuuuuagcacuuugcagaagaccucggaagcaguaacagaauccacaaauacaccagggggcaaaaggcaucccaacaaucagugggaccaguugaugauauaguaugagaagaauguccagauaugaauaaggagggaagagaaaccuuaaagaauuccuugacuuucaucucuguugaggaagagauagugggaaggggggauccucuucuuccagaacugauaaauacauauucucagucacaucgacauguugaguauagacaaauuacuagaaaguauguugcaguccucagggugcuuguuugguuuuagguauacuuuucauucaguucaacuagcauaagcuucaagcauacauacagcuugaugaauuuuuaccuauauaugcauccauguauucaugaucaaaauuaagauauagaacauuuccaccaacuuuguuuccuucccagucaauaauuuucccuccaguuaaucacuauucugacuuacaucacugugucucacauuugccuauucuugaacuucauuuaaauggaacuauaccuuaugucucauuugugucuggcuucuuuaauucaacauuauguugaccugaaaguuuuaaagggugaaauuguugaauaugucaccugucugcaaauagcaacuugguagaggacuggcaaacugccuuucauccauaaauucauccauaaauccauuauggaaaaucuauccauaaagauaaaugaccaucuuuaugugggguucuucaggaaaccuuaagaaauucagccuaguaaaaccuauuugugugccuggcaggcugcugagauucagugguaaacugucaggcaauauaguuguuuuucaaaagaaaucaaucugacuaaacuaaugagaguucuuucaaggaacuaaguaaaagaaagcuucuauuuuuuuaacacauuuuuagaaaacuuuucucaaaauaaaaauaacuguuacagaaucaauacguauuacuguaagaaaaaauuuucagaauauacuucugaguccugagaggcauaaagaaaaaaaaaaaaucaccuguaaucucaccaccucaaauaaucagucauuaugguauaccugcuaggaugggugugugcagugauaccuucugugugagucacccuaaaacuguacaccaguuaggauuagauucagcucugagugacagaaagccugaaguaaugguggcuuaaacaggauaaauguuuacaucucuguuguguaaaugaugugcugaguuaaauaguccagggcugguguggcagguccaggcucuccugauagcuuguagcuccaccaucuguaauccaugacuuccucuuugugauccaauaugacuaccagcucaggccaucauaucccuauucuagucaguaggaaggaggaagggacaaagaaagccauguccucucccuuugacacuuugagaaaguuguguacacuacuucuauuuauaccuuccugaccagcauuuucuuacauggcuacaucuaguugcagucaagucuagcaaauaguuuuuauuccagguggccauaauuacagcuaagacauggauucuaauuuaaaaaggagaagagacauauaguuaaugagagacaaugcucauaagcuuuuucauuuggaacauuuauguaguucauuuugaguauguuuauaguauaacauuguguggacauauucuacuguugaaauuuugguuuuuauucccuacugucccacacagugcugaugaaaauauacuguuuagauuguuugcacccaucuaguuacuguauuuguuuauuguaaauuccuaaguggaauuucuuguucaaagacuauacaugcacauuuuaaacucugaugcaauauugcuuuucaggacugcuuuaguuuuuacccauagaguaaaugagaguuuccacuuccccacaaccucaucuuuggcuucuuugccaauguauggacugggcauuuuaugucaguauaguuuuaaauuacacuuuuauuucuucuggguuucuguuuugcauuucucuuacaucuuuacauauguuuuuucacucauuuguauuucaugaauugacugugcuuuuugcacauuuuucuguuggaaucuuacucauuucuuagagcucuuuauauauuaaggauaucaauuuuuugucuugguuuuauaaauauuauuuucccagauaaucuuuuaccuuauucaaaguaguuuuucucauagaaaaguccuuaguauaaguaaucuagucuaucaguauuuucucccaagaucauggcuuuaggaucaugccuuaaaaguucuuuccuaggucaggcaugauggcucacaccuguaaucccagcauuuuggaaggccgaggugagcggauugcuugagcccaggaguucaggaccagccugggcaacauagugaggcuucaucuccacaaaaaaauacaaaaauuugccagguauaauggcuugcaucuguagucccagcuacuuaggaggcugaggugggaggauugcuugagcccagaagguugaggcugcggugagccguaaucauaucacugcacugcagccugggcaauagagugagacccugucucaaaaaaaaaguuaucuccuaccccagaauuauauuaaauauuucccuaaaauuuuagaaauuccuugcucagauuccauaauaaagauuuucaaagaaguauuuuaucauggaccaagguaaacugaaaaucaaaauuuaacuaguuccuccaguaaguauggcucucccuucugccuaaucuguaggaucagcauacauuagugaagaagcuacugcuuccguucucucccaaagucucuaccaaaugguagagacaaacggaagcucuuuccuuugcugacuccuaacuuacuaccggugugacuaguaagaaguuuuuccauugaaaagccuuuucucagcccuaguacuuagccagucagccugguuuuugugccuacauaaaugcaugugaauaacccagcaugaaguaagugauuaauaaauguucgcugucuuuaaaaacuuaauuuaucaaaagcuguuuggaaauccguuucuuugaaaaucugaagugacuaaagggguguaaacuucuccccacccccaacucuugauccacacagaagcauauuuguucaaagauugaaacuaggcaugcucuccuccuugcugaaacguauuauaccaggcaucuucccccuaaauaaaacacuuuugucugcguugaaagucuguugaguuagggaaccccuuccugauugucuucacaauugugaccagcaacucccuaguauuucugcucuaugcuuuaugauugauuuugauguccagauuuuucuaaaccuugaaacuugaaccauugcauuuauaugugguuugaagagagaaaagaaagcauauuucuaacaugcuagaauaaauucuuagcuuacuccugaaccgacauacacuaauaagucucccuucuugaugcugauccucuagccauuuacaaguuuuaccauuucguuaaccauuuuucuuucuugcaaguugccauuguugcacauuuucagcaauuuguauaaauuauauuguccuuaaaaacuuuguugccaauagaaacuucucugguagugacucuauucaaaaaaaaaaaaaaaaaaaaaagcuuuuuucugauucuaaaaaaaaaaaaaaugguuaauguuuaaaagaaguaguagucaaggauacagaaguaucuaaguagaaagugagaguuccaguaugaucaaccacucgccccugugguaaccacuucaaucaguuuggugugugugcuuacagucuuuuauacauacauauauauauauguaacaaacagucacauauauaguuccaugaacuuuuuuucaucaacuauaauuacuucuuaacguguauuaagugcugguuccagauagccaaacauguugguuccgaaggcagccccuaccuguuuuccuucccucgcccuuaaugauuuacuaucaacauuuccacccuuccugcgcuucucuuggggaaauuuugcuuuuuaugaccacccucugcugcuugucucauuuucauggaaagccaaguagaggacaggaugagugugagggagcagcccuaaguggcaguuacucagcugugugugauaucuagccacucuucaaccagaaaguggcuuuucuguguucaccaugcaugcuaagauuuucugcacaaguggaaaauuacccuucucuuuuauccagcuguguagucaguuugacagugaguaugauuggcacauuuaacagcucuccugcgagauggaaucaagacacaaaguggaagaaagugaaagauuaccaaauaaaacugaaauguauuuauagaacucugauuguuggagggccuggcccaaaauuccuagcagagguaauuugccuccaaauuaggcaaauuuggcucaguggaagccagcaucucagaauggaguaauauaagguagggaugcucccagccccucugggaaccuuauaugcccuguuaggccauggaguaucuccuagugagcugcauuuacugauggcagcgaauguuuauacuuggauguguuggagaagagaaaaguuuacaagcucuggaagaacaggguuccuuguuucuaaaagaaacauuuaggcugggcaugguggcucagaccuguaaucccagcacuuugggaggccaaggcuggcagaucacuugcuggagcccagaaguucgacaccagccugggcaacauggcaaaaccccaucucuauuuuaaacuuuuugaaagaaaauaauaaaauauuuuuuuuaaaggaagcauuuagaugauguugaaauuaguuccagcuugugcauuguauaguuuuuuacauugucagaaagucaauuuuuuuuuuuugagacagaagucucauucuguagcccaggauggagugcaauggugugaucucugcucacugcaaccucugccuccucaagcuauucuccugccucagccucccaaguagcugggauuaaagguacgugccaccacgcccagcgaauuuuucuauuuuuaguagagacgggguuucgccauguuggccaggcuggucuugaacuccuggccugaggugauccgucucggccucccaaagugcugggauuacagccaugagccaccgcauccagcccagaaagucaguuauaaagagcacaaugucacaaacguguuggugacagguuauauaaaagaggaguuuugacugacccagugaaaugguggaauaaugagaaacaacauuuuuguguuaaaagaaagcuuaaaauaaucuaguuaaaucuccucauuugucagaugaagauauuugagacccauagaauuuagggauucauucaggcuaacaucaauguaucagcaaaguuagaacuaguacuuuaugcugaugucaaaugagcuauuggaugaugugaugcauggguugguuaaauagaaaacggaaaaaauuggugaugucauuuacaacuuacuucauuaacacuauugccuauuuaaaaaaaaaacaguuucuuuaugacugugcaguucucucaagcgagaguaaagagcuauuggcaucaauucagccuagaaguuauagguuacaguacagauaauuaaaggcaguuucaacagcagaacuacuuuacaguaagagaaucuucucacuguuuuugaauggaaaggaaaaccaacaaaagaaaauuacugcuuaugauggauugcagggcaauuuaauaauuuaauuuacuugggaccuuuauugcaucagucagcuaacuaauccucuuuguucagaaccagauuauaaacucaucugcauucuuaccaauucaaaauaaggucuuuuagauuauaccaccucugcaaaaaguaauaugucuuuaggucucugacaaugccuuucauacuguguaacacgguguguaugcuguguuggcuaacuguacugauuccggagcucacuguccagguucaaguccuggcacauuuucuuagaacuuugggaucaugugaauguuuuauacuuccuaugccucauuuuuuucaucuguaaaaugagaaaaugauuccuaccucauggcauucuugggaggauuauaagaguuaaaauauaaaguucuuacagaguacccgauaccuaauaaacaccauagcauaauaacuaugcguauuuuaauuacuuuaaacaagacuagagaaaagaacauagaugauguuuuagucuaugguucuuuuugcaaaaaaaaaaaaacagacuuguuacccaaagucaguucacuaaaauucaauuugucguauuaccaaauugccaaauuuacuaauuugccaaauuuuuuuuaggaaguucacaguauuucauacugcuuuuaaagauuuuugugagauuaaguaguuggcuggcugucauuuuguuuguauagccuuuuuuuuuuuuuuuuuaaucucagcucacugcaaccugugccucccagguucaagugauucuccugucucagccucccaaguagcugggauuaaggcucacgccaccacaccuggcuaauuuuuuuuuguagacggagucuuacucugucaccuaggcuggaguccaguggcacgaucugcauucacugcaaccuccgccuccuggguucaagcgauucuccugccucagcuucccaaguagcuaggauuacaggcacaugccacgacgcccagcuaauuuuuuuucaguugagacaggguuuuaccauguuggucaggcuggucuugaauuccugaccucaagugauccacccgccuuggccucccaaagugcugggauuacaggcaugagccacugcuucuagccuaauuuuuuguauuuuaguagaggugggguuucaccauguugcccaggcaggucuccagcuccugagcucaggcaguccacccaccucggccucucaaagugcuaggauuacaggcaugagccaccacgccuggcuggaaagcagauuuuuuauuuuucuuuucuuuuuugacaguuucgcucugucacccaggcuggagugcaguggugcgaucuuggcucacugcaagcucugccucccggguucacaccagucuccugccucagccuccugaguagccaggacuacaggcucccgccaccaugccuggcuaauuuuuguauuuuuaguagagaugagguuucaccguguuugccgggauggucucgaucuccugaccucaugacccgcccgccucggccucccaaagugcugggauuacaggcgugagccaccacgccuggccagcagauuuuuaaaguauuagauuugcugaaaccuuaacauaauaugauuuaaucuuguuaguaauaaauguaacauucaaaaugcguauuucaagauugauaaccaagaaacucccaaggacuguauacaguacuaguacucagugaaaagaguacuaggaaaauuucauuuguuugccccuggggucuguaaggaagcucgucucugcaaggagcuugggccagugcuuuaagaguguugagagucugacgcguaugcuccccuuauaguacagauauauaagcugagaaaucaacauaaaauggucucaaaauggugacauuuauugcggaccggccccaacccauuccucauagagcucccacagaauucccacaaagcccuacuaaaaaugagcucaccaugcaaauuguuaaaggaucugaaauccaccaugaguuaggaugaguagucauaauaagacuaccaagaacuucagaaaaucguguaacauggagacucuuaauaugugaaagugauuuaaaggcauguaugaaggaaugcaaaccuuugaaaagaauaagaugcuguuuucaauaaggaaagaggacuucuagauuugaaaaacauagucacuaggaagaaaauuucaguauuuaacccauuggcuaaauagcagauuugacaccacuaaagaaagaauuagcaaaauguaagauaaaucugaagaaaauacccagaaugcacuauacauugcaaaaaaaaaaaugauaauuuagucacagggaggggggaguaaaaugaaacauuaccacaugcauuuaauaggcauuccagaaguagaaacuagaaaaaauggagagaggccguauucaaagugaucauggcugacaguauuuuucacaguugugaaagacgaguuauguguuagaagcauaaaccaaaaggaaaguaaguuauaccucauacccgugcacaucuuuuugaaaaaucagagcaccaacaacaaagagaauauuuuaauagcagcuuaaaacaccaccuagacuggcagcagauuucuccccagaaaucuuuguaauucugucaaauuuugcuucauguauuuugaggcuacguugcuuguacauaagugucacaguuauuauauauuaccagugaacuguuuaugauuaugugauaaucuuuaucuuaaaaucuauuuccaaguuuuuaaaaauuuuacuuuuuuuuuuuuuuuuagagauggggucuagcucuguugcccaggcuggagugcaguggcaugaucacagcacacuguagccuucaacuccugggcaugagcaguccucuugccucaaccucccaaguagcugggcuauuucuaaauaggcuucuagguuuauuuauaaaucguauagauacaucuacuuuuuuuaauucagugaaucauugucuaauguguuuuuuuuaaaauaaaauuuuauaucugcacaguuaaaaaugaaucaaauaguuuuacaaacuguaaaaacucucaguccccaguucccaaauuuaagagguaaccuuuuugacucugcuaguuaccuuuauauuuuucaauaauaugauuauacuguuauuucuugauuuucaaguuuuaguuauuaugauuuuuuguuuuuauuuuuucuucugauucucugagauuuuuuuacuaugaaaacugacuacaaguugaaacuuuguuuuuuuuuuuuuuuugagacggugucucacugugucucugaggagggagugcaguggugcaaucucagcucacugcaaccuccgccuccuggguuuaagcuauucuccugccucagccucccggguagcugggauuacaggugugcaccaccaugcugggcuaaucacucaagugauccacgugccucagccucccaaaauguuaggauuacaggcgugagccaccgcaucuggccaaguugaagcuuugauguuuuauaaccaagauauguacaacaggauuccauaucucauucucacgcacaugaagacaaaugauaaauuucuuacacuagaugaaaggaauuucaaagaaaaaagaaauuaguauaauaauauaaugcacuguucagucccaucauuaaagcacuguguuaugauuucucauuguugcuguuuuucucagugguauguaaauaaaagacagacauguuuuaaucauauuuuagagucaaugaauuauuugacuuuuaaaauacuuauuauuuaacaauauuuuaaccaauuuauuugcucaccaauccuucuuguaucucauuucuucugaguucaacucccuucuuccugaaauauaaucuugaauauaccuccuucagugaugguguugaaauagugaauucuuaguuacuauuggucugaaaaugucuuaacuuuacuucucaacaaugaugguguuggaauuaugggcuagcaaauuaccuuaaaaccccaaagauacuacuccaauugucuucuggcaucuguugugugccaccacaccuggcuaauuuuuuuuauuuuuuguacagacagggucucacuguguuguccagacucgccuggaacucuuggccuuaaguuauccuccugccuugaccucccagugugcugggauuauaggcaugagccgccaugccugcccauaauaaaagcuuuuuaaugaaaauaacagaaugagaaauauauacacuaaguauaacugauaaaauuuuuauucaaaaaauauaaauaauguuuaucuuacccauauguaacuuucaaaaccauuuuccacuuauucuaugaaaaaaaggcacacagggaaauacagauacuauaguagucccuccauacccacagcagauaacgucuaauacaauauaauugcugugcaaguaguuguacauugcuuuuuguuuguuuguuuuuguuuuuguuuuuugagacagaguuuugcucugucacccaggcuggugugcaguggcgugaucucaacucacugcaaccucugccuccugggcucaaaugauucuccugccucagccuuagccucacaaguagcugggauuacaggcacucgccaccaugcccagcuaauuuuuguaucuuuaguagagacaagguuucaccguauuggucaggcuggucuugaacuccugaccucaggugaucuucccgccuuggccucccaaagugcugggauuacaggagugagcuaccacgcccaggcugcauuuuaaaauuuauauaacuuuugcuguauuguuauauuuuauuacuuguaguuuuaucuuuucagauauuuuuccauuuguaguugguugaauccuggaugcagaagccauggauauggagagccaacuguagauugugaucacagaaaaacuuguagcuuuuuaauuaaguaggaauaaaaugaacaugaaagcauugcuaugggcuuguuaagcuagaaaaaaauaaagauuauucuguacuuacuaguggaucuaucuuccugaagagcagaccagcaaaaugggaacuauuuauaaaauuguucauucacuucaccuagucuuaggggauacacauguaaagauguuagugaaugccgcuguagaauauaaauuacuccauccaaacuuaaaugaccucuucagccccuuaaugauuuuauaacugauaguaacuaagagcacuuacuguguaccaggcaguguauccauucauuuaguccucccagcaacucugcuacaaggauagguucuauuacugcaccuuaacaguccaaaguuaaguaacuuucccaaaaucacacauuaacacugagugcagccaagauuugagcccaggcagucuuaacuucaaacucccuacuucauaucauugcaccaaacugccucucagaacuaaagccacuuaucaaauaguuaacuuuccuugguuagggucauuuaauuaccucuacauggcuacuacuagggugauagcugcauuucaguacagauucuaaaugguuuugaauauaaugcucauggguuugagcagugaaacagaucuucugauauauuaccaaugacauuguaaauaaguacaguccuuuuuggaaagcauuuuggcagauugaaagagccauaaaauacucaucuuuuuugacccaguuagugcuacuucugggaaucaucuuaaaaaaauaguccaguauggaaaaagacuuacgcacuaaagugaucaccacagccaugcuugugauaguagggugacaggaaacaacccucaauguucaacaauaagggaaugaaugaccaaacaaaccaugguauauuuacuuaggccaauaaaaauuaagugucauguaacaugaggaaaacauagucaucaagaguugaagcagcacacacagcagugugaauacuaaaauuacagcuuuuacaaauaugaaaaaagauggaauauaaaaaugauaaucagauuggugugauuguagauaauuuuauuuccauaauuacuuacugguuuugugccuuagucucauaacccucaguagaugauaugcugcuuggugacagaggaagaaaacuggaauugcacaaagagcaucgcuggaggccacagggucugggcccuuugcaagcgccuccuguacaagugugugaaccucaggcagccacucugugcucccgugcacucaguugacccacggugagcagugcaguuugggaagcaugagugggaucuuuggagucagagggaccucgcugugugucuucagcucuucccagaaaagcuucugaaacuggguagagcucaaccuucucaucuauacaaauaaggcgaaugagcucggugccuggcaccuuucgucagugcucugaaaauguuuguuccauucggugguagccguuagcauuccucacuuuggccuuuggccuuuggccuuuaaggacaguaacaaaaguaaagucuuccagcgaacuuucuuugcugaaaucuuuugagcaucagcuuuuaaaaauuuuacauauucuguuuucugguguaccuuauccuccauaauuuagaauuaaggaggaagacaaaaaauauuuugucauucaauguggcuggcuaaauugucuguuuuguuuuaaucacauuuuuuuucugauuauaaaaauguaguaaaagcucauugcugaacuuuuggaaaauggagaaagcugaaagaagaaaaucggacaauaaucuucccacucagaaauaacuguuacacacauuucauuuuauuuucuuccaugcuuuucugaauaucugauuuuuucuuauuuuugaaaggagagauauaggaaagcuuuuccuggaacauuugcuauauuuggagcaaguuuaacaugaugcuuuguguucauuuugagauaguuuaucuuuaacaaauaguucuuagauggggauaaagaccaaguagcaauagggaaccagauggaggguggggacaggaauaucucugucuuaauuaggaggaaaaaauuuucuguaauccugauaccuaucaaagaaggaacuuauguaaaguguaauuaccaaaaucauggauccuagacuucuucaggacaauugcaguuuuaaauaauuuguauuguuuuuaucguaagugccuuauaucuuuucagaucaugaguugugaauuuugguuugguaaaauauaaucaucauacauaaacuuggaaugaagaagcagcuugcaaaauacaacuucuuggcucuuggccuuaccauuuuuagaacaugcaguuuucaaaaaauuaucaguuccuguaacauccucuggagaaaaguggaaaauucauccacuacaaagauagaaccaacagagcaacaaauaccuggaaagacuuagccuaagugacugaggccauauggggcugggcauugauggagcuucacucucacucgugcugucuuugugcuuaaaucaggagagggucgggcgccauggcucacgccuauaaccccagcacuuugggaggccaaggaggcgggcggaucacuugagguuaggaguuugugaccagccuggccaacauggugaaaccccaucucuacuaaaaauacaaaacaaccagccaggcaugguggcagacaccuguaaucccagcuacuugggaggcugaggcaggagaaucgcuugaaccagggaggcggagguugcagugagcugagaucacaccacugcacuccagccuaagcaacagagugagacuccaucucaagggaaaaaaaaaaaaaaggagagaauggacuugcuaguggauucagcacacuguucccuuuguuuucugggcucuguugcucaagggagggcuuuaaaaguugggaaagggucuucuuccauuucuuuucuucggagcagcaauagaauuauuaaagguggcagagcaugucccauauagauauuuucaguguggcagaucugucacugccacaacauugaggagaacaugagaaauguuucgggucaguguguuguguucacucuccuuugaagacaccauuguggcuugugccccuuugacuucugagcucugcugccauaggcaagagauuccuacuugucuggaaguagguucccacacuccugcuuagugucugcacaucagggaagucacuuguccuuuugagucauuucuucugacaagacugagcauaaaccuuuacucaugcuuguuaguuaaccuuucuaaccaguuccucuuugaggaaggucacuuauuuacaaagggagaaaaccauaccuagagcacaguuugaguguccagcuuagaguuucauugacauccacagcuuuagacaguacuuacauacaaaggggaaaaugauaauucaccagugccuugugagaacggaaugaauaaccauagccuugaaaccuucuauuuugaauaacuguggcccauguaaaaccgggcuugccuuggcacccugugaaaagacagaugggugugaucugagaauuuugaguauuuugaacggcuagggaaaguaguccccaagcaguaaaagggcggaaaccacauagaaaguuagcugaacuuaacacgcuggucuuaugagagaagaucgucagaguuauuuaauucacuuuacuuuguaggauucuucuguaauugauuacugaucaaagugauuuaauuuuuuucaguauugccugucagggcacccaaccuuaccaugcaaugugcucaaauucaaaucaaccaccauuauguuggacugcggacuggacaugacuucuacccucaauuuccuuccuuugccacuuguucaaagguaugugcuggugcagccaaagacaaaaugagcuuuaaguuugcugaaaaaugguaccauuaguaugaagguuacuaguaccuaguauauugucguaaguuugcuuuguuuccuuaaaaauguucuuuaucaaaauaauuuccuuuggcugagcugauggaaaguguucuauugauuuauugauuggcuucuuuauuauaacuucuucugagcuucuguaaaauguuccugcaacugcucaguacaacugaggucauguauauuucaucuuucuugcuaauucacauaagagcugguaaauggucaacugcugagcccaagaauugaauuuuagaauuauuuagcagccuuugcagagacuuaacagcauagagucugacauuucuuuuugacaggcaucugugcauuauuuucauacuaagucaacuuuagauuuagaaccacauauguagcccaaguucauaucuuaaaugagacagauugccucaggccuacaauagcacuguuuaugcuuaaauaagacuuugccuuaggaaauugguuucccagcauacuacuauuuagaaacaguuuauagaagaaguggcuaccuuguugaagcaaauauacuuacaguagcaaaaagugacaccacauacaagauaggauauggaaaagcuaucuaaagcagauuuaagagcucaaaagcauaguaagcuggguaagcuuucuaguuuaucucagucauuccugaagacaucacugaguacaaugauuauucacagugauaacccgaugaaccaucuagaaaaauuaucaucagcuauugauuuuucugagauaaggggcacaguaaggugguguaaggauaaagucagagauaauuccagauuacauuuuaugcaaagcagauggaauucaguuauaauuacacccagcauuuagaaauacaugugccacccacagauauugcccaaaaacuggauugggaggagcuuguuuacaugacaauugguuauuuccuaauaaaauggccugauauuauugucuuuuucccccagagagcaaaauguuuguuuguuugauguuucuuaaaaaucugcacuguucuggaccagaggauuuagagaugaacagaauaaccuacuuucccucauggaacuuagucuaucagggagaaagacaucacacagaugaagauuuaauuacacuugugacuagaaaacaaguauauauauuuaggauaauuacuuuaaaaauaaaaucuaagguaccaugagagauuccaaaagggagcccaaccugcucuguggggucaugaauuuccugggugaugagaacuggacgagggcagacaaucccagcugcauguuuucccguuccuguucacucucauccuuacccaguucuacuguucucaugguccuggcucagcacuggaauucucguucccucucuuccccuucccauucuuucacucucagagggaaguucuacuaggagaaugguuagcuauccauaugguuucuuacaaaagaugucuccuuuugcucagaccaggacacgguugccuaaaaugguauuccuggcccucucuauccccucagcugcuuugucuucguagcacuuauuacauuauaaguacauauuuauugucuuucuucuccacuacauguaaguuucauaaaggcagggaauuugguucuccauuguauccccacugccuagaacuauucuuggcaugugguagcuacucaguaaguauuuguuguaugaaugaauugcuuuaucuucucuguauuccauacucgucacuuuuucagaguccuuuuacuauuauaauuaacuaauuaauuaaauuauuauaucuuugguuugucuuggacuuuuccaucuugucauuuaauuauaaucauucacuuuuaacuuaaaauuuaaaaaacaauuuuugaccuucucucaauucguuuuuccccuucagcauuucuaaacccuguccagucuucacucugcccacaccacuccacuagaaccucuuaggccccacaugacuuccauguuauuagaugugaugggcauuugucaguccucaucuuauuugaccauucagcagcacugaccuccaugauaaugcauuccugguuuuccucuuaccucugugacccuucuuucucuguauacuuuggagauguguuuuccucuaauuggccaucauguauugacaucuucgguguucauugcuuggccccaucauauucuccacuaagggcauuuaauaaaugcucagcacuauucauaauaguaaagacauggaagcaacuuaagugccccucagcaguggacuggauaaagaaaaugugguacauauacaccauggaauacuacccagccauaaaaaaagaaugaaaucaugcccuuugcagugacauggaugcaacuggaggccauuauucuuggugaauuaacacaagaauagaaaaccaaauaccgcauguucucauuuguaagugggagcuaaacauuggguucacguggacauaaagauggcaacaguagacacuggggacugcuagaagggcuagauaaggaggggccaaggauugaaaaacuaacucuuggcuacuaugcucacuaccugggugacaggaucaguuguaccccaaaccucagcauaaugaaauauaaccagguaacaaaccugcacauguacccuaugaaucuaaauacaaguugaaauaacaaaaaguaaauugcucagagcugcaauaaccguccaaacagcaacuuacaaauguguaucuuuaguuaguaacucuuuuccaaguuccagauugauguguccaaaaugccuaccaaaaauuuuaaaauuagcuaggcaugguggugugugccuguaguccuagcugacuugggagguugaggcaggaggaucacuugagcccagagagucgaggcugcagugagccaugauugugccaccgcacuccagcuugggugacagagagagagagagaccgugucucaaaaaaacaacaacaaaaacaaaauucaacaugcccucaaaccuuuuuucaugaucagacuggguccagaagaggaaaauguauccuuccagauaggguuuucuucaaguuccuaucuuaguaaaugguauccuuuuauaaaaaccagaaaacugggaguuaacuuugauucagcccucuuccucccugcuccauauucagucuuugauuaagccuugacacuuuuaccuucuaaauaguucuaaaauccagucacuucucuucagugcugcuguagucauucucgucuuuuauagguaucauuacuaaagccuccucaccaguuucaucaauucucaucuugacccugucucaaucaagagucaucuuuuuugugugacuuuuuauuugaaauccuacagauuuacagaaaagcugcaaaaauaguacaagcaauuccuaauugccuuuaccaauuuauuggcauuuuaacaaauuugcuuuaucauuuccucuugguauguauacacauaauuuuuuucugacccauuugagagugagaugcaggcaugauccuccucacccauaaaugcuuaaguauauuuccaaagagcaaggacauccucuaacauaaccaugguacaaaaaucaaaaucagagaauuuacauugauaguauaccagugucuaaucuguauaccuuauacauaugucugcacuuuuaccaagucauaauucacuauguaacccguuauagcaaaagagaaaaaugguaauuucugguccaggaucucauccacaucccauccacauugcauuuagcugucauuucuucagacuccuuuaaucuggaagacuuucccaguccgucuuuuaugaccuugagguuuuuaagaguauggccaauuauuucauauaacgacuuucaauuuggguuugucuaauguucccucaugauuagguugggguuacuguuuuugguaggaauaccaugccaaugauaguaucuauuaucagaaggcacaugguuccauuuuccccacagucaucuuguagaagcacaaaucaaauuuuaucuuacuuguuuaaaaccuuucagugguuuuucauugcucuuaggauaaacaccacacucaucucaguguaucaggcuucacgccugccccuccaguaccuucuguauacucugccucuuguucuuuguuuccuucuauuaaauaguuucaaagaaaucuucugacuccuucagagcagucacauguauuguuucuccagcuuggaagacucugugagaucaucuaugacuacaguuuugauguaggaaggacauaaugauggggacuagcuggauggggacugggagggagugucuuggaaucugcucaaaguuccaugugaauaacccucguggaagauguucauggugagaaggacugaaggaaccugcugggcuguucaccauggaauacuacacagccagaaaaaggaacaaaaucaugcccuuuguagugacauggaugcagcuggaggccauuauucuuggugaaucaacacaagaacagaaaaccaaauucuguauguucucaccuguaagugggagcuaaacuuucucuauuccuucaggcccugcccucaguuuccccuugacucugcuccugugcagaucucaacucaguccucauguccccagggaaaucuuuugaugcugccuccacuuguccccaucaauuugcaugcugacuggauuugugugccuugccugcuuccucaggaggagggaguguuuugcucacaguccuaucgcuggcaccuaguccuaucaccagcaucuugacaugcaaauaaagacuccuaaagugacacgcgaauaaagauucagugagugaaaauaugaacaccucacuugccugcaacacugcaccuugugaugaggcucuucccuguuuccuucuucuugaaagaucuccucuaccuucacuuccuaacuccuguuuucugcucuaccaccucacugcaaacugucaaaagugcccuuucugugugaacccauggcaccuccugcguaccccugucagagcucuuauuuuauucugguguaaugacucucucccuauacuagauugcaaacucuugaaaggaaaggauuguuuauuuacuaucauuccaacaguuugcacugaguauuaagcuuguuaauauuuuuugaauaaaugaaugaauggacucaugccucuuucacuauuauuuucugauuauaaaaguaacacauuucauaccuggauauggugguauguaccuguagucccagcugcucggaaggcugagacuugagcccaggaguucgagucugugguggacugugaucacacaagugcuuuccagcuugggugacagaguaagacucugucucuaauaaaaauaaaaaagaaauugugggccaggcgcgguggcuuacgccuguaaucccagcacuuugggaggcugaggcgcgggcagaucacgaggucaggagaucgagaccauccugguuaacgcagugaaacacugucucuaacuaaaaauacaaaaaauuagccgagcgugguggcaggcaccuguagucccagcuacucgggaggcugaggcagaagaauggugcaaacccaggaggugggacuccgccucaaaacaaaacaaaaaaaaaaagaaauuacguauaauguucaaucuucucuucaguauuuuccuaggcaauagauuacuugucuuagguuauuuugcuuuuaaugauuacaaaguucgacuguauaaacaaggagauagagaucuuuccacagaaaucuuagaauaauuuaccuauuuuuccaaaauaaacaauuacuuuaaaaauaaaucuuucauacauuuuuugacuaaaaauuuuaaugguauccuuuuuuccuaagaaauguuaguaaaauagugggugcaaagaugugcucuucuauaaucauuuuuuugguaccuuuaccucccauauuuuauuagauuuucuuucuuuguuucuuucuuuuuuuuuuuuuugagauggaguuuugcucuuuuugcccaggcuggaguacaguggcgccaucuuggcucacugcaacccuugccucccagguucaagugauucucuugccucggccucucaaguagcugggauuauaggcacacaccaccauacguggauaauuuuguauuuuuaguagagacaggguuucaccauguuggccaggcuggucucgaaccccugaccuaggugauccauccgccucggccucccaaagugcugggauuauaggcaugggccaccaugcccagccauuuuauuagauuucuguggaaagaucucuaucuccucauuuacaaaguuuacacagucgaacuuuguaaucauuaaaaacaaaaaaauaagucccuuccccuuugguuucuuaaaauuuacucuuuaugguuuauuugauaacucauuggaacacaguaagcaaauauuuucaucucuauagucagcaugucuuugccauguggugauguauuugcaucccuuugucauuggcacuguugucacaauguggucaugauuuccuuugagcauucagucucaucuacuagcaguggcucuaacccaaaguaaccacccagguauaauagguggccuugauguuauuaaagaauguuuuccaggaguuuaaaccacaacaccucaaaauuuugcuuuuuaaaaaauuaguuauauucucauaagcaacuuacuauuucuaaacauuuguugaggacaacuaacugcaucugucaucugauuugugugggucugauggggaacggacagaguguguguccuuugauccaguucucuuuguaaagggaaguagauaguuacaaccuuguuuuagagaguuaacaugcaugaaauaagaacaguguccacauugucuugucauuacacuuuuauuggaaugcuugcuuucuuaaucugaucugauagcaaauauauuuuucaagaagugagaagucuucaaaauauaugacuaugaaaugagacgggaauuaaaacaacuaaugguaauagcauauuuuucugaaaaguuacagcagaaaacucccagaguuuauuuuaaaaacuuuuuuaaaaacucccagaguuuaaaaaaaaaaaaaaaagaguuuaucaggugugauuuauaccagucaaauuugauucucucaguagugauuuucuuuuuuuauuuuuuugagacagggucuuguuucaaaacaagaucuugcuuuguggcaguggcacaaucacagcucccugcagccuugaccuccugggcucaagcgauccuuccuccugggccucccaaguagcugagacugcaagcguguaccaccauagccugcuaguuuuuuaauuuauuauagagacagggucuuacuaugaugcccaggcugggcucaaacuccuggguucaaaugauccucccaccuuggccucccaaagugcugggauuacaggugugagcuaccacaccuggccuccaguagugauuuucauucucuaguaugaaaugguauucucacuuuuggauaaauaaaggcaaaauguaaacaguuaaucuagauaaaggguaugugggaguccauuguauucacauccuugcaacuuuucuguaaguuuggaauuaaugucagaauuauuugcaccaaccuaauaauuaaaacuuaccccccacccccggcugggugcaguggcucauuccuguaaucccagcacuuugggaggcugaggcggguggaucaugaggucaggagaucgagaccauccuggcuaacacagugaaaccccaucucuacuaaaaauacaaaaaauuagccaggugugguggcgggcaccuguagucccagcuacucgggaggcugaggcaggagaauggcguggacccgggaggcagagguugcagugagccgagauugcaccacugcacuccagccugggcgacagagugagacucugucucaaaaaacaacaacaacaacaaaacaaaaacaaaaacaaacuuaccccacccccaauucucacuuuuuucugaaaauagaugcauuuauauuuuauucagguuuuucaccauuucuaaaagauugacagauauucacauauuuaugcuuuuguguugacuuucauaccuaucaucuaauuacagacuuagcaucugaucaaauuauuuugggaagaggaagagggaccuuagagauacuugguuucugauucuuuuagucccgcacccuuacuuugcccuuaacuuuugcaucacagaaguuaauuuuguagugagugcugaaauccuuuuaccauccaacuuggaauccuguuggcuuuuucuucacacauugccuucuucauuaagcuuuuacuuuuaccagcauacuguuuucccuccugaguuauuggcacuuucagcuugcauuauauuucuucuggucaacuaguagaacacaguuaaaucuugagauuacuaguagcaaaugauuuuuuaauucagauuuuuaaaauguaacauauacaugaaauugaccucaucugcuagaagcuguucacuuuagacauggugucauuuuguaacacuugggaaaacuagcuucauucuccagaauuggaaacucaagucacaggugacaggugacuaauccacuuguaaagcugugaacccaaagcguggauuggacuggaauucggguauucguguuuguugugaaugcugaugggaagauagcagggcaguguucucaucagagcuccuauccucucugcaucuguuuuuucaucugcaauaagaugaugccuauucugcccuguccuaaggacuguugucaaacacaugggaaagaagacagggugauuggacaauuauaaaaggcuuucaugucucaucuuucuuuuuucuuuauuauuuugcauaggauucuuuuaguuuuuccaauuuuccacuaaacuauuugaccuuuuaauauccuauugccacauaauuuuuaagcuugauacaacaugguuauuucucuuauuuuuuauuggaauuuaggguaagaacuacugccaguaauuuuaaacuguucuuaacuuuauggagacaguaaguuaccaugaagucauugaggauuauaaucuauuuagguuaauuuaaucuuaaucuuuuguuuugcagucccaggcuguccaaucuuccuggcuggucccugaaggauggaaaugcuuucuuggacaagguaauaucuaagacuacaaacuaaagccuaucuacagccaguggaaagcuaucuucucauaccagagccacccuguaguagugugacugauggcuuuuuuuuuuuuuccucucugaaaauccccaagaucuaugcuagggucuucagaacaugguaacugcuguuuuuaagcauguuuuuagagaaugucauuguucugauucagauccauuuugcucauguguagaaaucuaaguacuucugcugcaaauaccuuuuaucaccacagaaagacaacuauuauuucuagaauugcaaugaguguuucaaagacaaggcuuuuuaaagaauucaauccaguucauuuugugauugcaaagaguaaaaccuuuuuuugaauaacuuuuaaaauccucaagcaggugaguuuuaaacugcuucuaucaagggucagaucagguagggcuuuguaaaaagcuugggucuuuuuuggguaaugagaggccacagaagguuacagaaggacaguggcauugucagaucggaucacucuggccacuguguggggaacgguccaggagcagaguguuugacuuccccagcagugccuucuugugcaggggacaguacucuuagguaaauuugaguagugggucuccgacacuaugaucugugaucccguuucaaccuguccugauagccuagaauggacaaucuuuauagaugauuaaaaaaaaaaaacaguucuaggacucugggauauggagucuuauuaugacuuuaaugacugacuacaccuaaaauaaauggcuuaaauuacuucuuucucuuugaggcuauuaaauuuuugacauuagguuaucuucucaguaauuccuuccucggaucaauaguuagacaguuaacuuaauaaaugaaagacuaaagcuaccaaaaauguuacaacuauaagcuagucaaacuucguacuaaaaucagagguauaagaagguuaaagacuguaaagcccccucaggccaauucuuaguccccuaaaucauucuuccuuuccuaaguuucacauuugaaaaacuaaagaguuuaaagaugcuuaacaugauucaucuaaauaaggcauuuucucuuguaauagauacuguuaaauaaagaggugcccuuuuuacagaauuaauuccuguaacugcacccuagccucaaguacaagccaaaugcauaauuugacaccagauuuucuucagagcugacuguaaaauuaugugacauucagaaaccugugcaccugauuucagccugagucuccugcuggcuauaaaucauuguucccugcagaaggcuccgaagcaucccauuaccagcgcauugugagcgaaaugacuugcauguguaugugggaguauuucauuagaagggaguggugaauaaaauacagugacauuguaaguguuuggaauggcaaauaugcuucugcaggccgggaaggaugagagccugugaggagacuucaucauagcccuguccugaaauguagcauuauggggaagaagauuacauagcccauuuaagaccaggcaaagcuuugaaauuucccaugauuugucuuuaaucauuuuuaaccucauccuaagggaguggggagucuucucccauuaaacauaauugcucauuuguuuuuagcuggcagguacauuguaauuaagaacuguguucagucuccuuucagcuccaccugucgcuaguuaaaugguacucaucuaaggagagaaaccagagaguacaguggaaggcaaggggaggaaauugucuaucaagguucugauaugagacuuauaaaauucaaaaggaccaguacuauguagucaaugcccuauuuucagauaaagauugagaguaaaaucauucagacucugauguguaaauauagauacauguauauauggauauguacaauauauguugagugacuaauggaaacauaauagaaaaaaauuacaacaguaucuuucccuuucuggaaagagcaaaggaaacucaaucacauucugucuuuuacugguuucaguguaaagucauagguagcuuuaaccuuaauggugcaaaaaauucacuguggacuucaguuuaaagucagugagaggagaaagcauuaguggccuucaggaggcaucguagcagacccuauugguagcccacccauaucucucagacuuugcuguuucacuguccucugucauaauuccagcugccgguaucuguauggcuuugccugagaguuuuuuccugaggcugcacaaaaugcagcaguugguauauaaacauuucagccccauugcuccucagugggauaacucagagcugucuguguuagaccauuucugaguuuccccauggggauaaguuccaguugccccaaguuguauguggcucagugccauuaucugucaccuuccuuugcacugaucacuucuccguucuguuuucucagcaccucccauauaaacuaccuucucucaaacucuuuucucagggucagccugugggggaaagacagguuuauuaaauuuggugagucauggguggggugagaaguuggacuauaucuauuucuuuauacauaugcuuauuucuuuugaauaaauacauuugguuuauaaugcuaaauaaaugguauguucugcacggaaaaacauuacauucgugguggcaguggugguuuugguggaggugguaguaguggugguugugguggagguggaggugguagugguggugguggugguggagguaguggugguagucgugguaguggaggagguggugauggugguagugguggugguagauguugaaucccuguuucaggcucuuaacucucccuccuuacaucccccuuuccucccaacccuugguaggugaagaaaaagcuucuaaacaguuuauguaggguugugacuccuaaccugacagcauaacaggaucacuggaggugcuuguuauaaauacauauuccauggccucauccccaguuucugaucccuucagucuuagauagggccagggaucuuuuauguaauccauguccccacauaauucugguguugcuaguacaguuugcauaccuuauuuggaaaccacuggauuguggguuaugggagcagcacauacccaugcauggcuuucuugaagagguaucaaaaaaugugccuucaaguccugagucugcaaccaaacagcauuuuacccuuaauaagacacuuggccugccuaagccuaaacauaggacagucggccuaauaaccucccagcuucccuccagcucuaguagucuaugauucuucaugaaaaguuuuguuuggggaguuuauuucuuugguccuguaucuacuggauaucucuuccuuguauuuuuccuuuucauuucuuuuaggagcuaaaggagugcucgggucauguauuuguggauucugugccggaauucuguuuaccagagguaagauuaaggugaaucuuauuguagaaacaaaccuuauuauguaauugcucaaaaugaagucaagaaauaauuuuaagaggcuuagcuuccuguuuucaaguuuaaaugaaucuguuauuccaggcacauuguuacacagccaaaaugucaucauuuagcagcuuuuuauauuguuuguaaaucauuuacgucacucucuucuuccuauuuccgguucuuucuguaauccccacuaauacuccuaguagggcauaguuuugagcaagguaaggaacuaacucaagccuuuuaguuuugugauucugaugccugugugcuuagguuagccuuauguguccuggucuugcuuuaugguggguaauugacaauugcuaguaaacuguaaaaauucuugcugacuugaaauaccauauugaauauuguuugaaauucauagauucugaacugagucauagaagacaaucacuuacauauuauuaucacagugagacuugcuguuaggguguggggccaguuucauccuuucaaaggaaacuaagaucaguuuccauuuguuuucaaggcagcuaaucucagcugagaggccuaauacccagaguagccuaggugcgguucuuaacagacaugugaaauguggaaagccggagcugcucccagguucaugagaagcugccauccucuuuuuuccucaugcccaguggaucgcagugccuguagaaaauaguuccacaaauucaggaccaaagagaaaaagaauuuggagugcaguuucucugauuuuuguuuucucuucuuccuucucuuuccauuucuacacuuuguuuaauauccuguagaucaacauuuuuaucucucuuagaaguauguguaugugucuuugaggguaccagagcaaauagaaaaagaaacacagacaaaugugguaauugaaggugucagauaagggagaaaguuugagauugaguaguaagcguaaagcugaaagaauccaagaauccagagcucucccucucaccguuaaccaaagucauuuugucauccuuauuugugacuuaggaauugguagggugauuccccaucuguuugaagauuccuaauccuaggugcuacauuuguuuucaguugaccacgugucacgccaacuacugcaaccuuccauuuauggacaccacuguagaauuuaugaauugcugucccgauggcuuucugacuugcucuauaggguacucagcuuuuaaauuagacaguuaccauuccacaguucauuuuugccaagcuaaaggauuauugauauauuuaggguucuagagccauauacauuuuuucaggcaagauguuagggcacaaauuaguaauagucacuguuuuaaaguagagccaggucuuguaugauuggaaaaaaaugggagaguaauggaagcaggagagaggcacuuauuauagcccagucuucacugacuugugggugagccaugcagccuuagucccaauccucaugaaauuuacaaacuaguacaaauagcuuaaauaucuuuguaucccaguacaguacgcaaccaguaaaugaggguuguuuugauugaauuuauggucuguagaaccccaaguguuuguauacagcaguuuuaaagauagaguaaucuuuauuggauuccauuaagugaacauauguaaguaaauaugugaguacaguugacccuugaacaauaugaguuugaacugggaaaguccacuuacauguggaguuuuucauuaugacaauuugaaaaaacuugcagaugaacugcauagucuagaaauagcaaaaaacuuaagaaaacguuaggcaugucaugaaugcauaaaauauauauagaaacuagucuauuuucucauuuaccaccauaaaguauacacaaauuuauuauaaaaagaaaaauuuuuuuuuugagacagagucucgcucugucaccuaggcuggaguacaguggugccaucuuggcucauugcaaccucagccuccuggguucaagcaauucuccugccucagccucccgaguagcugggauuacaggugcccaccagcucauuuuugaauuuuuaguacagagggguuucaccauguuggccaggcuggucuuaaacuccugaccucaggugauacaccugccucggccucccaaagugcugggauuacaggcgugacccaccacgcccagcugauaauuuuuuuaaauuggcucuguucacaggcuggagugcaguggugcgaucucagcucacugcaaccuccgccuuccuggcucaagccauccucccaccucaaccucccaaguagcugggaccacaggugcacacaaccacacccugcuaauuuuguauuuuuuguagagaugggguuuugccuuguugcccaagcuggucuugaacuccugagcucaagcgaucugcgucagccucccaaagugcuggaagaacagguuugaaccaccgcgcccagcuaaaaaaguuaaaauuuaucaaaacuaugcacaucaacauuuacagaccauacgugacaacgauuugcacucaaaagaaacguaaacaagcauuaagauucaguauuuaaucauaggcauaaaacuguaguacaguauauaacuucauagccaccuccuguugcuguuguggggagcucaaguauccgcuuaaaacaccaugugaugccagucaucuccaugugagcaguuccccucucuguaaauugcauauugcaguaaagagugaucucucgcaguucucauggaucuugcgucgugcuucaugcaguaccauaaaccuugaauaaccaugggacccauacgaagugccacuaguggugcuugaagugcucccaagaagcaaagaaaagucaugacauuacaaggaaaaguugaagugccugauauguagauugaaaccugcagcugauauugcccgccauuucaagacaaaugaauccagcauaaggaccauuguaaaaaaaggaccauuguuuaaaaaaaaaaaaagaaaaaggaagaagaaaagaaaagcaagagaaaauacaugaagcugucacuguagcuacaccagcaggcaugaaaacuuguacuucuugugaaauacauuuuuaccuuguauuagaaaugcagcuuuaugugggugcaagucuacuauaagaaaggcauaccuguagacucugaugugauucaagaaaaagugaaaucacuauaugacaaagcaaaaggaaagcuuaaaaaaaugucaagauaacaggaaaagcagcuuccuccagccaagagacagcagacaaauuccuagaugccauuaagaaaaucauugaggagaaagacuaucugccugaacagguuuuuaaugcagaugaaaguguccuauucuggcagaaaaugucacaagaaacauuuauuaggaagagaagugaguucuaacacuuaaaggaggaagggauaggcuaacucuacuguuuugugcaaaugcacucggguuuuuuuuaucaggacugccuuuaccuauaaaguggccaaccccugauccuugaagaaaaaagauaaacagcaguugccagucuuuggcuuguacaacaaaaagaccuggacggugagaaccgcuugucaggauuccauugaugcuuugucccugaagucgagaaguaccuugccacuaagggacugcaucuuaaaguucuuucaguauuggacaaugcacuuggccacccauaaucccaugaguucaccuccaaaggugucagaguggucuaaugccauaaacacaccaucacuaauucagccucuagaucaggaggucauaagaaccuuugagccucaucacacacaguacucuauggaaaggacugucaacucugucgaaggggaccccaauagaacaucaugaaaaucuggaaggauuacaccauugaaccugccaucauuguuacagaaagagccaugaagccugaaacaauaaauaaauuccugcuaaacaaaacuguguccagguguuguacuucacaggauuuagaacagaaccagucaaggaaauuaggaaagagauuguggaugugacaaaaaaaaaaagugggaggugaaacguuucaagauauggagcuuggagaaauucaggagccuauuaacacaccagaggaguuaacagaagaugacccgaccaagaugagugcuucugaaccugugccagaugaugaagaaggagacauagaagaagcagugcuggaaaacaaauugacauuagacagucuggcagaaggguucugauuauucaggacugcuuuugauuucuuucacaacuuggauccuucugugaugugggcacagaaacuaaaaugguggaagaaggauugauaccauauagaaacauuuuuagagaaaugaaaacgugaaaacauccaacaaauuacaacauauaucuguaagcacucugagugugccugcuucuccugccuugccuucuaccuccuacacuucuuccccucugccacccaagacaacaagaccaaccccucgucuuccuccuccucagucuguuuaaugugaagaugacaaaaauaaagaccucuaugaugauucacuuccacuuaauggauaggaaauguauuuuacuaucacuaaaguacauuuacuuuuccuuaugauuuuuuuugagauggggucucacuuuauugcccagcgugaagugugauggcauaaccauaauucacuccagccucgaccuccugggcugaagugauccuccugucucagccuccgaguagcugggacuacaugugugcaacaccaugccuggcuaauuguugaaacauuuuuuguagagacauggucucacuauguugaccaggcuggucucaaacuccuggccucaagcaguccucccaccucagcccccuaaagugcuaggauuacaggcaugagccaccacaucuggcuccuuaucauuuucuuaauaacguuuucuuuucucuagcuuauuuuauuguaagaauaccauauauaguauauaugcaaaguauguguuaaauauguuauucaggaaggcuucuagucaacaggcuauuaguaguuaaguuuugggggagucaaaaguuauuuucaacuguacagugggucagcaccccugaccccuguguuggucaagaauuaccuguauauaaaugugguuuggauguuaaauuucucagaggaaaaauguuuuauguaagcauacacucuugauauauaccaacagaauaauuuuuuauuuuuuauaauucuagacucugugggcugguucuuaaagagaaauuucaaguuuucucacccaguuucuguacacaugaggacugguggugaugauuuuuagcuuuauuguugcuucagugugauucacauuguuuucuucuggaucuaucacugugcuacccugucuuaauuuccuuauuuguuuaaaaaugaugcuaggggagguaguggagaguaggaccagcaaacaguuacgugguccuucaugaggaggacacugucuugcaaaggcagugcacaacuuggggugaagguugggauagguuggcuguucauuaggcaugguguucacacagauggcaguacccuggcacugaguggcuuaugaccucugcuggcauccuguccucgggggccgaugcugccuggcagcuuuauuaaguuacucguuuuauuuguaaaguuacucagcuggaaaauacccauagccagaauggcacccucccucucuucaucugcuuaugucacaucaucuuucuuucuuuuuuuuuuuacuuuauuuauuuuuuuaauuauacuuuaaguuuuaggguacaugugcacaaugugcagguuaguuacauauguauacaugugccaugcuggcguacugcacccauuaacucgucauuuagcauuagguauaucucuuaaugcuaucccucccccuccccccaccccacaacaguccccagagugugauguuccccuuccuguguccauguguucucauuguucaguucccaccuaugagugagaauaugcgguguuugguuuucuguucuugugauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccacaauaaacauacgugugcaugugucuuuauagcagcaugacuuauaguccuuuggguauauacccaguaaugggauggcugggucaaaugguauuucuaguucuagaucccugaggaaucaccacacugacuuccacaaugguugaacuaguuuacagucccaccaacaguguaaaaguguuccuauuucuccacauccucuccagcacccguuguuuccugacuuuuuaaugauugccauucuaacuggugugagaugguaucucauugugguuuucauuugcauuucucugauggccagugauggugagcauuuuuucauguguuuuuuggcugcauaaaugucuucuuuugagaagugucuguucauguccuuugcccacuuuuugaugggguuguuuguuuuuuucuuguaaacuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacguuuaagucuuuaauccaucuugaauuaauuuuuguauaagguguaaagaagggauccaguuucagcuuucuacauauggcuagccaguuuucccagcaccauuuauuaaauagugaaucccuuccccauugcuuauuuuuuucagguuugucaaagaucagauaguuauagauaugcggcguuauuucugagggcucuguucuguuccauugaucuauaucucuguuuugguaccaguaccaugcuguuuugguuacuauagccuuguaggauaguuugaagucagguagcaugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuauaaauuaccuugggcaguauggccauuuucaugauauugauucuuccuacccaugagcauggaauguucuuccauuuguuuguauccucuuuuauuucauugagcagugguuuguaguucuccuugaagagguccuuccugucccuuguaaguuggauuccuagguauuuuauuuucuuugaagcaauugugaaugggaguucacucaugauuuggcucucuacaucaucuuucuuauuucuucuucguggggauguauuaucucaaggacccaucucuuaaccgagucacuugcuuuuccuuagugcaccguauauuucccaggguuagcuccuccacgguggagggcccugugagugacagguugucucugaaccauggugucucacuucucccagaacaugcugcuaauaaagcugcauuccuucaacagaagcacaccaaggcuuguuagguacuggcugccacaggugggaggggacagaggagucacacaggacaaagugcuacuuugagguguuguguguagauugugaacugucauaagaguuacacagacagaccgggcuugguggcuugguguaaucccagcauuuuggaaggcugaggcaggcagaucacuugaggccgggaguuugagaccagcuuggccaacauggugaaaacccaucucuacuaaaaauacaaaaauuagccaggcaugguagggcacaccuguaaucccagcuacucugucucaaaaagaaauaaaaaguuaaaaauugaguuacacaugcaauacuuugggaguucugaggaagaugugguuucuuucaucugagcaaaucaggaagaccuaguggaagaagagaauugcgucuugacagauugguaggacuuaaauauauggaaaaauuuuaggaguuuuccuaaaauuuacccaaacuuggauagccuuuucccucacaugcuaaccugucuuuucucccuuuuuacaugaccuuaaugauggacuuaaaagggcagaucuggggauaagauuaggauggagggugaaaggauaauuuccuuucaugacugccacuacgcuuuuuagggcgggcucuauaaccagcacuaaacuaacaaaaguuaccucaaaagaaaaaaaaaagcaaaacaaguugucucuccaucuggcuuuugaagagcugguuucugugugcugcguccccguugcccauuaaucuguagcaaugggguguuauguucuagugugugcuugccgccuguaugcugcucucucugcuugcaguuuccugguuucacuugccuggcagcagcugccgaaggguccugcugucauuuaaccucauaagucuaauucagaagaauucuguucuaguaaaaucagagugcugccucugggcuggcuguguucucacugcuggccguccuguccugcuacuuaaugucaguguagaaaaccucuucaaaugagagaauggcaguguugcaggaaagccaucauuauucugcaauacaaaaacuacuucucugcauucugacaacgucguuuuuuagucacaucauauugaucgaucccugaacagauauauaucauucccucccuuucuuuucagacggagcuaauagaucugucuacaguagaugugauucucaucucuaacuaucacuguaugauggcgcugccauacaucaccgagcacaccggcuucacaggcacaguguaugccacggaacccaccguccagaucggcaggugagaggguugauucugacccugcuaggaugugacugcggagcuccucccucagugaugacgcuaucacaguauuauaccagggcuggugguuaguuccuucugaacaacuaacccaaagaacaggcaggaguaagcgacucucuagaugaggaauguucauuggaaaugccuaaggauugauggugcaaguagucuuguuggucuuuuuucuuauaaauuaauuggaaggaguucauggagacggcuccucuguacagagaauacuaauuaggggagguaauguuuagaaagaugccacaaagaugcaaggcagagagcuucagagggaaagaguguagcaucuuuaagaagaagaaauuuuauugcuuugcuuucaaaaauucccccuuuuugugguuuguuguagacuauaaauggagacagcuuguagaaaauacaggauagauaaguaaauagaugguuaaguugucucugcuguugacagagugaaacugagcagucuaggaguaaaacugcaguuuuccuuugacucuaagaagccucugccaucccuuucucugcuucuacuaagccuuugugacacaggugguuaccacaaguagcaauaguaucauuuagugaggaauuagguaaagaaaauuacuccagaaaaaaaaauuugucaauuuauuuuuuuugaaauaaauuaauaaguacgguauaaguugaaacugucagguuccaaaaugugagacuuaagaauugcuauagacuccuagguuggauucuagagccuugcagaugaaauaauguguuuucuuguuuuuaugucaaaccauauuaccugcacuguguauguaaccauuagggagcugaggaagggcucucauaggaaaguaaaacacucgaagugaugcacugguuucaauugagaggauaagcuaaaaaacuagccucuagucuggaaaaguuaaagcagugaggaucagcacaccaaacuguuccuaugaaagcuacauccaggacaccagugagccugaaucacaggucuugagauguugaaauuagcacucuuccuucaagauggaaggaggagaugguauuaggccaaaauaaauaaaugagaaugaaaugaaguuguuuaguuuucaaaugcuaauacauuaauggcuuaccaguauguauauguuaacuuggaggggauuuaagucaauauggaucacgaauauuagauuaggaauggagauucaaggugucaaauccauuucuaccuuuguggucauccucuggccaucaagaauucccgcaguucucuguccugugaauccccaaagccuguguaccuugaucuaacugauagcgcagcauuucuuagauuccucaucccugguucugugguacuccgucucaucucagagagagcuagucuucugcauuuagcagcguacuccauuuguccuuggaguauucuuccacauggaauuuugcuaauuccuaaaacauaucaagaaaacuuauuuuauccauuuaaaauguucauuuaggcuggccacgguggcucaugccuguaaucccccagcacuuugggaggccgaggcggguggaucaccugaggucaggaguucaagaccagccuggccaacauagugaaaccccgucucuacuaaaaauacaaaaaauuagcugggcaugguggugugugccuguaaucccagcuacucgaguggcugaggcaggagaaucccuugaacccgggaggcggagauuguagugagcugagauugugccauugcagucuagccugggcaacaagaacgaaacucugucucaaaaaaaaaaaaguucacuuaauauugucauuuaaaaaaaaacaguccugcccacacccuacuacgucaccaaaauuagauaccugacagucauuuaacuucucccuauauauuuucaguaacauaaaaguagagaucuuagagugagaguuaaaacaggcuuguggauuucuaugauuagagacaagaaacaggccagccuuguuuuaaaggugaauuaaauuauuuaaguucagaauuuuuagcauggaaaugcaauaagaaagugaggauuuuguuuaacuuuauaucaaauggugaucaaguuuaugugcagcagagaggaagaugaugaugaaaugguguagggggaggugggcaagucauuucuccuggccaacuguuagaguaugggguguuucucuaauuuuuuaauggguguuccucacuuguuuuguuuaaacucaggcuucucauggaagagcuggugaauuucauugaaagagugccaaaggcucagucugccuccuuguggaagaauaaggacauucagaggugaggaacagaccacucucuuaccgagagacuguagagccaggugcuuugcaaagcagucucauuugauuucuuccucuaugcuuaaacaaugauuugguuauauuaaagauucucuuuuuccuaauacaugaaaggguuauauuugauucaaccaacauuuuuugagaggcaacuaugugcaaggugcuaugcuggguaccagaguuuuuaggaacaauuggcucuugagguggucaaaguuuaauggaaaaucagauaacucaacaggucaguuaacaguuugcauggcaugucuuagaagagguguuugccagcuaggcgcggugacucacgccuguaaucccagcacuuugggaggccgagaugggcagaucaccugaguuugggaguuugagaccagccugaccaacauggagaaaccccgucucuaugaaaaaugcaaaaaaauuagcugggugguagcacaugccuguaaucacagcuacucgggaggcugaggcaggagaauugcuugaacccgggaggcagagguuucagugagcugagauugcaccauugcacuccagccugggcaacaagagugaaacucugucucaaaaaaaaaaaaaaaaacagauguuugcccccagugcuguaggcacucagaaacugaagaacucugcuuaggaaggcugagaaggacauuccuuaggagaugacaguuaagaugggucuuggaagaagaaauggauuuguuccuauagcagagguugagaagagaaguccaggcauggcgucaugggacauaguauauucagggaacagugagauguucaguguggauuagggugaguagagaggugagaggugcaaguaaaggggugaguuggagcaagagaaugaagauucucauaugugaaguuugaguuuuauauuguugagagugugaaguuggccaguggagguuuauaaggaggcuaaugacuacguuuguuuuggggaaaguaacucuggaagcagcguaaaggauggacaggaaugcagagguaggcaggaggaccagcagugugacugcugaaacccaggggagaugacaaagccuugaucuaaggcaguauccgugagcaugaagcugaagucuaacuucaaaugaauuucugagauagaauugaaaagaacugguaagaguuguaaaagaggcuguaguaauuaagaagguaagaggagagcugagugggaaccaagggacaaggaaguuucagaaaacacagguuguugcuggucucagaugcugcagaaauaucaaguaaaauggagauaaggcccuuggcuaugggaauggggaaguccuuaacaaucccggagaggugaguugccguagagugcuagguccagaaaccaggcugaaagagaugaaguaaggagaaacaugguagaagcagcagcuugauuccacuuccaugaucucuuauuuaaauuggcaacagaguaccccuguggauauuaacacacugggcuuucucuaaccuuagcaauucugccuucaucuccaggccccacagcagccacaccuucugaugguggcgucaagucuggaguaaaaacuagucuuuugauuucuuuuuuuuuuucuuuuucuuuuucuuuuguuuuuuuuuugguuuuuguuuuuguuuuuguuuuuguuuuugagacagagucuaacucugucgcccaggcuggagugcaguggugcgaucuuggcucacugcaaccuccaccuccaggguucaagcgauucucgugccucaggcucccgaguagcugggacugcaggugugugcaaccacacccagcuaauuuuuguauuuuuaguagagaugggguuucaccauguuggccaggacggucuugaucucuugaccucaccauccacccaccucgaccucccaaagugcugggauuacaggugugagccacugcacccggcauagucuuauaauuucuuaggcaguuuacguuccauaugcuccuacccauguccacuuuuuuccaguuggcacugauuucucuuucccucuagaucagugauuuguagucaucugcuuauuucaacauuagaaugucuuaguuuuugcagaucuucuuuugauuagaauauaaauauguagcuagaggaauacacuuuuucuauagugacuauuucggagcuugagcaugagucuccuccgugcauuccuuuguacacauguuauuuauuuuacuuauguaacacuugugugccaggcaccuucuaaauguguuaauuuauuuauuccuuuaauaaauagguagauagguagguagugguguuacuccuuuuuuuuuugagauggaguuucgcucugucucccaggcuggagugcaguggugcaauuucggcucacugcaaccccugccucccaagguucaggcaauucuucugccucaggcucccaaguagcugggaccacaggugagcgccaccaugcccagcuaauuuuuguauuuuuaguagagaugggguuucaccauauuggccagacuggucuugaacuccugacuucgugaucugcccaccucagccucccaaaguguugggauuacaggcaugagccaccacacccaggcaguguuauuacuuuuuuacaggagagaaaacugacacagagagauuaaguaacuugcccaaggucgcacagcuagugaguggcaggaucuggauucaaacccagacagccagcuagccuggcugcaggguccauacuccuaacccauuugcugggccaccucuuaugcacacacacaugccucuucucaugugcgugucagccgcuucuugugucaggggacgaggaaguaggcuuaucugugcacacuuucuccuguguuuuaaggaucuuuugaaugucuguuuccuuguuuggggauguauggugugggcguggcuucacauuaggaaacauuuucuggacaugugcauuuauaagucuuugguguguaugugaauggccuccuugaucugacugcccuggugcaguaccacauucuuguucccagcucccuuuucucuugcccucgguucugauaccucccuucuuuucuuuucucuccugugugcccacuggacuggacaggaccccaguucccuacaucucccucuuagaaaccucaggacuuuguuuucuuucccauggaacaugugugcucuggcuucccuucuuccucuuaaauguaaacccuuuauagugauuugcugcaaauaauuuuggcacaccacaaauaguguucuaaagucaguauuucuuggccaggugcaguggcucaggccuguaaucccaucacuuugggaggcugaugcgggcagaucacuugaggucaggaguucaagaccagccuggccaauauggugaaaccccccaucucuaccaaaaauacaaaaaaaaauuagccaggcguaguggugggcaccuguaguuccagcuacucagaaggcuaaggcaggagagucgcuugaaccugggaggcagagguugcagugagcuaagaucacgccacugcacuccagccugggggacagagcgagacucugucuaaaaaaaagggcaauauuuccugacucccaaaucuugggucaagucuuaggaagccccaaauccuuauuucaccuuuucucuugugaccuuggacaaaguccucagcauuuugccuuugccucccauuuggccacacaaaagaagugccaccuacauuacggagaguaugaaugaggcuaaaggaggagaaggcuagggaggggccugaaagguauuuccuaagaugcagaggaaagcucccuuuuuaaaaaaaauuuaaguucugggauaggugugugggacaugcaguuuuguuacauagguaaacaugugccauggugguuugcugcaccuaucaacccuucaccuagguguuaagccccauaugcauuagcuguuuaucucaaugcucccccuucccccgcacacucccugagaggccccaguguguguuguuccccugccuguguucauguguucucguucagcucccacuuaaaagugagaacacgcgguguuugguuuucuguuccuauguuaguuugcugaggauaauggcuucagcuccaucuaugucccuacaacagacaugaucucauuccuuuuuauggcugcauaguauuccaugguguauagguaccacauuuuuuuaauccagucugucauugaugggcauuuugguugaguccauaucuuugcuauugugaauagggcugcaaugaacauacacuugcauguaucuuuauaauagaauggaaaucucccuuuuaaaagaagcugcuaguugaaauauauuugcccaccuggugggcaaaaaucagaaacuguugagacuaacuugguagaggagcaaggagaguaguaacuugcgcuauuggagaaggccaucuuugauucucauccuggccaaugauuguguuuugauuuuugagcaugagaugagccauaguuauugguagagaaagggaagagucuaauuauuggaaaacauacugaggugugaaagagacacuccauagcuguguccucuuuuucuccuagauaaacucagcauaaauacuagaagugguagaagaauuugaagagcuuuuuuuuuuuuuuuuuuaauuuuuugagacagggucucacucugucacccaggcugcaguacagugaugcgaugucagcucacugcagccuucaccucccgggguucaagcgauucucccguaucaaccugcugaguagcugggacuagagaugcccaccaccaugcccgcuaauuuuuguauuuuuuggguuucaccuuguuggccagguuggucucaaacuccugaccucaagugauccgcccaccucagccucccaaagugcugggauuauaggcaugagccaccaugccuggccugaagagcuauuuauucuuuaauuggcaucaaaugaaagaguucuuuuaaaauauucaccuagaauuuaaucuuggaccagaguucuaaaagugcugcauuuggguaauguuugugcuaagggauuuacaucaccuuuagauuuaucucuaucacaagcuaguuaauaucuaaugucccaaacuacugcagcaugcuacauugacaaacgcugcuuuuugcuaucuaguucacggaaauuuuucccauuauauagccucuaucugucuucucuguauguuuucacucuuuuuuuuuuuucuucauucuugugcuuugccuguccaggucuuccaaaguagggaucacaggucuacaaugccuacagggcuggggaagguacacacaggagugagaugggcugguggaaaauguggaccggugaccacaccucuguauaggggcagcugacucguagcuccagcgaucguggccauaugggaaugugagcccacagcugccaagccuuccuuagaagcucaaagucuagauguuguaaaugugacuuuuaaaaaaucuuuuuagaaauguuggcuucuacauuagaaucaaaucccguaugaucugagcaaaguagcucuuagagagguacuuugagagguauucgauuugaggcuugagccccuaauuuuugaauuauacuauauauaggcagccucaaagcagaucuugucaagugccuagaauuaauacaucuuaguagcuuacauuacuaauaaaacuaucaacuaaagaaaacaguaaauuagaaacuuucaaacucagaagaaucugacaaauucucauaaaucauuugaaguuagcuugaauuagcauuugauuuauuauuaguacacguaccaaaaaaaaacuauuacuccuacuuuuuggcagcuguguaacuuccugccucaguugacagugcuccuugagauuuauaucaaagaaguuaagucauccuucuuccuaacuuugacauugcaguuuacucuugaaaaagagauggauuuugaagggaaggaaaaggagaaucccucacaauguaauucugggucucugacuuucccacacucacuuaaguuuagguuuuuaaugggaaaauguaaagcaagauauuccacuuaagaaaguaaccccaccucuaguacuuuuuuuguauaaaacuaauauuuuuuauaagguuagaaaucuauaauuacaauaaggauaaaucauuacaagauauugucauccucaugcaagcauuaagcaaugaagcauugauauagucuuggcugaauuuuuauggcacuuuuuaauacuuacaacuuaaaauguggcuucauaccuuacggaagacuuaaaagaaaacuggcugggcgugguggcucaugccuauaaucucagcacuuuggggggccaaggcugguggaucaccugaggucaggaguucaagaccagugugaccaauauggugaaaccccgucucuacuaaaaauacaaaauuagucauaccuauaaucccagcuacgugggagcugaggcaggagaaucgcuugaaccugggagguggaaguugcggugagccgagaucgugccauugcacuccagucugggcaacaagagcaaaacuccaucucaaaaaaaaaaaaagacuuaaaaccaugcauguucaaguugaaguuccuccgcucugacgcuccuuggguaugcauacaggaauuuaucaacuaacucuaugauaggaagagaagauagaagugugugcucggaggucaaauagacugguauuugaauuucagaucuguuucuugguaguuguggcaacuuauuucuucuaggcucuguuuccuccuucauaaaauagaagugauauuaacaacuuaauaggauuguuguaaggacuaaaugagugguaugauuaaguucuuaaaacaaugccagucacacaguaggugcucaauaaaugccaguguccuugucucuuuuaauaagauacguggcuuacauaaucugcuuuuguuaacuagaauacaucugucuucugcagccuaauuuacuuucagacacugccuuucugacgaaagcaagguagcuaaguggacagaaggaaaacuguuuucaaauuccacuguuaccuguaguuaguugucacugucacucagacucucagacucaaucuccuuuucuguaaaauaagaauuaaauuaucucuaaguccacuuguguuagaguucuaaaagauguccagagagaggcuccuuaaggcaggcccucagagagcggcagugcuuugacggaguaaucacagcugguugggcuuugcgauucuggucacuucaccguuucauuucacucggaguugauuagccucugagggacugauucaugcucaccagacucccaggauguugagugacaaacaaaaaucccaauuaaucacuuuaaaguaagaccucugaguggcuccagaacuagaguggcuucucuauccaggacacucuaugcuggccaggaaguccacuuaagaccucaaauuauggauaagaaauuuuuccaugagcauaggauuagagcaaagauaguugaguugcucucaagagucguuccugucaugcuuugguagccuaagcaauugccauuuuuuuaagcaauaauuugaucuaaaauaaacaucagggguuguaaccuaguuucugguuaauauugaaacauacuucauuuugaggcuccagaaacuccauauguguccuuauucugccaacaugcccagucuacccuagcccccacaggcauguuaagcccuuugcugugaugagagucaggcagggaacuuuccugauuccuaucuucuuuguauucuguccuuacauuaauuuuguucauucacuuauucauucauuuauucauucaacauacacuuaaugcccagccaguuuuuuacuuaccaccuuccaagugguccuucuggacuuaaaaguuuuaauauuuaauaaaaacacaaaagugugcugcuuuugcuggcaggaugaaggaagaggccgcagagcuuuggcaucaugucagagcccugggaaagaaguucuucaggcacucaagugugguaagaacaaagcaaaacaaugaaauccuuuagaaaguacuuaugaaacauuuagacucugagaacuugacuuugauaaauuagaaagccagaaaaaacagaacuaguucccucuggguuuccuuauccuucuuauccaaaaucagccaauaauccuaauggcuuuaaauggcucuauaaaugccucucuguaauuaggaccucaaguaagcauaaggagaguuucugggaaagcuaaguuagacaagauguguuaggagauagaggaagcacaacaaaguaacuaaauaucuagaaagaauaaaagaggaugucagcaaaaggacuuugugggcagaaauaugaaauucagagaacuucacuuacuuguugaguaacuaccaaaugccugguauucuaaguuuguagaaaaaugcccaaaaaaguuuaagauuuagucgcucuacucaaggagcuugucaagcaaaaaaauagaugccaaauggcaagacuuaggcugggcuaggcagauugaguaggguuugaaugaggaaaaagagaccauuccaagcaggcaagaaagcgagcaagauagaaguccuagucuuuuguaaccuaaucacugaagugacagcccaucaucaucuuugucauguuagcagcaagccacuugaucuaccucacacucaggaggagaggauuccacaagggggugaauccuguggguaggggucacuuggagccauggcagaagcgccugccacaaaacccugaaccgggcaggucagacuggaccagaggcagugggacggcuuggcuuuccuccuccggguuaccccugagcuccuccuugauuuuuuucaccaccucucacaguuagagggcucaccucuacccaaacauggugcaguucagacgggacacguugauaauugcauugcugguucuuuuuuuuccugggauagcaacugaacuuuuuuucuuuugagugucauuuauauugggcacuaugcucagugcugaggagacaaaaaugaaaaaaguguugcugugugaaucauaugauacaauaggaaaaaagauacacauuacucuuuucaguggguauuaauaaaauacaaaacaaaaggcauauuuaacaagacuguucuucuaaauacaguguucuauguaucugauuagcaaaaaucaucuguagugaaaauuucuguauaaacaaaugcuuucuucugucagcuacuaguagcuguauguuuaaugcucacuacuggcccaugcauacugauguuucugucaucauucugauuguagaacguaaguuuaugauuuccaugccauuuacuuuaaaaggaaagaugggaaagauucaggcugaaauauaccuggaucuucaggagccuuuuguuuugcuuaaguaaauugugucccuacuugaaacaccaguaauuucucuagaaauaaguucuggguuauugaggacaaaaguuguagaugcuuugcaucuucaugcuuuccacuuucccuucuaagggcuuggucagaacgcugcuaguacucaauagggugaauauaagacuguuucaucuccagcacacagugaaaauauuaaagugaccaaagccucuuuuugagcaaggcuguuccaguucuuaaucuugcugaauuuucacaggacguuguccuagauggaaaggggaggcugugcugggaagggccaucaagagaagacagagcuagcaggaaggaaagcccacgugguaugguguucuggguaauggcaguacugguugucaaauaauggguaaggaaaaucgcagaaagaaagcagguauaguucuggccuugugugugacuuucuagucagccuuuaaaagaaaugacuguugcagggcccuggcaaagcuggggacaaugugaaagaaauucagcugaauggagagaugugcuugggguugcaaguguuauucaucauuauccaucacggucccugcucucuagccacucccaugacagccuuccagcucuggcauuauuaagucaagaaacuccuuggcuccuaccgggcccagagugagaggucuucauuuucugugcagggcagccccaggagguucaagccccagggcugccugauccugagaacuuaaaggaggagucaaagcuagguagaaccuuggguuuuuccuugaguccugucaaguucagaaucguugcugcucgucagagucaaucacccugggguggaguccacugcaguauuguagggaaaugcaugugcuucuggggcuguguuggagcagggcuggagacaaaccuugacucagcaucucuucugcaccagacauuucacaugcauuauauuauauaucauuuccccauugcagagaaacucucaaaggaagguaguauucucuccauuuuauagaugaggaaacugaggcuuggaggugaagagcuaacucccagauguaaaccuagacuucucugguuguaaauucucuuuuuuccauuauuuccuagugccucugagagaaaucucuccuuccucaaagcaggcagucgugaguuauggggauguggagguaacagaugcaggagcagcagccccugcggcggccucaguccaaagugggcuucugugccacuucccuguacuccugccagacucagggccagccagccuucccaaagagcacgugagugagcaccuggccuagacuggggucacaagaucugagagaaagugacaaguguguuuagguuuuaagcaagagcaaguaaguguuguccacucaaaauguagaagacagagggacuuagguagguggggugcaggcaggcagggccuugcacuagaaaagcccaguauagacaguacaggcagaagcagcacccagauaaagaagggccuuaggaagucaugcugagagccuuggauuuuauccucaauguauuggugaaucauuaaaguugggggaaggaggagaggaggugugcauaagaucuugagauuugcauuuguaguguauuguugaggcccuucugggagggaaggccagccuguaggcaaggaugacucgaggcuuuuggcauccuguugcccuguacuauuaaauuuuucuuagacuuaagcacagugugaacagaagcccuauauuaugcgugucauuccccuuaugugacuuaaguccugagaccacagucagugcucaguaaauauguauagaauaaauauugcaaaaccuaaagcaguucacuauguguaccuaagaaagugaauaagaaaaucuucauguaucuguuuauguagaagguaaugaaaauggaucauugauauuuuguugcuaaagaaacaaggguaaaaagcauaggaacgauuugacauaugugcuacucugguuaaaucuuaauucaguguuuccauuauuauggcuguauaaaugcaauucaccggccauauaagauuauuaggauuauuuuuucuaucuugugcaacuuuuuguuuucccuugaguuaauuaccuuguuuucuuauuugucuaguuguuuuauguaccuauugucucuauacucuuucccuacuugucucuccucaauauguuuguaaguaauuaaauuucuccucuacccucuuaggguguccaguugugccuaagaauuaaacugacauaaaacagguuaacagaagaaagguacacacauuuuauuaaguuacauauauguaagagucugcacaggagaaugaagacccaaaggaacaguuagaguugaacacagacaccgaguuggacaaagagcaggacauugggaaagugugacaagggaaggggacuugggcuagggcagucaauuggguggagaagugacugggaagaucaggguuuaacaagguuugcugguacagguuuuucucgaacuccauucccuuucccuacagauaaaaauguuacuuuccuccugcuauauggaggacaucuuccauauggggaugucaucuccuuucaggaagaaaaagaggagggcagagagcucuuccugcaccugcuguuuuucaggugccuuuaccucaaaauaaccuuuaugcugaaguggcauauuguaggguggcauauccugccacccaucauguucagucuccauagguauucugacaacuuuuaucuccuugaaaaguccucuccccagccuucucucucugaugucagcugucuugggcccaaugccauggcuuucagcugaggauuuuccucaccauuaucccgaagacuucuuugcuucuuuauucuguuuucuggaucuuccuuuuucuuguuuacuccuucauuuuucaggccacauccuccaguaacucccugccaaagagugugugggaaguaaauuuucccacacaaagagugugugggaaguguguggggugggcaguagaucugcacaucuaaaacuauuugguagaaauaacccucaaacuauuugauagaaaucuacauuagauacaauuuucucuuacaauauugaaaacauuauauuuccuucuagcuuccaggagugcuguugaaauguccaaugcuauuuugaaccuagaucuuuaguuuguaccucuugauucccauaugauagcuuuuagaaucuugucuuuauuccuugaguucaugaugaugguucuuacugaagccguuucauucaugugcugaguacuuagugggcccuuucaauuuagaacaggaguggcaacuaaggccagcacuguuuuugggccagaucuggcccaccacuguuuuuauaaaguuuuaucagaacacagccacacuuguuuacauauuguguaugcuauuacacggcuaaguugaauaguugugguggagacuauaugugaucugcaaagcuuaaaauaucugcagccacuuauggaaaagguuugccaauucccaauuuagaaaaugaagaauuuugauucugguuuaaaaaaaaaaguuuucuacccccauuuucuguguucuuucugcaacucuugcuauuagaugcugaaccucuuagauugucauuuaaauauuuuucucuucucuuuuccaucucuguuuuucuuuuuguuuguucuuccgcaaaauucccuuuauuucccaagcuuucuaucaguguuucauuccugcuguaauauuuuuuugacaucaauucuucugauuuuuaaauuaaccuuuuuauuguaauauaaagcacagauaucagucaugcccauaaucccagcacuuugggaggccacggcgggcagaucgcuugaguccaggaguuugagaccggcaugggcaacguggcaaaaucccaucucuacaaaaaauaaacugagccgggcaugguggcacgcaucuguagucccagcuacuuuggaagcugaggcaggaggaucgcuugagcucaggagguugaggcugcagugagcugugauuaugccacugcacuccagccuaggugacagagcaagaccuugucuaaaaacaacagcagcgaaaaaaaaaaaaacccacagauaucaaaacacacaaaacuaauauauugcuuaauaaauuauuauaaagcaaccacucuuaaagccacaccccuggucaaggaagagaacauucccagcaacucaaaagcuccaguccaaucacagcccccucugaaauacugcaugguuucaacccacuggguggugguggugguuucagcuggaauugucccaucuuugaacacugaaagccuugucagguguuuauaugguuugccugcguccccacccaaaucucaacuugaauuguaucucccagaauucccacauguugugggagggacccagggggagauaauggaaucauggggaccaguuuuuccugugcuagucucaugauagugaauaagucucacaagaucugauggguuuaucggggcuuccgcuuuugcuucuuccucauuuucucuugccaccgccauguaagaaguaucuuucaccucccaccaugauucugaggccuccccagccauguggaacuguaaguccaauuaaaccuauuuuucuucccagucucaguaugucuuuaucagcagugugaaaacggacuaauuguccucugggucguuuauugugacccucauagucuuugauuguuuccuugccaucugugauagcaggauguuuaagauuccucauguacauucucugcccuaaauugcccauuucuccaagaaacccugguuucugcaaugggaaguggaauuuuaagaucccauuuugguuguuaguaaugcucauugcuacuaaauuagucauuguuucuaguacucuuuggagaacagagcauacauauuuccccccacuuuuuuuuuacacuuuuaccuuaucuguguugucagaauauauaugcauuacauacuauccucccuuccuuuuaaccugcauguagucugucagcuacuaguaacuguauauuuaaugcucacuacuggcccaugcauacugauguuucugucaucauucugauugucugaaacucagucuucaguagauuucucaggaugggaucacaagaacaauauucccugaguuccugcauguucauaauuguuuaucugugaucuuuggccuugaaagucacuuuugcaaagcuacuccucgagaagagcaacuccaagacacguaauugucagauucaccaaaguucaaaugaaggaaaaaauguuaagggcagccaaagagaaagguuggguuauccacaaagggaagcccaucagacuaacagcugaucucucagcagaaacucuacaagccagaagagagugggggccaauauucaacauucuuaaagaaaagaauuuucaacccagaauuucauauccagccaaacuaagcuucauaaguguacagacaagcaaaugcugagagauuuugucaccaccaggccugcccuaaaagagcuccugaaggaagcacuaaacauggaaaggaacaacugguaccagccacugcaaaaucaugccaaauuguaaagaccaucaaggcuaggaagaaacugcaucaacuaacgagcaaaauaaccagcuaacaucauaaugacaggaucaaauucacauauaacaauauuaacuuuaaauguaaauggacuaaaugcuccaauuaaaagacacagacuggcaaauuggauaaagagucaagacccaucagugugcuguauucaggaaacccaucuuacgugcagagacacacauaggcucaaaauaaaaggauggaggaagaucuaccaagcaaauggaaaacaaaaaaaggcagggguugcaauccuugucucugauaaaacagacuuuaaaccaacaaagaucaaaagagacaaagaaggccauuacauaaugguaaagggaucaauucaacaagaagaacuaacuauccuaaauauauaugcacccaaacaggagcacccagauucauaaagcaaguccugagugaccuacaaagagacuuagacucccacacaauaauaaugggagacuuuaacaccccacugucaacauuagacagaucaacgagacagaaaguuaauaaggauacccaggaauugaacucagcucugcaccaagcagaccuaauagacaucuacagaacucuccaccccaaaucaacagaauauacaauuuuuucagcaccacaccacaccuauucgaaaauugaccacauacuuggaaguaaagcucuccucagcaaauguaaaagaucagaaauuauaacaaacugucucucagacaacagugcaaucaaacuagaacucaggauuaagaaacucacucaaaaccgcucaacuacauggaaacugaacaaccugcuccugaaugacuacuggguacauaaugaaaugaaggcagaaauaaagauguucuuugaaaccaacaagaacaaagacacaacauaccagaaucucugggacacauucaaagcaguguguagagggaaauuuauagcacuaaaugcccacaagagaaagcaggaaggauccaaaauugacacccuaacaucacaauuaaaagaacuagaaaagcaagagcaaacacauucaaaagcuagcagaaggcaagaaauaacugaaaucagagcagaacugaaggaaauagagacacaaaaaacccuuccaaaaauuagugaauccaagagcugguuuuuugaaaggaucaacaaaauugauagacugcuagcaagacuaauaaagaagaaaagagagaagaaucaaauagacacaauaaaaaaugauaaaggggauaucaccaccgaucccacagaaauacaaacuaccaucagagaauacuacaaaaaccucuacgcaaauaaacuagaaaaucuagaagaaauggauaaauuccucgacacauacacccucccaagacuaaaccaggaagaaguugaaucucugaauagaccaauaacaggcucugaaauuguggcaauaaucaauagcuuaccaaccaaaaagaguccaggaccagauggauucacagccgaauucuaccagagguacaaggcggaacugguaccauuccuucugaaacuauuccaaucaauagaaaaagagggaauccucccuaacucauuuuaugaggccagcaucauccugauaccaaagccgggcagagacacaaccaaaaaagagaauuuuagaccaauauccuugaugaacauugaugcaaaaauccucaauaaaauacuggcaaaccgaauccagcaucacaucaaaaagcuuaucuaccaugaucaagugggcuucaucccugggaugcaaggcugguucaauauacgcaaaucaagaaauguaauccagcauauaaacagaaccaaagacaaaaaccacaugauuaucucaauagaugcagaaaaggccuuugacaaaauucaacaacccuucaugcuaaaaacucucaauaaauuaggcauugaugggacguaucucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaagucaaauugucccuguuugcagacgacaugauuguauaucuagaaaaccccauugucucagcccaaaaucuccuuaagcugauaagcaacuucagcaaagucucaggauacaaaaucaauguacaaaaaucacaagcauucuuauacaccaauaacagacaaacagccaaaucaugagugaacucccauucacaauugcuucaaagagaauaaaauaccuaggaauccaacuuacaagggaugugaaggaccucuucaaggagaacuacaaacaacugcucaaugaaauaaaagaggguacaaacaaauggaagaacauuccaugcucauggguaggaagaaucaguaucguuaaaauggccacacugcccaagguaauuuauagauucaaugccauccccaucaagcuaccaaugacuuucuucacagaauuggaaaaaacuacuuuaaaguucauauggaaccaaaaaagagcccacaucaccaagucaguccuaagccaaaagaacaaagcuggaggcaucacgcuaccugacuucaaacuauacugcaaggcuacaguaaccaaaacagcauguuacugguaccaaaacagagauauagaucaauggaacacaacagagcccucagaaauaacgccacauaucuacaacuaucugaucuuugacaaaccugagaaaaacaagcaauggggaaaggauucccuauuuaauaaauggugcugggaaaacuggcuagccauauggagaaagcugaaacuggaucccuuccuuacaccuuauauaaaaauuaauucaagauggauuaaagacuuaaacguuagaccuaaaaccauaaaaacccuagaagaaaaccuaggcauuaccauucaggacauaggcaugggcaaggacuucaugucuaaaacaccaaaagcaauggcaauaaaagccaaaauugacaaaugggaucuaauuaaacuaaagagcuucugcacagcaaaagaaacuaccaucagagugaacaggcaaccuacaaaaugggagaaaauuuucgcaaccuacucaucugacaaagggcuaauauccagaaucuacaaugaacucaaacaaguuuacaagaaaaaaacaaacaaccccaucaaaaagugggcaaaggacaugaacagacacuucucaaaagaagacauuuaugcagccaaaaaacacaugaaaaaaugcucaccaucacuggccaucagagaaaugcaaaugaaaaccacaaugagauaccaccuuacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaagucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggacgaaauuggaaaucaucauucacaguaaacuaucgcaagaacaaaaaaaccaaacaccgcauauucucacucauaggugggaauugaacaaugagaacauauggacacaggaaggggaacaucacacucuggggacuguuguggguggggggaggggggagggacagcuuuaggggacauaccuaaugcuaaaugacgaguuaaugggugcagcacaccagcauggcacauguauacauauguaacuaaccugcacauugugcacauguacccuaaaacuuaaaguauaauaauaauaaaauuuuuaaaaaaggaaaaaaaaaagaaagucaguuuugcuagauauauaguccuuggcaugcauuuucuuucuuugaguaucuuaaauauguucucauauuuuuuucuaauauuaaacauugcuauuaaaaacacugauaaaaucuaauuuucuuuccuuguaagucacuuguucuuuuccuagaucccaaagguuugcuuguagucuaaauauuuuccagaauaugucuguuguucauuguucugggucaguauucucaaguguacacuguguucuuuuaguguguaguuucgugucucuucauuuuagcaauuauaguauuuaguaauugaauauuaugaguguuaauuauuauucucacuugguuuucugugaugccacauaagauucccuuauguggcaucuugcuuaucugucuucaacauuuguuagguucuuuugaauuguuuaaaucucuucauuucuuuuugguauuuuuuauuaaucuacucuuguguuucuauuacagguugagugucccuuaugugaaauacuugggaccaaaguguuucagacuucagacuuuuuccgauuuuggaauauugcugauugagcaucccaaauccaaaauccaaaguaauccagugagcauuuccuuuaagcgucauguuugccucaaaaagcugcagauuuuagaccauuucugacuucagguuuucagauuugggauggucaacauguaguuuagucuucauuuccaaaaugauguuuucuuuuauuucuaauucuuuauugaguuuugucaccucauuuauaagcuuugcugguuuuucauguauguaccucuuucacguuuguauaacuuuuaaaucuuuuuagcuuauuugaaauucugguguauuguuggcaugcuuucacucucuauaugacauuguauuucuaauuuguaacagcucuuuuuauucucuuaaucuuuuauuuuguagcaaucucuucucauuucuuagcuauacuaucuuauuuuucuaacgauaguaaggacaagcuguucuuaaaguuuucuucuaccugccuaauuuauuucuucuaauuucccugccugcuccucugcccccacuugaggccuuuauuauuuuagagacuuuucucaaauuuaugguaguccuuggcuauuggcucauguuuaagaguugaacgauuaaaaaaacuaauuagaaagucuaugugccauggguaggacuuguucacuuccacacuuuaccauaaaguaaucugauugagcuguuucuuuguggaauccucugcguuagaaucuuuucauuaauuuuuuuucuuugaggcugaucggauucuucagagaagauucuuucagcccccuacccugaggggaauaagcuuacucauagugcuuuggcagccaaaugaggagaggaacauuguuccucuguaaauuuuuguuuaggaaggcugucucaguugaugguuucccguaguccagacuuucauuuuuacucccuccagagaacaaccucugguagcauaccugagaggagaagggacaucugcugagcuauauggaaggaaugaggagaucuggaagguucuaaguaucucgucucuuuuuucaacaguuccucuuguuuuuagguugauucaacuuccugauacaccuguuguuuucaguugccauauuuuuuguggguucugcaguagaaauuaaacguuugcauugaacuuuccugggccuaugaagucaguuaucauuugucugucuacuuucuaaaaugccuugcuauugucucuucucucauucucuuugucuuaagggugugugugugagagugugugugugugugugugugugugugugugugugugugugugugugugugagaagcccuguucaguguuguuucaggagagagaggagaggcuaauggcaugcauucauuucaccccaguacuuggaccuguauuguacagugaaugucagggaaguuacucuucaggucuccugauucuuuuggagcaaaugauaaaacguuuuucuguugacacauuuugggcgacauagcaagaccaugucucuauuuuuuuuuuuuuuuuaaaaaaagaaauggcugagcacgguggcucaugccuguaaucccagcacuuugggaggccgaguugggccuaucacaaggucaggagauugagaccaucauggccaacauggugaaaccccaucucuacuaaaaauacaaaaauuagccgggcaugguggugggcgccuguaaucccagcuacuuaggaggcugaggcaggagauucgcuugaacccgggagguggagguugcagugagccgagauggcgccauagcacuccagccuggugacacagugagacucugucucaaaaaaaguaaaaauaaaaacagagaaauggucauaaaggaauccuaugaacaauuauaugccaguaaauuaaaccauuuggaucaaauggacaaauuacuagaaaggaaugcuguagaacaugaagaaauguucaccugguaguugacauugugauccauuugcaggcuguuaccuucuccucucaaggaugcaguggaagucucaaccuggagaagaugcuauacaaugcaagaggugaacucugcccuuaguaaaauccagcuggugggauauucucagaaaauugugaguauucauauuacauuucaguuauucaugaaugcuuuccauucauauuguuguuuguuguuuggaagaauccuauaguuacguuuuuaaagccauuccauugcugaggauccagagccucuguucuuuccuccguuccgcgcaggauuuuauuggugcucuuuccccacccucacaucuccaucaccagccagcauucgauuggccagcgugcagggaguccggagaaaggcgucucauccuguucacauuagauuuuauagauuuuggaugggugaaacgggaagagagaagaguuugucaagugugacuuuugagcucugaccuaaaugauaagccuucccauuucuuacugucauccugugcccagagcuacucaguaccgaacaacaagggccuaacaccuaacugaaaaugaaaaaggaaagccaaagugugugagucuuuggucuguuugguaauauuucaucucucccuuuuaaugugugaaccuugagugccuggggacauggaagagagcugaagcucucaggugacaaguaaauauuauaggauugcuuucuuugucugccaguugaucuccaucaucuuucuguuuuccuuaaaacuuucuaguuuacuuuauugauugauugacugagacaaggucccacuuuguuacucaggcuggagcgcagugguacaaacauggcucacugcagccucaacuucccgggcuccagugauccuccugccccaaguagcugcuugaggacuacaggcaugugccaccaugcccagcuaauuuuuguauuuuuuuguagagacaggguuucaccauguugcccaggcuggucuugaacuccuggccucagccucccaaagugcugggauuacaggcgugagccauugcacccagucucugguuuacuuuaaaauaauuuuuguuuuuaaacugaggauauuucuguuguuuuucccugcagaauuaccucaugugacugucacuguaagcucauugcacauucuuacugugguucucuuuuaggagcuuuuuggugcgguccaggugacuccucugagcucuggcuaugcccuugggagcuccaacuggaucauccagucucauuacgagaaagugucuuaugucucuggauccuccuugcuuaccacacacccccagguaauuccaaauucucuucuagcaacucagcuuuuugguuacuuaagucaaauucagaauguauccaaggaaccaucagccauuuuuaaaucuuccaaauaugguuuucuacagauacucucuagccaagguagacuauuugagucucaacauuuugaccuacagguuucucugaaauaguccugcuaccuugagggucacuccuaggauucugaaaucccccaggccuuccaaagaccauagccugaugugggacacagaugguuaugcauuuacucagcaaauauuaacuguuuaaaauccuucccaagggccaagugucaagugucaugcacacaucuggguauuggggauucaguggugaccaacgggcaaagcaugugcccguagaucuuauguuguaggggaguugaugauguuggggagaggaugguguauaguagguaaacaaauaaagugccuggucauuuccgauugagauacaaguacugaaaacaguaaagcagggugauuuucagaaugauggccauugguuuagauugggugcccaggaaagccaaugggaagaucucacuugaacugagaccuggagagauaaaccaugucggcugggcgcgguggcucauaccuguaaucccaucauuuugggaggccgaaaugggauaacugcuugagccuaggaguucaggaccggccugggcaauauggcaaaacucugucucuacaaaaaauacaaaaauuacccgggugugguggcacacgcuguggucccagcuacucaggaagcuaaggcagaaggaucgcuugagccugggaagcggagguugcagucagccgagauugcgccaccguacuccagugcggguaacagagugagauuaugccucaagaaaaaaaaaaaaaggccggguaugguggcucaugccuguaaucccagcacuuugggaagccaaggcgaguggaucacuuuaggucaggaguucaagaccaaccuggccaacauggugaaaccccaucucuacuaaaaauacaaaaauuaggugugauggugugcaccuauaaucccagcuacuugggaggcugaggcgggagaaucacuugaacucgggagacagagguugcagugagcugagaucaugcugcuguacccagccugggugacagagugagacuccaucucaacaaaaaaaaaaaaaaagagagagaaagaaaaaagaaaaacagagaaauuagccacguaaagccgugaguguuuguauuacaaagggauggccagugaagggccccuaaaguaagaauaagcugggcauguuugaagggcagagaaggcuauuguggucacagcguggaggucagcagugagguccaagagaguggcagacaccaugucauguaguguuagcaggcugugaggaggaauuuugguuuuauuuuaauauggagagggaaacuauuggaacguuuuaaguuauucauuccagucauauuuggcaagaagccuagcacauauaaacauuguuaugaaugugauacuuacuccuuuuugguauuuguaaauaauuuacuguucauuuccugaauguugguuauuucuauguuuguaauagggaguggggggacauuaguuagcuguugaauggguauauagauacauuagguaacuuguggaaguccauauuacauuuguuuaucuacaucuauuuacggagagagagagagagagagaaggucuuguucugucacccggacuggaguacagugguguagucauagcucacuguaaucucaaacuccugggcucaagcaguccucccaaguagcuaggacuauagccaccacaccuggccuauuuauuuuuuaacauaaccucaaauuuuuauugucuucauaauaaaaccaaaaaugaagcuaagaacuggaucacuuggccuuuucuccuuuuaucccuucccaguuaaaaauacuuguaucucuaguagccagcauucuccuagaucugcaguugggcccaacacuuaagcuuuagcacaaucucguuuguaguuuuagccuuuuuccagaagauuggcuuggucugccuacauagccaccccuuccugccauuaagccacuuucccuuggcauacagaucaucuuuucccuucuuguaccaugucacucugugggguuggugccaaccaugcuucuuacacaaaguccaguggguuugaagaacauucaccauguuagagcacuaucaguaaagaaagaaagaaauuauucauuuuuuaauuacaaauaaaaauuguauauauuuaugguaugcaugaugucuugauaugugcaugcauuauggaauggcuaagucaauaauuaacagaccccauuuuaauacagggagaaccaugcugugcucuaguguugaacaauaggaugucugagcugccauucuguauuauuucuuuauaccuucuuuuauagccaaguuucaucucaaggucuagaggggacguugcuauuuuuuccugcaucuggcggaauucugggcccuuccugguuauugaaaucaaaagcccaucaaugucaccaucaucugcuucauugaaucaaaauuuuuuauuggcagcuucuaucguuccugauauguucuuccauaaaagacagaaagaugacuugguugccaacucucgcgauuuguccugcuuaguucaaagccuuuacaguacuauugauguaauuuccaguaaauuauucuuacaagguccauaaauuuaaagggaaaauaaugucuugaaaguaaugagcaacauaccuaaguaauuaauuuuaauuuuuagcuggcaaccuguguuauauguaaaaaagaaaaaaauuagauuuuucucuacccacguaauuggauuguguauugaauuggcagggaugagaaaaguuuugguuugaaaaacuugauagacuaaugcagauguuagcaaacuguggccugggcacuaaauguagcaugccaccuauuuuggcauauaauauuuuguugaaguacagccacacccacuuguuuauggaauguuuauggcugaauauacaccguaggcuggacaagguggcucaugccuguaaucacagcauuuugggaggccaaggcaagaugauugcuugagcccaggaauuggagaccagccugggcaacauggcaagaucccaucucuacgaaaaguuaaaauaaaauaaaaaaaagccaggugcgguggcaugcgccuguggucccagcuacucgggaggcugaggcaugaggauuucuucagccugggagguugaggcugcagugagccauguuugugccauuguacucuagccugggcaacagagcaagacccugucucaaaaaaaaaaaaaaaguuauaauggcagaauucuacuuuaaauguuagagcaaacuuugcuaaccccuggucuacuugaguacaaucuuuacuaacuaggaagaauaucacaggcugcuguagaauucugauaaacauggggaaauaaggcuuuggauuaagccugaggcaguaagaauggagaaaagaguuaaaacauuggcgggucuuuaaugcaagaaacauuuguugaaugcccacugucuucagaaaagaaagaauaaaaguuacagaucuuaugucugcaugacauugagaaugguguuaauggccauuccaguuaacaaggaagaguuggcagagggacauuuguugcagaagaggguaguagguuucaugaaugugaauuugagagaacauuagacagauguaaauauggggcuggaacugggauguggaggcaagucuggagacaaacuggagaguugucacguuuuaaaaaucuaaccgggcacgguggcacacaccuguaauccuagcacuuugggagaccaaggcaggcagaucacaaggucaggaguucaagaccccaacauggugaaaccccaucucuacuaaaaauacaaaaauuaaccggugugauggugcucaccuguaaucccaaauacucgggaggcugaggcaggagaaucgcuugaacccaggagguggagguugcagugagccgagaucgcacuauuacacuucagccagggcaacagagagagacuccgucucaaaaaaaaaaaaaaaaaaucuaaauaaagggcugagggccaaagacugauccauagggaacuuuuaccaacagacaguggaagaaagaaaaauagucuuguguaagaauggauggagaguuaaaggaaaauugaggccaaagagugcaaccucccaaagggagaaggaagagaacuagccuuuacugagcaugaggucucaguauuaauuuuuuaauugauuugauauuuagcaaccaugcugaauucucuuaauucuaauaaucuauugauauuaucuugcaaagaaguaacaguuuucucaccucucuucuaaccuuuguaucuuuuauuuuucuuaucuugugacugagcccuauaauacuacguugcacagcaaugaugauaguggacauccuugucuuguauaaggcuguaaaaggaaagcuuuuguaguuucuucguuaaacaucacgcuuacugcaccauguuuauuugucaaguuaaggagugucuccuuuauccccaacuuucugauuuuuuaaaagucagauauaaguguuauaccuuaucaaaugcuuuugagcaugugagaucaacuuugauuucucuccuuugagaccauuaauguagugaacugcaguguuagcuuuucucacauuuaaccauccaauauuccugggauaaaucuugcuugauuacaaucuauucuuuuuaaaauacucuccaggaaugaguuggugaauauuuuauugaaguuuauaaucuauagucauaggugaaaaaugggcccauacauuauuuucuuguacuaccuuuguuuguuggaagccaagguguauuagucucauaaggugauuugggagccuuucccucuuuuucuaaugucagaaaaaaguauaugagauagggauuaucuuuuccugaaaguuuggucaaauguuccauaaaacugucuggaccuggauuaccauuauugaacuauauuuucugggccaaaauugugccagaauuuuggcagagauuuguccuuuuugcuuagguuuucaaaaucauaggcauagagcuauuuauaauccucuuuuauuuguuuaaccuuuuuuguguaagucuguuuucauucuaaauuuuauuuucaucaucaucuugaucagacuugccagaaguuugucuguauuauugauuuuauucaaaaaauaaguuuuugcuuuuaaucguuuugguuguauuuucauccuuuguucugcccuuuaucuccuuccuuccuucuuuacuuuggauuuacucuguuuaauacuugcuaaguguguuucaguguuugcuuuucgauaaauguauuuaaagcaaccgguuucuuaguauaauuuuacucuguuacauuuuugauacucagugcuuugucauucaucucuaaguaugucauaauuuucucuauaauguucaugauuuaaauaaccaaagguuauuuuacaguauaauuguuuguuucuaguccauccagucugauuagacauaggauuagaggaaauguuuuuaagcauauguuucaggauucuaaucuuuugcauuauaauaaacauauccugauggacugaaauuugauuagucuuccuuugaagcacaaucuauuuuuguaaauguucuacgugucuuggaaaagaauguguauucacuguuggguaaaauauuucuauauguauuugaguuuuuugcauuauucaagucuuauaucuuugcuuagcuacugauuucugaaaaggguguguuaguuguugauuuaucuguuucucacuguaguuugccaauuuuuacuuuuuuaauauuucuaagcuguauacucaggaguccauauauucaugaucauuguguuuuaucaaucaguuauucuuuuuaucaggaugcuucgaugcuuucuuuuuuucucuauaaaaacugcauuaaaagcuaagaggcuuuuucccauuucauaugugccugguuuuuuuuguuuuguuuuguuuuuuugagacaaggucuugcucugucgcucaggcuagagcacaauggugcaaucucaacucacugcagccucugccuccgcaguucaagcaguccucccaccucagccucccaaguagcugggacuacaggcacaugucaccgugccuggcuaauuuuuguuuuuuuuguagagacaggaucuuccuauauugcccaggcuggucucaaacuccuggccucaagcgaucgguccaccuuuggccucccaaagugcugggauuacaggcaugagccaccgugcuuggccgggauuuuuuuuuuaaucuagugucucuugguuggugagccuguuuguguuucuugugaugacuauuguaguuuuaccaucuucuuucauguuuuuaguucauucuuuuccuaguccuuucuugccuuccuuuagaaguguaaauuuccuucuguauaugugaaaaugcacauuuuauuuuuauucuucugaguuauuucuuaguuuauuuuuucugugacuaucuuacuuaucaguaucuguaucuuuccucccaaagccacacuguccucaucuccccuaucuccccucaucucuuccuuugcacaucauacccuaugaugaccauggugaaaccaucuagaauuuuaguucugggucguuuagaacauacauaauacaguggugaauauauuccuuacugcaacaacagugaucuucauugagauauauuguaaguuuuucaaccuuacuuuccauaaacaggaucucauaacauccugcuagauugacuuuucuucuuccaggaaugcuugaggaaugggaaucuagagggucuugaagugguaagccugugaggccuugaauuauuaagaaugucuuuaauuuuuuucucacauuuaaaugauagcuuggauggauuaaaaaucaaaggcaaaaaacuucgauaggauaaagcuuuggaaauaugacuucauuuuccacuuguaucgcuuguugucauuaagaacccugaagccauuuagauuugcguuccauuauaugggaucugcuuuuagaauuuucacuuuaauauuuguaaguuuuaaaauuauuucucuucaauguguguuuuuccugugaauguaguaucugugagaucuuccaauuuccuuuaacuuaaauaaauucuuagucauauuuuaaauuacuuacuccugguugauuuucuuuuccuuuuaaggaauuucuaguauuauagauacugacacuucuguguauugcaugucuuuuuucuuguguauuucccaccuacuucaugaagccuccuggaaaaaaucuuccagccccugaauucauucucagcuguauucaugcugcuccucagccuaucuauugaacucuucauuuccacaacuauacuuuuguucacaguauuucuagguguuucucuuuauaccugcucauuuuaauugcccucuguguauuuuugggacauuuuaauacauauauuccuacucucugguucacuaauucucccuguggggauagauuuuagcucaccauguuuaguagaugcugccuuccuugguguucuuguuugauucccugugagcucuucuugcuugacccucagggacccuccucucauaccacugcuucaggcauuguuucuccugagugucucccugacuugucaccacuuugcccuuguggugugagggaacaagcaaggaguggcuugguguucugugaaccuucaucccacuguucuggcauuuccuuccucaugcaggggggcgggggguauugaaccuuccacaaucugccaacuguaauacggaggaaagaaaaaaggacaaaggguuuuuacccagccucuccuccacccgcaguagaggcgauugccugccauuuuguccucauugcaagaccccuaguuuccccaggaauuuaucccaguuuugauuuaguuucucaaauuugucagcugcccuugcuucugagcgucucuguccucucaguuuagauucugggaguguggcagagcauauuggcucaugccuguaaucccaacaccuugggaggccaaggugggaggauugcuugagcucaggaguguucaagaccagcuuggacaauauagugggaccccgucucuacaaaaaaucaagaaagaagcugggcgugguggcacauaccuguggucccagcuacucaggaugcugaggugggaggaucgcuugaguuagggagguugaggcugcagugagcugugacugcaccagugugcuccagccugggcaacaaagugagacccugucucaaaauaaauaaauaaaaauaaaaauagauucugggagcaugccagcaguucaugcccauguguggucuugucaggaguuauaauagacaucuuauuuugaaauaauauuauuuucuucuauuucugauuagaaaauuuuaauuuguauuuauuguaauaauuuuggaaaauacaaaaaucucagagaaaagauaaaaacuauaugaauccugacauuaagagcuauuugcagccugcuuuucuacucuuucugaugaacuguauagugaacuuuacuuaggucaucauggauucuaccacaugacauaugauaucuguuugguggucugucgcguggauauaccaugaaauguuuaacucuuccacuguuggacauuuaaauggcuuaaaacuuuuuuccuuaaaaaaacuuauuucaaacaguuguacagucugcccagaaaaagggcccaggacacaguuuaaaaaugguaauacuaauagaacaaaacaagcagcaccuguuggaaagaucccauaaacguauuggcaauaacuagcaagcacuuuugauuauugaagcugcagccuuucuggcccuggcuaaucaaaugaauggauuugcuugugaccugcgaaccuguauuugaauacuacauuuuguauuauguugguuugaaaagucaacuuaauagucauauuauuucaauagcuucuuggcuacucugucugacuucagggguagacuugaguuugagaugugaaauuccccagcauaguauagcaaaagcuacauauaccuagacguuagggcuugguuuuauuauuuacuuacuuuauuuauuuauuuuugagacagucucacucuguugcccagguuggagugcaguggcaugaucaugacucacugcaaccucaaacucuaugggcucagaugauccucccaccucagccucccaaauagcugggacuacagugcaccagcacaucuggcuaauuuuuuuuuuuuuuuuuuuguagaaacgggguuuuaccauguugcccaggguggucuugaacuccugggcucaagugauucacccaucucagccucccaaaguggugggauuacaggcaugagcuaggccugguuaguuuuagaaacuuaucuauaauagaaugugacacugauguccuuaccaggcuaagauuugaaguauggaaaauuguagggcgugguagaauauuuuguuguuacucuuggcaguauguuuucauuuguguuuagguuuaguuuguuuauuguuuugaucuuuucucaucuuucugaccacaaaagaaaccuggaaaguauccauccuacgccuuuagcucuuaccugaaggccuugaagacucuccagcaccaacaccuuggucucuguucuggaaugaauuuggaaaaccaagcacagccagucaaaugggcuguuuccuucccauauaacuuuuggccuugaagcuaagacacgugguucucugguuucuaagguuccuugggucuaugagggagaaggagaggagagauuauuugaaagcaaggauuccacagggggaugucugccuucgagcagugguucuuaacauuuugugggucauuaaccaaaagccugauaguaagaaucugagagaacuacuccaaaaaaaguaauaaaacauuuaugcacauugacacagacuucgcuuuuuauuucuggggacccugaguuuauggaguccucagaagcccauuguuauuuaucagguuaagaaucucuggcuuagaauuuuggaaauaauuuguuuaagaaaugaaauaaaagaaaaugaauuggcauuuuccacccagucauucccugagcuuaugauguuuuauucuucacugugggaauuccuucuuauccaugggauuggaaggcggugauuggccuaugagaaugucuccuagagcuggcacaauucccacaccuguacuucaugauccuuuucccuuugaaggucaggggaaugcuccuauuggcucauuuucuugaggucuuaaagacucuggcacugguugggccugguggcucccgccuguaaucccagcacuuugggaggucgaggcaggaggauugcuugagcccaggaguuugagaccaggcugggcaacaugguaaaacuccaucucuacaaaaaauacaaaaauuagcuggccaugguggcacacaccuguggucccagcuacuugggaagcugaggugggagucuuacuuuagcccaaggagguugaggcugcagugagcugagaucacgccauugcacuccagucugagcaacagggcaagauucugucucaaaaauaaauaaauaaguaaauaaagacuggcaguaauguaguuucuuaaaucuaaagaaaauaucuuaaauuuggauuucuuguaucaagguuuuuguuuuuuggguuuuuuuuguuuuuuuguuuguuuguuuguuuugagacagagucuuacucugucacucaggcuggagggcaagggcaugaucucaguucacugcagcuucugccuccugggcuuaagaguuccucccaucucagccuccugaguagcuagagguauaggcgcacaccaccaugccaggcuaauuuuuuuguauuuuuuguagagaugggguuuugccauguugcugaggcugguuucaaacuccugggcucaagcgauccaccugccuuggccucccaaaguucugggauuauaggcgugagccaccgugcccagccgaaucaaauuuuuaagaacuaaggcaguugcuauguagguuuguuuuguuuuuuuguaaugauuucuucccccugaauuuccccaaauguuuugcuguuucugcaauacuaugcucugaucuggaagcucuacaguaaaaguuaaaccuaauauauuugggggcuaggguggcagguaggcugagcuacuaauaguccauggaucaguuggagguugguuccaugaagcaaggagggggagacuggacaauuuacuggcccuccaccuguuucuuuccacgcuugcuaucuuguuugucuuaucuggcuguacagcuucucucugcagaauauuuccuucucucagaaguaacguauaccauuuaugugcauuuguuuaguuguucauucauuaccucacauaguuagugauauuuccuaaaccccuacuuuggggaacagaguuaacuaggcuauaggagaaacaugaaauuuacagauguuauaauagggggagaagauguguacaugcagaacuuuucuccagggugcaggugauccgucaaguggaucugcugcuuccaucuccucaccugccaugacauuauaauuuguuucuccugucuggacugcuauaugggccuuaaaaauguucucugucuguuugaucucacccaccuccuuuggugaaaucuccuguaauugcuguuaccagaaugucauuugcugcuucagacuguuggcuucucacugccugcucugucagugggcaugauccugaccuuuuuggcccuuuaccaauugcacucucuuuacucaacuccuuucuccggcccaaaguacacucuccauccuggccaaguacauucauuuggcauaugcaugcugccuugcccugcccaugcccucccgccuccugcagucugcaugcuuccccucaccuuccugacucccacugcacucucccagugugaaauucugacguuuccuaccagaccauguucuuuuuauauauucaucuguucagcaaauguuuguuuaguaaaugcuguaugccaggcauuuugcuaggcaacagggaaacaaaguucuugccuucacggagcuucagaguccugugggggacacagacaaguaaauaguacuuucaguuuggagugaucagugcugagauagaaaguauuagaugccccagggcacauauuaaagggacaacuugguauaggggaagggagagauguccgggagauguuccaaaggcagugagugacccaggcuguugaaauugaguauuaaguuccuuagccaaggagugaaagaaaacuggagcaaaacaucaucugccaaaaagccauguauuacugaccucagcacaccaauguggcugagugaggcccgaguuggguguugcuggcuagggguccccggcuugcaaagugaccaagaagaagaaucacuuguuugugacuuucaacuuuguaagguauuuuaaguugguacuuggacaagauggcuuuuucuuuguguguguauuugaacaaaauguucccguuugcagcacucauugaguggucauugacaccaguaaucuauacauuugcccuuuaguggugaaauggaguuguuugaggugucagcuugguuuggagugucacuaaaagccuuuuaagccugcuucaucacaguagcccugggaaucaacgagaaaugucucugaguuaagagcuaaaauuacaaacauccagucugaccugaucaugagguaucuuacaaugguuccaacucggugacauucgacauucguacuguagcacugccucuguuuguuuguuaguggucauuuaacauucaaaggaagaagaugcuaauggccaagguucagagauaauguuucuagaguuugcucuguguuauauguuuuguuuuguuugagacggaguuucgcucuuguugcccaggcuggagugcaauggugugaucuuggcucacugcaaccuccgccucccggguucaaacaauucuccugcuucagccucccgaguaggugggauuacaggugcccgccagcacgccuagcuaauuauuuguauuuuuaguagagacuggguuucgcuauguuggccaggcuggucucgaacgccugaccucgugauccacccgccuuggccucacaaagugcugggauuacaggugugagccacugagccugaccuguguuauauauuuuuaucuggaucaguaggucuuuuguuuuauuugagagggagagagucuugcacugccacccaggcuaaagcgcaguggugcaaacauagcucacugcagccucaaaugucagaguucaagugugaaucaguaguucuucaucuuuuuggggucauggccccauuucaccacccaguuaaauuuauggaaaaguauacacagaggcuggucgugguggcucacgacuguaaucccagcacuuugggagaucaaggcaggcagaucgcuugaggucaggaguacaagaccagccuggccaacauggugaaaaguuuucucuacuaaaaauacaaaaguuagccgggcuuggugaugagcaccuguaaucccagcuacucaggaggcugaggcaggagaauuccuugaacccaggagguggagguugcagugagccgagauggcaccacugcacuccagccugggcaacagagcugucucaaagaaaaaaaagaaaaaagaaaaguuuacacaggcacacacagaauuguauauaccauuuuagaagguuccuggauccucuaaagucccucaucucccuuuagcccucgggaucauuauugguucauucuaacaagguccauauaaaaugauugccauuuuaagcuaacugugcuauccauugaugccuugguuccuuucucaccauucugguuuccuugcaguugauaacucgcacacgagaaacagucugaggccccuuacacaucugcugcuaagaaucacuguccuguacuucccuuccucucuucucuggaaauaauggaugcauauguauuuguuggagaaguacaaauagaugaguucugcccaagcagagaaaaagcucuuacauauuugugugaauauacuugugcaaauagaaaauagaagcuauucacauauagcugucuucaccacuggccuuuuucuguuuccauauuaaauguuuuucagguuauaaagccgcuuauaacguaagaucaaaauuguguuauuuaaaaaauaaugaagcucauguauccaugcuuauauauaauagaaggugaaaggaaaauacugaaggcacagcuacucggagaccacaaugcagauguugagacuuugcuauuauuuggaauuuuauuuacugcgaaauugggugggagagaaaaaagaggaguaagccuucuuaguaaacuguguugcuggcuuuuuucuucugacgauccacuggguauuuucaauggagaugaggaaaggauguguuucagauggaaaccuuuaugaacucuccugugagcucuccagcuucucaauccaugggcccucauuuugguuucuuauuuuaauccuaauuuauuuagaaaggguaauauuuuuugaaaugcuuugaaaacaaucaaaauuacauucaagcuguggugaguaaaaauaaaaacacagcauccuaagaaucacauaguagugugcccugggaguuccuaguucacaagaagaucauggauguuaaccugugagacuuacugaagucaucuaggggagaugggucaagaaauagccccauuuuauaggaaauccagcucagagcugugacugaggucaugaggcuggucauggaauugggaguagauuugaccuucuaguucccaauccaggguucuucauggcuucuaugccacugggacuuaguguaaaucuccuuaccucuuugaguccuaaauuccauauuccgauaguguaugcuuauuuccugugcuucagaguuauucugagaaucaaauucuauaacguaugcuucucaaagugugauuccccaggccggcaauggcagcaucuccugggaagaugugaaaaugcagauucucaggccccaccccaaccugaaucugaaacucugggaggggcccaacaauccguguuuuagcacaccguccaggggauucugacucaugaagcuugagagccacugaugacacgugagauagcauuuugaaaagaagaaagcauuacagaaauacaagauaccuuguuuuaauggagguaaaauguauauauggugaaacacaaagaucuuaaauguguaauacugaauuuugauauaaucagugccccagugaagauacagaacuuguucaucccuuauaaagcucccucuugccuccucccaucaguccccacccaacuuaggcagccagugguuaaggacagacuauuccuuagagaacauaagagaacucgaugauggguuaaacguagaaagagcaaugucuguguucucguauucuuucacuauuuguagguaauguuccuuuuaaaauuacuaaccauauuucuguguucuuuuucagcccauggaccaagcuucucucaaaaacagcgauguucuuguucugacagggcuuacccagauccccacugcaaacccagauggaauggugggagaguucugcagcaaccuaggugugcaaccgucucucaucuuacguuggaugaucuaucuugcauuuauuuuacaauaauaaauauaauauuuuacaauaaugggggaaggagugcuuacaggguagcaguugucaaaggagggaggcaguauaucuuugcaaauaauagcacagaaaagaguguuacacuuugaacucacagcagcgauacagugaacagauagauauguaugaauguuugugugguuguuuuugagacagagucuucucugucacccaggcuugagugcaguggcauaaucuuggguuacugcaaccucugucugcuggguucaagcaguucuccugacucaaucuccugaguagcugggacuacaggcgugugccaacacacccggcuaauuucuguauuuuuuguagagacaugguuucaccauguuggccaggcuggucuggaacuccugaccucaggcaauccgcccgcuuuggccucccaaaaugcugggauuuccggcaugagccacagugcccggccaaacagguauauuuuuuccccacuaauauuugguugguuuuauuuuuucuucuuuugaggaaaggcuaaauuaagagagguauggggcauuuucuaccuggaagaaauuuauuuuccuucggauauaacugucacuaaaucuggaaguucugcuucucauuuagacaaauagguugguuacugucuuaguuaguuugggcugccguaacaaaauacugcagacauuaacuucucacaauucuggagacugggaagucugagauuagcgugccagcauggucguuucuugaugcagaugauugccaucuugcaguguccucauguggagaagaggggaagcucuggugucucuuccucuucuuuuuuuuuuuuuuuuuuuuuuuuuuuugagacggagucuugcucuguugcccaggcuagagugcaguggcacgaucuuggcucacugcaaccuccgccucccagguucaagcgauucuccugcuucagccucccgaguagcugggacuacaggugugcgccacugugcccggcuaauuuuuguauuuuuaguagagacaagguuucacuauguuggcccaucuggucucgaacuccugaccucaugauccguccgccucggccucccaaagugcugggauuacaggugugagccaccaugccuggccucucuuccucuucuuaugagggcaugaaucccaucauggggccugcacccucgaccucaucuaaaccuaaucacuucccaaagucccugccucucuguaccaucacaguggggguuaggccaacaugagaaucuugugggggacacacacauucaguccguaacagcuaccaaagagguauuaaugagcucagaccuucagcuccagcaacuuuaagugauauuacuucugcucuaggaagaagaaguggucaucuuauauuuacacggaaggcacuguucuuagaaauuaaacuuagccaugcuaauaaacauagucuguuuuuguucuuugauacuaaugcaaagguaauuuauuuguaccuuagaaaaauaauuggacuaaucucaaauagagucuugguuuguauguuuguuuauaaucuagaaucacagacucaaagaacuuuaggcuugaaaggaaccuuacauuuaauucagucucccaaagugggguccacuaaccgcauucccuuaagaccaaugggauuacuuauuaaaaaugcaaauuugggggcccuaccuuagaccuaguaagucagaaucucuggggaaaggagacuuccagaagaaaaguugcauuuucaacauguucucuggcauuuuccacgcaaacuaaagcuugaaaauuacugaucuaauucauucuuuucauguaacugaugcagaaacugaggccaaggaagguuguaguggcuuuccugugguccuguggguugggacaaagguaggauuugagacaggcucuugagcuaugaccagcgauguugauuuucuccacuguauccuacucuaguaccauacucuaguaauagcaaguccaccagcccucaaguuauagcaucuaggugagccuaaguacuuaaaguauaggggauuuuccugcagacaaauguuaaugaaagaaaauacuacuaacuccugcagacaaacguuagucaaacagaaaaacucggccuauuuucuuauaggucauucagccauggucagagacugaacagagacaaauccagcaaauuuuugagcaggaucuaaaacgggaaggagcuuggaggcucuguccugaagcucagcugccauugguaaaaacccaaacccguagucacaugcucuauucccagggaccuagauuagacaaugaugagaaaaucauuaucagccuauagcauccccugcuuugauguguucuucaaaagaagcagcuuauuagacauguaaguaaaucauaaaaacagaaguaggaaaacaagugcaaaucuuauuuuacaaguuuaucuuuauaacacugcccuuuugauaugauguuuuuucuccucuggcauccacuuuucuagcucugacaguccggaauggaggaaacguguugguucccugcuacccuucuggagugaucuaugaccuccuggagugccuauaucaguacaucgacucagccgggcuuuccagcgucccccucuacuucaucuccccuguggccaacaguucacuggaguuuucccagaucuuugcugagugguauguccgugguuuuuuuuuuuuuuugugaauuuuauuugauucaggacauucaagcaguaagaauaaaaauaauccuguuuuuucucacauuacuguggaaauuucauuuuguuguuuuucugucugugauaagauugcauuauuaaaagccaaaucuguugcauugcuaaguuuagaauaauaguugucaaagagggaagaaugcaaggcagagacuuaccuuagcccagcacuuucaaaacugguaacaaaaaucuuauauacuuaucacaugucacccucugccuguuacuaggugaaaugacauucuaaaaguuaaaaaaauuuucaagcccaaucucauguugucuaaaauguauagugccaaaucugagaagaaaaacuagauuuuuaaaaauugcaauaguaugauauuugacaaaauuuuauuacaucagaaaauugaucaaauccuagaguuggcaaaauaugaaacaauaugaaauuagugaaccuuuuuagaguuauuuaggugcauguuugaauguaacucaccugaccaaaaauaaagggagaagaggaaaauaacuuuuacaauauccccaguggugccuuagaauggugcuucccaaacguuccgggacugugacacaggcagucuaggcugcauuuaaucccuuuuagucaugagguagccgauagacacagcauguacugaguuucuaauuaaaaaggaauuuguacaucaucuucucaugauauauucaguuacgcugcccccaacccuugcuuuuguaaaguacuuuuuucauucccuucuguggucguuuuuuuccccgcuguguuuagacucauacaggcgucucuaucccauguacaaauuauucuucuuugucacuuuuuuuuuuuuuugagacggagucuugcucuguugcccaggcuggaguacaguggcacaaucuccgcucacugcaaccuccgccuccuggguucaagcaaaucuccugccucagccuccgaagaagcugggauuacaggcacccgccaccaugcccggcuaauuuuuguauucuuaguagagacaggguuucaccaugcuggucagcuggucucgaacuccugaccucaggugauccacccgccucggccucccaaagugcugggauuacaggcaugagccacugcgcccacccuuaaauaacauuaguacauuauuauuaacucugaaucuuuauucugauugcaccaguuuuuccacaaauuuuuuuuuuuguuuuuguuugggauccaauccaggguaacacauugcauuuaggccuuugauuuuuuuguuuuuuugcaagaaguuuuuuuuaguuuuuuauacugauaguuuuagucucuuuugcaguuucuucuguugauacuauguuuagaaaauucuugccucuauaggugucacauggcuaaacauacuuucuuucaguuuuauuguagcuucuuucuuucuuuuuuuacaucaccccuuaacuauuuuaucuggaauuuguuuuaguauauaguaugaagagaagcauuaauuucauuuuuucccaaguagucaaguacuuaccuguccaaguacuauuuauugaguaauguuaacuuuuucagcugauuuguauuaaugccauaugccagacuuucauaugcaccagguuuuguuucuagacuauccugauugagugauccauucauucuuuggccaacaugaugcuaauauauuuuaauaacugcagccucacuuauaauuguacucugugguaaaguacauuucuccauuauuuuucuuagaauucuuggagcuauuuuugcuuacuuauuuuuguggaagaauuguggaaucacuguaucaguuuucagaauaucuuuuugaguccacaaaaccuauaaauuacaguuugcaguaguuuucccaugcugagacaugggaugugugucugucuuuuaagcuuuucaaauauuccucccguagacucuuaaacucagugaucauauuauucuuguuuccaucgauaguucuauuugcuuaaauccauaaaccuuuaagugccaaagcacugaggauacaaagaggucccugaccuugaggaaucuguaccaugaaggaagaggcagcuguguaaaccucuuaccacucggaaguaaucugauggaaauauauacacacauacccacacacacaccuacguauaucuguaugguauucagagaagggguggguggugaccccauuugggggguuaagaaaggcauucuggaaggaggugcuccugaagaauaaccaagaaucagccagacagaaacacuauuuaaggaugaguuggguggucugccggcggugauguguggguggagaggauaacacaagccaagacauagaugggagguuagaaugguuugguuuguucagagaacuauccauaguucuuuauuguuacaguaugaaguucaggguggggaguggcaggguaugaggcuagagggauccuguccaugggggggauucauuggaggauucuaagcaggaaaugaacaugauuauaugugcauuuuauauagagccuucugcauuuaugugaaguuuguugggagguggugggagggggugcaacugaaguacaagacaagagucuuugcagaagucgagggacugaagacuccagucucuaccauccuggaggaaagcaaggcaggaacccauaugagaggugauuaggaaauacaaggggcaggacuuacugguuacuugauacagaaaagguagcaaucaagauugacaccacaauuucuaguguaguagaucguguugaccccaaacaaaauagguucuacaaaggaaggguagguucauacagcaagugugguuagcuuaguuugguuuugucccugagggcauugacggugccugaggcaggggaugugcaggugaaacuuguccaauccaaagaucugagaagcccaggcuggagucauagguugggguguccucagcguugagguaguugaguggcugggauugccacaagaaugaaugggauugucuggggagaggauuugagguuagaagaacaggcaguggggaaaggauggacuuaaguaaugccugcauuuuuggggucauuagagaacaaauauuuaggaaaagugugaagacaaauaguuaaagaaguagaagaggccgaucaggguggcucacaccuguaaucccagcacuuuaggaggccaaggcgggaggauugcuugaggccaggaguucgagaucagccugagcaacauagcaagaccucauuuccacaaaagauuaaaauauuagcaggguaugguggugcauguccauaguuccagcuacucgggaggcugaggcaagaggauuucuugagccugggggauuucucuguguuucuguuucacugugcuguucucuuucaugcagccuugcuguaaggcacccuuuuucccuaaauaaggaacucaguuaccaaaauggauagcugcuagcuccagacuugcauuaacuuagcaagucccagccccccaugccaggaccaccacaagccugugcugaggguuuggcuuccucuccucuuugguguucugaacgggugcuucacagccuggcugcucugugcucagccucaggcccggccugcuguucccuaucacucugguucccuggcucugugcuucccguucucagggguucugcucuggcuucuacaugguccugcuuugaugccugcagaagcccagccccuugcuguccagugucugcccuugcuccgagcuaaggggcuugguuguuuggguugguuuuguuuuugcaggggauggagaugggagggaauagcucuugaaagaccucucugaucuuuuggaguuuggaguguugggguuuggaguguugguugguugguugguugguuuuugagacaggcucucacucugucgcccaggcuggagugcaguagcacaaucacggcucacugcagccucaaccuccuggucucaagcgauccucccaccucagccuccugaguaccugggacuacaggugucaccaucaugcccagcuaauuuuuguacagacaagguugcaucucgucugaacccaugaacuccuggguucaagugaucugcccgccuuggccuuccagaguggugggauuacaguccugagccacagugccuggcucugauccuuuuuugaacaagcaguggaagagugugcgguaccugaggucuggccaucagggagcaggagggucugucacauucccaauuagagauaaaccuagaagcgccauuuauucuucauucuuccugauaaucugguauacacagaucuccuuuugaacucuaacagcuacccccagaagaagcaaacucuaaucagguccuucagccucugucuuagaaagggggugggucccugucugcugugccugcaugaggauucuagagcagaguauggaggaucuguuagcagaacuggccuaagcauuauguaggugggcuucacaaucucuaaucauauuguaaucucuucuguaucccuaaucucugccuuuaaugcauguaggauaauguccuuuggaacaaucaaaauaaguuuagaaccaagcucuuauauuugucucccugagcuagaaauaaagacagaacuagugucuauuuagauaauauaagguaacccuccaaaagcaucuugcucuuccauauuuauaucuuccaaguaggguauaaagugauguuuuuuuaaaccaaacuuaaacgaaacuaaggguaggaaaaauuagauacaauguauuaauacaaaauccaagcccugaaguccugagcuccuccccucaaaguagugacuauuuuuuuaaaugucaaaccugcacaacacccacauauauugauuuaucaacugugaacuuuuugccacauuugcuuuauccagacaucucaguauuguaaagucauaacugacuaggaaaaagcaaauguaaauuaccaaaaacauucacauugucucuagccugugauccuuuguucuucucuaguuggaguuaccaaugcugcuguuaaaaagagugugagggccaggcacaguggcucacgccuguaaucucagcacuuugggaggccgaggcggguggaucaccugaggucagcaguuugagaccagccuggccaacauggugaaaccccgucucuacuaaaaauacaaaaauucgccgagugugguggcaggugccuguaaucccagcuacuugggaggcuuuggcaggagaaccacuggaacccaggagguggagguugcagugagccgagaucgcgccauugcacuccagcugggcaacaagagcgaaacucugucuccaaaaaaaaagugcauggacaaaaacagaagccaugucucaagguguagaucacuuucuuugugaaauugaccacaacuaaaugcaauaugauaccacggauuggauccuggaacagaaaagggacaugauuggaaaaacuagugaaaucugaaugaagucuggaguuuaguugauugucauuggccugauguuaauuucuuaguugacgacugugccagucauaucagauguuaacucuggggacauagggugaagaggccauggaaacucuguacugucuuugcagcuuuucuuuaaaucuaaaauuauuccaaaauaacaaguuuauauuuuaagaaaaaauguauugagaaauucuaaaguuuaaaaacauacaagauacaucucuucucuguaggcacuggauuucauucacagugaaauucacuggcgggaaauuuuuaaauaaacuucaguauuuaauauuugcacugcugccacuagguggcaacagaugccaccguaugcucuuccucacaugcugauguguuuuuccucuuuaauaggcuuugucacaacaaacagaguaagguguaucuuccagaaccaccuuuuccucaugcagagguaagaaaacaaaaucacugggacaugggaaggaagcaauguggauaaccugaugcagaugcagacagcaggucguuagaugaaauagauugcuguguaaaccuguagaccccuuugccucccaagucagacacagggaaguauuuuaacucaagcuucacuugcuuuccuccuauuaacacuuucuauugcgcacguggagcagcccuucuccaaaauguuguggaccgcagaauuguuucagacuugggauucgggaauauacuuacugguugagcaucccaaauuugaaagucugaaaucaaaaugcuccaaugagcauuuccuuugagcaucauguuggugcccaaaaaguucagauacuggaacauuuuggauuagggaugcucagccuguaccauguucaugcaauucauagccugcuucuguucuacugacugcaugaugaauuguauuucgauacauauuacuaccuuuuuaaauuggguuuauguauugucagaguguucuuuccaguuaugucagucauauauguacauuuuuagugacgaaaauaacauuucaguucaacaaauaaaaggcuucuuccucccucacagaacaaauggguguuuucuauauagcugaauaccuagcuuuguugucagguucuuuucacccaaggguauauuaugaacguuuuucugcgucucauguuauuauugcucuacuacaaugaagcuaacagacaauaguuacuccucauuuuugguuauauuuucacucaaagauucucuaaauugguaucaccaccuuagaaaacugacaguauuggcugggcucgguggcucacgccuguaaucccagcacuuugggaggccaaggcggguggaucacaaggucaggagaucgagaccauccuggcuaacacagugaaaccccgucucuacuacaaauacaaaaaauuagccaggcgugguggcgggugccuguagucacaacugcucgggaggcugaagcaggagaauggcgugaaccugggaggcggagcuugcagugagcccagaucgcgccacugcacucuagccugggucacagagugagacuccgucucaaaaaaagaaaaaaagaaaacugacaguaucugcuaaagcugaacaauguacucuaugccuccgcaguuuuguuccuaaaguauacauugaacagaaaugcauagagauguuaccaaaagacacacacacaaaucuagaauuuggucaggugcgguggcucacaccuauaaucccaacacuuugggaggcugaagugggaggaucacuggaggccaggaauuugagaccaaccuugacaucauggcaaaacccugucucuacaaaaaaauacaaaaaauuagcccggugugguggcacaugccuguaguucuagcuacccuagaggcuggggugggaggaucaccugaagcugagggaguucgaggcugcugcagugaacugcaaucgugcuacuuacugcacaccagucugggugacagagcaagacccugucucaaaaaaaaaaaaaaaucuaaaauuuuugguaauaguacugaaauauacucaaauucccaucaacaauagcauggauuuugugguauacucacacagucccuuacaucacugugaacaaauaagcuccaauuauaugcaguguagauaaacugcacaaacauaaugugagugaaagauccagauauaaaagaguagauaugguaugauuuuauuuacauaaaaguucaaaaacacaauaaacugaucugugguauuagaugccagugugguagugauccuggaggggaggggacaguagugacaggaaggggacaaagagggauuucugaggagcuaguaaugcuuuauuucuugauguacauguguucaccuuguaaaaaauccaucaagguguacagaguuagauauaaggaaagagugaaggcuggaaugaauccugugcuguuggauagaauugaugguauuggugugaacuccuauuuucaauauauguagauacagaaagaaauccacuugugcauguguguguaugugugugucugugcacauacguaucuuccagcucuggccacacagagggccugggagcagugacaugccacuaacugaggaacacauuuagcucccacauguugguuucuagauaccauucuccacuaaaaggaaccaggccucuuuggaaaauacaagaugaggcuguaagaucuugcuguaugcucagagaaagauggggacaugucagaagccacaucugaggucacuggaacaucaaaauaaauaaugcuaguaaugaauauaauccacugaauaacagaaacuccugcauccauagugagguaacugaguacauaggcaagaggggaaaguucuuccaacaguaaacucauaguuaacauaggaaagaaccuuagaauuagaaaaucaccauuuggcagccaccgcaguaauaauuuauuccugcaagaaacaccagugggugcuaaaaccagugggugaaaauguuaugaagaacuagaucauuuauagucccaaaaaguauguccccacaaaagucauguuuauuacaaagacagaaauaguaacuggaguuuggacaaacuugacauaugcagucaacguuaacaucaccaguaauuggacuaacugacauugcguggcucuuaacacaaauuauugagaaagcagcaugauuucugugauccugcugcuaaaaaugcuucaccugaaucuagugagcauucagacccaagucgaggaugcucaacaaaauaacugaccuguacccuuugagaaugucagagaccuagaggacaagggaagacugaggaacugccgagagaaugaagagaugugacagauagauguacuccauggccaugggcuggaucuggaaauggaagaagaaagaucuaguuuguuugcuauuaggagcauugauaacaguugguaaagucugaaucggguguguagaugagagggggcaguguugugucacuguucauucccugcuuuugaugguuguacuguuauaauacauccauguuaacugcgauuaucuccccacacucauuucuuugauugucauauuuauaaccccuccucaacuaaggcagguagacuguuuuuacuuacagcaugucagugcagauagauauguuuagggauuuaguuguuuuguuuuauaguuaacuaacacguauuucaacaaauguccugcuaauuacuuuaaauguaauugcuguuuucauacuguaaaggauaggucuuuuaugaaccaggaugccaaguagaagguuuugaagaaguuauuuuuuggucccuguagucuaaauaguauuuuggcagccaggguuuuugcaagcugugucaaugccauagugaaacacaggcuagaaauauuauaaaaaugucagaaaauuaaguguggcaaaacaucuugugguggacuuugcucuugaaugucuguuuugcuuccuuugcagucagccuugcuguagagcuuguuuucuaggagugugaucacauucucacucacacaccugucacaaaugaccuggugccauuuagaguuaggaaugugaguagacuguggucguaccaugaggguuccucaggugcacuugucguuguuagggcaugagggagucaacccuugguaauguuaccaaugcccaugagaaacggugguuccacccuuaguacugguaacaaauuacuguucagaauuccugccccacagcuucauuuccacuggucaaaugcaguaaguuggcuagaaagguagauccaauuggcaaaaaacgaugaauuuaucuuaguuucugugcauugaucaguagagcuacaggaacuauagauaaugcuuaaaagugacuuacgugugcagagaccugcugcuauucuuagaaucacauucaucaucuugacaucuuaggauacaauagacccuuuuugacagccacucacccauuuaacugagacaacuaaugauuuuggccauauaguuuauaaaaagaaugucaguucaacuugcagacuaccuggaaggaacgugggaauucgauguuugcuccggcuuuacuauucauauuccauccaagcaugcgacagcugaugaagaucuccaggacaguguuagugucuuccuaauacaaccaggucucuucaauuaaagaugaggucuucaaggugaagagaguuuggcuucuguuugggguauguccuauucuggccacauccccacucuuagggugacuucauuugcacuucaagguguugcccagggcccucucaugcacaacauguggcaacaggauugagccuaucacaggccauugcuuuauccaugaaacagccuuccagagcagugcuuccuuuggccugguugauauuuagggucugugaagucugggugucuagccucuggaugcugggguggggcaaggaggccugggcagcaggcacagugucugagacguuacaagaugccaucuagucauaacugucuuugcuauugccuugaaugggccugacacugggagaugauugucaaguguuaugcugcaggggagacucuugguucaacacguacacuugaaagaaagcuuugaggcugcggggcaccugcuucuuuuuuuuuuuuuuuuuuuuuuuuuuugagacggagucucacugucgcccaggcuggagugcaguggcgccaucucggcucacugcaagcuccgccuccuggguucaugccauucuccugccucagccucccgaguaacggacuacagguguccgccaccaggcccagcuaauuuuuuguauuuuuaguagagacgggguuucaccauguuagccaggauggucuccaucuccugaccuugugaucugcccaccugagcaucccaaagugcuggggguuuuuuuguguguguauguguuuuuuuuagugacagggucucaguuacccaugccagaauacagcguugcaaucauagauuacugcaaccuugaacuccugggcucuagccacaguauccaagaacuuuuuuuauuuuuuguagagacagggucuugcuuuguugcccagccuggucucaaacuucugggcucaagcaauccucuugucuuugucucccaaagugcuggaauuacaggcguaagccauugugccuagcccauuucuuaauauaacugucuguguuaccaggacaucacauuucuaaaagccaauuugaucuuugucgugcaugugugugugcguguaugugugcaugugugcacacauguccacaugcuguacacauucagagaagcuucucuaguagcaaacaacagaaaugaucccugaaaguacagucuuuggucuugguccuuauucaguugcugcaguagcuuaacacagcucuagcuuugcaggaggagguccuguacuggcaaacaguguuucuggugugacgaaugugguuacugucaccaggacuuggugauucacgaguguugggaaagucacuuguacuucaaacaagaagugauaaugagaacuucaggccugguguggagugucaggcagcuuauaaaggaagaguccagcuaaagcaggccauaacaaucugaauauguuuccaggaaguaugucaguauuaccagaaagacuugacuugcccauguguuccacaaaucacauucuggguaaaaacuauuuuaauaagauucacuuguauuuuuuuaaauuaauaaguguuacuuuucacagcaguuuuagguucacggcaaucauaugccccugccccacacacgcaguugcccacugcaccaucccacaccagagaggugcguuugcuacggcugaugaacccacauugacacgucacucucgcccaaagcccagaguuuacaguagggguucccuuggcguugugcuuucuaugguuuugaacaaaugaacagugaccuggauccaccauuacaucaucacacagaggagcuuccucacucugcagauccucugugcucagccuguucauuucacucuccacgaaucccuggugaccgcugagccuuuuacuaucuguauaguuuugccuuuuccagaacgucauacaguuggaaucauaggggccuuggcuuuucagaguggcgcccuucacuuaggaauagguuccuucaugucuuuucguagcuuggcagcucauuucuuuuuuagggcugaauaauauuccauugucuggaugcaucaguuucauccuucaccugcugaaggacacaucuugguuguuuccacguuuuagcaauuaggacauucaugugcagguuucuuguggacaugauuuuucaaaauaucuuucaaaguggcuguauccuuuugcauucccaccagcagugaaugagaguccuuguucuuccauauccuugucagcauuuggugcugugaguguucuggauuuuggccauuuuauuauaacagguguauagugguaucucaucauuuuaauuugcaguuuccuaaugacauacgguguggagcauuuuuucguaugcucauuugccaucucucuucucugaugaggugucuguucagguuuuuugcccacuuuuuaauagggcuguucauuucuuuuugcugagguuucggaguucauagauucugggucacaguccucucucaggugugacuuuugcagguauuuucucccaauccguggcuugucuucuuuguugguauuuuagauccagucccgcucacccucccguacuuugguucccccuucagccugggcaggcucacauuucuuuguauuuuuucuauauuuuccagcucauucagaccaauaagcugaagcacuaccccagcauccacggagacuucagcaacgacuuuagacagcccugugugguguucaccgggcacccuucccuccgcuucggggacgugguccacuucauggagcucuggggaaaaucuagucucaauaccgucauauucacggguaagugaaaaaaauaaagaaacaaauugguucucuccacugaggccaugagugaaugcaccuacaagguagagacccagggaaggauuuugcagugagacauaaauacaaacauuguucuacuguagguaccaaagaaugaagaaaccgcagagaaagagugaagcagugugugccauuggacagcugggcauccagcgaggccuucaugccuguguuuucagauuucuccaagacagaauccugcugagugcuuuugcuaggauaucguaagccauuucaagaagugcagugauucaguaacgguguuguuuuaccuguuaggaauuguuuacagagguagaucuuuuucuucugauugugguuuacucuaacuguggauuuucuucuggagacaaaucccucaggggaaaaaauuccuuugauaaggucaaguagaguguuuacauagauaaugacuguaucauuuuaucaguguagcgugcccagcccuuugaaugcuaggucuuuuuugcuuaucugugauaggggauaucuuggaaauuaugcacagaccuuuuuuuuuuuuuuuuuuuuuuuuuuuuuuuuuuuuuuuagcucaucagucaucauuaguguuaguguauuuuauguggggcacgagauaguucuucuuccaguguggcccaaagaagccaaaagcuuggacacccauggguuagggucuucagucggccuuggguuuuagaaaucuuacaggcuaugaagaaaaaagaaaaaaaaaaaaaaaccuugauuugaaaucuggcccagcuugcagcaaccucagccaauucaccagcaagcaugacuguccccacaguaaaugggacugucaguagcuaccucugugggucacucugggcaccaggcacagaacccggcacauggcggcuguugggaaagcacugucaccagcucccuuccuagcuuuaggagcugggaauccaguuacaccagaagcacuggggugacgcuucagcccuucccccagcuuucauuugugaccuagaggccaccaggaacacgccuguggucaaaccaaguuggguuuauugccucauuucagcaaggggaacacacaccauggguaaaagaaaagcaaaaagaccuugcaggacuccggcugguguucggugaugcgcagguguucgcggaggugaggcgucacccuguauuggguggcgucaggaugcagggucauucugcgauggguuucuuaacucauucuuaucuagaacacaggaagaauggagccggcauagcgggaaguuugcuuaugcuguggucaggaaaguucuguguuccguguucaggaugauuacagaggggucuugucuuuggccggauccaucauugucagacaagguguugguguuccaggaaguugcguucacacagcaggaggacacauggcuuugcugugggugccaggccggcucuugcugauaccaggccaggcagaaagugccaggagaggccccggucaccaggacugcuuuccucuucucaggccugcuuugggcuaaagguggaggaaguugggccacaagauauugauugacaacacccagaacuucauagcugccaagauuucauuaauuaggagguuguccagagaauguccuauguaguggggcugagguuggugucuccugcuccugcugcugaguggugacucgacauuugacaugacaguggugacagcaucuacacagcacaguagauaaccuggccuuuaguacaaauguuucuucagcuaaaaggaaaucaggacugugugauuuccugugacaacucuggguaauggguuugcauuuaaacugguuuauggggcuuccagggcagaaguugugucugggagagguuggggccaucuuuuuuuauuguuuugugacuccuggauacaugaaaagggggucaguauucucagagaagcacaauccacuggaaugggcauuuauguaccuggcagcucugccaguuuguccugacaacaguggagacgucucugugucuggugugccuaagccagggucccucgucgcugggcacagacugugcugggaaucaaagugucacaucaguuaggaccgagcgaggucuuuuggcucaaggcaggcagcucccucgaguugggggaauguucccugccaagcaggcugcagcagcccucaggagacaggcugagcagagggcgaggacucuucccggucugaggggcuggggcugcuggggagcaucccagucucagucuacagaccauucacgggccuggaggcggggccgugcgcuugucuuccgggugcaucucacaccugggcguuaacucagagcugauucuagguucccgggucuguaccaggccucuccacugugaagucaguuuuucccauuguauuaaaucaguaccuugugggggacucuuugaaacuauauacauauucuguucucccucaaaaugguaucugauauuuuuagcauuuguugaugauuuucaucugaauaagugaugaacuguaaugguugccaaacggugguuuugguuuuuauuucaucguuuguuucuuggcauuucguuguaaaaagagcuuucuuuucucccccacauauguauuucucccucauuuaccucaucugccucugcugaagcuuggagcccacccacaggguccaucccagccugccccuccuuccacggggccccuuugaccuccgucccccacgugugcuuccuggcucccuccugacccccugacugucugugggcccucagcgccccaguugcugucuggcuuggcagcuccuguguagucugcauuguaagauuucuuucuuguacuuucccuagaaccagacuucuccuaccuggaagcccuggcuccuuaccagccgcuggccaugaaaugcaucuacugccccaucgacacccggcugaacuucauccaggugucaaagcugcuuaaagaagugcagguaaugaaggacacugcuugugccuucacguagucaugucaccuugguguggcucaugcuuguguggggugaggggagagagaucuagcuguguuugauucuugucuucaguucucacgcaucugcagaaugcugggacacaugccagccccccuccacacugaaaaggaguggucuuuacacccugaccgcaguuuccauucuaaagaaaucagauguggaagggaaagaaaaccaucuguguccgcuuaaaagcaaacccucucaccccugccaaaaaaaaaaaaagucauucuagaaacauacucacuaagcugagacaguuuaaaugaaacgcguuacuggggccgugucgcacguguaggcugguaccacaaacagugcugucggguuuggguuuuguggcaguuuuuggucauuuguuucacuucacauuuucugcccuggagaaagggaagaaguagcuggggugcaguguagaccaggaggcgcgcguagcaggaaggcagggccacggaaccacugugcuggcucagccacugcucgcuggguuucuggcucuugagagucgggagaggaacuggaauuggcaaggaggacagcugacaccggcgaggaagagcucucccuuuccacucccugguguucccaggagugagaugaggguggaggggcccagcacagcaccuucaaccucaggaugagagaggcccuuucacaaaacucuaaggcaggggaacaggaaacagagaaagccggagaaccccaggagggccccaagagcggauucuggugauuauuaaugugcuugcccaaugaagaaagaauacuggcacucucuagguaugaugagagcagacagcaaacguggggccugucuacagugauucgcuaccccaauguaugcucauccacguuagaagcagcagugaaaggcguguugcuuuucauuauuaacuucaaaucccagucccuaaaccagcucuugacgccccucugucaggugcuaauccuggaaacuggaggccaccuggucuccacuuuaggugaggaaaaccugggagaagccaucagacugcaccuguggcaugagaugcuuugagacaggucaagaggaggagcaaagggcaguuuggaggagaaaaguauuagcccuaaggaacaagugcuuuuggaagcucagcccggucagccugguggaaagccgucuucagcagggaauucagggcuugguccaagcucuuaaguagaagcagggacaacacagugccccugugggcugccagcauuccuuuucauuugggugauauuugugcaaaguaaaaauugguuuacuaaucuuuuuuucucaagauaacaaaaagagacauuuuguuuaaaaaaaaaaacaaaaaaaaaaaacucugccucugcuccuugguugcacauggugagcacaugagcugaggagugcccacugccuaauaccagcugaccugcagauccagcggaaacuccaaacccacagcgccagcccggcacgaaaagccacagcucuugguaaucagccaagagcuuauaauagcaggcaugugggaauguuagagaaagaccgugccccgaggaagcccagagaccgcugggagcagacacauggaaguuaccgugaaacuuauguaaagaguaagaaagauaaauuaagcugaggcaguuuagggguuuccgagauguuucuucugccccagugccuucacguucccucuccugucuacgguucauugggcuugagaggaugaaaguucaccuuggccuggaaguggugagccuguaauggcggggaguggaucggggucaggaaugggccuuccacaggggccacuguacuucacaccaccuuucucaacugucccauugguuccucagccccugcacgugguguguccugagcaguacacucagccgcccccagcccagucccacaggauggaccucaugaucgacugccagccccccgccauguccuaucggcgggcugagguucucgcccugcccuucaaacgucgguacgagaagaucgagaucaugccagaggugagcuguucuccuuccuaggguuaaacuagagcuuuccacagaggcucuuggagaucgugcagggguggccuucuuuuggauuuaugucaaguauaaaugaaccaggcugcgcgcaguagcucacgccuauaaucccagcacuuugggcagccaaggugggcggaucacuugaggucaggaguucgagaccagccuggccaacccagcccagccaauauggcaaaaccccaucucuacuaaaaauacaaaaaaaguagccaggugugguggcacgcaucuguaaucccagcuacucgugaggcugaagccugagaaucgcuugaaccaggagguggagguugcagugagccgagaucacaccacugcacuccagccugggcaacagagugagacuccaaguaugaaugaacaaagaacauggacccuuaaccaaguaaccgggaagaggggggauuuucagggccuucuuguuuuucaacuaauaaaauaacagcuguuagucaggacugcuccuuaccuagcauucagcagcgugagcccugggccacaucaugggucagagcccugggaaguggagaugcugacacccgcucugucccuaaauaccauaggauggugacuuuucucuuccuuccuggaccucaguuaugagugagugucaagaguuugcugaauucagagguagaugggggagauaacaggaaccaaaaaauaaggauuguaaacuugguuauuuauauccucuugagcauacuugcagguuuuggucuaucaaagucuaaguauuuuauaggucugugaacucuuagcuucaguuuuagcagggaaagagccaaagcaugcuguccauguugaacagcuguggcaugcugcgcuugggccacuccucugagagggagacagagagggacgcggccucuccugaaagacagcguugaggaugguuggaggcuaccucuggcuuccuuucaccucuugaggcaacuugaauguguuuucaacagacaggaaaaagaaauauaaaaacuuauuguuaaaaccagugugcccaaacuucuuuuggagucugagguucagaaauggccuccagaccuuggguuggaggucuuggcuccugaaugugacucauuuccaugagccuggagaggcugcuagggaccaccaggugccaucuuuaugguuguuuaauguuuaauauguuuuuaucauuuuguuaugauuuuuucacuuucucuggauuguuuuugucugguauuuuacaggggcugggauugacggccuugguuuagauuucaacucucuaagccagcauuccuuaaaccuuuuggucucagacauccuuacaaauagaacuccaaagagguuuuguuuauguggguuaugucuauugauguuugcuauaugagaaauuaaaacuaagacauuuuaaaaauauucacuuaauaauacaaaccuauuauauguuaacauaacuaagggauaaagacaaaagcaaaaaucagucccagugccagggauaaauguuaagauuuugauguauuugccuugucuguucacugugugugugccuacuggaaucacaccucauacacugucgucuuuuucaccuaucaguaaguacauuauaucauuuaagauauuucagccaggcaugguagcucacuccuguaauccuagcacugugggaggccgaggcggguggacaaugaggucaggaguucaagacuagccuggccaagguggugaaaccccaucuccacuaaaaaaaauuagcugggcguggugucacgcaccuguaaucccagcuacuuggaggcuguggcagagaauugcuugaaccgggaggcagagguugcaguaagccaagaucaugccaccgcacuccuacguggaugacagagcgagacucugucucaaaaaauauauauuucagcugggcaugguggcucaugccuguaaaccccagcacuucaggaggcugaggcgggggugaaucacuuaaggucacgaguucaagaccagccuggccaacaugaugaaaccuugucucuaauaaaaaaacaaaaauuagccacaggcgugguggcaggcgccuguaaucgcagcuacucgggaggcugagguugcagugagccaaaaucgcgccacugcacuccagcuugggcaacauagcgagacuccgucucaagaaaaaaaaaaaagauauuucaaaagcuucagcuuuaaugguugcauaauggucugucauaauuuaacaguuccuuuuuucauagauuuuuuuuuuuuuuuuuugagacggagucucgcucugucacccaagcuggagugcauuggcgcgaucuuggcucacugcaagcuccgccucccagcuucaugccauucuccugccucagccucccuaguagcugggaccacaggcacccgccaccaugcccagcuaauuuuuuuguauuuuuaguagagacgggguuucaucguguuagccaggauggucucaaucuccugaccuugugauccacccgccuuggccucccagagugcugggauuacaggcgugagccacugcgccuggccccuuuuuucacagauuuucauuucugguuuuucuguguuauaaauaacacuuuuaggagcauccuuuuacauaaaucuuuguccauauauguuuauuuccauaagaaaauuuucugaaguuagaauuucugggucaaagauuaugaacaucccuuucuggcucgaggcuauauauugccagcuuguccucuagaaugagugugacaguuuauacucccacagcagagcuggagacagcucuuacuucugccuccuugcuaauauugaauguuguccuuuuuuaguuauuuuccaauuuuauucaagucuuuuccaguuauauaaguauacacuguuaucuaauuuuaaauuguaugucuuuuuuuuucuuuuuuugagacggagucucgcuguguugcccaggcugaagugcaguggugagaucucugcucacugcaagcuccaccuccugaguucacgccauucuccugccucagccucccgaguaucugggacuacaggcaccugccaccacaccuggauaauuuauuguauuuuuaguagagacaggguuucacuguguuagccaggauggucuugaucuccugaccuugugaucuacccaccucggccucccaaguccugggauuacaggcgugaaccaccgugcccggcccuaugucuuuuuuugagacggagucuugccguguugcccaggcuggaguguaguggcacagucuuggcucacugcaaccucugccucccgggugcaugcaguucuccucccuaggcucucgaguagcugggauuauaggcacaugccaccaauccuagcuaauuuuuguauuuuugguagagaugggguuucaccauauuggccaggcuggucucaaacuccagucugcccaccguggccucccaaagugcuggaauuacaggcgugagccaccgcacccagccaaacuguacgucuuugaucauuaauggagguaacugucucaauccaacuugcuacaguaauugccuuuaaaauggacauuauggccaggcacauuggcucaggccuguaaucccagcccuugggaggccaaggcaggaggaucacuugaugccaggaguucaagaccagccugggcaacacagcaagacccccguaucuacaaaaaaauaauaaauuagccaggcguggugguucaugccuguagucccagcuacuggggaggcugaggagggaacaucacuugagcccaggagguugagguugcaaugagcuaugaucacaccaccacacuccagccugggcagcagagugaggccccaucucaaaaaaaaaaagacuccuucagagucgucuuggaaauagugcauggcugcccagggagagcgcagaacgccauccccaaagcucccaccccagccuugugcagggaggaggggccuguguggaggaggccucaggugaagaacgggaucuggcgcacacccugcuccucggcaagggccgcuucacgcucgccauaggccguuuucuuauuucaugaaacaggccucacguaccacuugccaaucugcuuaaguauccuaagcugcuuccucugcccguuugguauugaucuucauguuuacauaauggccucuugcauguuuuuguuuuuaaauaaagguggcuuggcuagguaggggucuacaugucuuaaaaaccaugcagcuaaacccagcaacagagcaccuaauaaggucaggcugcacggcagggcacccaucaggugcagguggucggaaagauaccaccccccagguaaagccguggcucccaccaucaggagaagucagacuuucaggaagagagagcucccucaaccgccaugcugcuguccccguccuuccugccacuggucaccuggagaggggaugagggugaaguaaaggccagaaugaaugaaaggcugcacuuggugugucaccugggcgacagagcaagacuccaucucaaaaaaaaaaaaauuguuuaccuuuaaaguuauuucaucuuuuuagacugcagugauguaaauacagauuaaaggaagaguaauggucaucauuaaaggcccccagccugaacugcgcccuuugcuuucagcucgcagauucacuggugcccauggagaucaagccuggcaucuccuuggcaacugucucggccgugcugcacaccaaagauaacaagcacuugcuucagguagggggugcugggugggagugcaggggacccucuccccagcaagaaaccagaccaccuaacagauuauauuugaaauagcgcuucaugugaauucuuguugaagaauuauuucccuggccaugugccucagagaggcugcugugcccagagaugaggccgcacgucaucccaagggcugccacaggcacauucuguuggggagcgcugccacgcgaggcagggcuguggggagacgugcaggguggcaggugcagcccugcccuugggggcuggaaccggagggcaccugcgugaggcuguggcuaccugagagccugguccuaccaaugacccacacacagguggguggcacuucagcuccagggcaggcacugugucuuaagaauuccuuucagaucuggacugugucaccuuuaugccacauguagaguugcuccuagcuaccacuuaaagucuauuagacccugugcuggguccuugacccgccuugucuuacugagccgucagaauucacugcugucaucauuucguaggcagcuucucuaaccuuggccagaugguggcaaaggugggguuucccccuuuggucugaccccacagccagugugcccagccacggggucaugauguaccugcagcacgacacaguguauucuggagaauuuacucagcagauacugaagugaaccaccugaaaauuuaaaaauggaucuugauagaaggcagagaucuuagcgaauaagguguugguaggcuggacaguugagcauuagagcgcguggaucuggggcucccggcagccagggaaccugaaccgagugccggcugaggaaaccgggccggggcucuguggccugugaggacaggauagucucaggcucucaguguggccugcgguggccccugcugcucagaggaagcucaugaaagccacucuuuccuucugcucuagcccccuccucggcccgcccagcccacgagcgggaagaagagaaagcgggugagcgaugacguaccagacugcaaaguccugaagccuuuguugagcgguuccaucccuguggagcaguucgugcagacccuggagaaggugagcugguuucgcuggugccgugaaaacuccacacguggcagccuuucccuggcucacuauggcccccuggcugcagggaguggauguugcugcuugucacuuaguccccacuguccuguggcaucuguuuggucuaagguccugcugggagacccaggagaaagaaagcagagugaggagugccccauccuuccucccagcacgaggucaccagaaggccucuccagacugaagaaaaagcugcuuccacacacacaugugacgaguggggcaggguagugaggccaggacaaagagggacccggcccugccagagucuugcacuuccacagaugacuccuugcugucagaggggagccaagucuccagucgacugucaggauuugcaggaggcagucgggggaggggacacuggcccuuccccucugucucagcagcccugauggcugcuucucccagagaugagauuucuugacuaugauuaaaagaaaaaaaucuaaccuuaaagguuguaauuuuggcuucagucacaggacuucagagaugacuuuauuaggauuauagaaucuuugauaggaagaaggaauuggcuaaagguaauacuguucaugcugcugcuugcaagaacugcaacaaauuacaaucauuacaaggaaggagauuucuaugaacuuucuauccaauguaaauaucacaguugccgacuuucaaaucuuaaaggcuuucccuuuccuaggauugguuuucuccaccugucuuugauuuucccguagggaaaaaggcucuggcugggugguugcggcucucuuccacccucccugaagaccuugcagggcuccugggcccuguuaaugggccucaagcuggacuuuuaaaaacuuaagaugaggaccuucugccuggcccagccuauguccugacccaguguuccaccccggcuccucucugcagaaggagcaagcaccuguccaagucccuaggggagccugcagccaugaaguacagguggccuccccacaccgaggcccuucaccugcugugugucuguuucaggcacaugccuccuuuccaugucacgucugauuuguaaggaauuucuguccuuagcauuagcaauagcugagaaguuugcacugcugccuucucuccuucacucuugagagggcucugccaagucccacagggguaucuuggugucaccuggcauuuuccugggagcucagacagcugaaacuuaggagggagcugucaccagggaacggcauggugcaagcagcugagcgucccagacuccugaacacagugcuuggacgugcccucaaagaacucacaaaagcuuagccagguuguggaaauucuguuguuuugcaugagcuuuugcauguuuagggucucuuuucaaguauaagaaacuaucacuaucauaggccuaugacuagucugaagaauuguguugagacgugucaguuucuagaaaguucagucgagucugugaagugucauuuacagaucucacagaugugcagucugcccagcccaccucuuucuuuucuucuggagcagcauggcuucagugauauuaagguggaggacacagccaagggccauaucguccugcuccaggaggcugagacgcucauccagauugaagaagacucgacccauaucaucugcgacaaugacgagaugcucagagugcgacugcgggaccuuguccucaaauucuuacagaaguucugagugggccaucugagcuacuucccugaaauccugcagucccucacuggcugcccucacaagccaccugaggaguggcaugagaggccauuaacugugucuuugugguguccucuggcuuaaggagugaagagguggcucuugagggaaauggucuggacuuauucccagcacuguuucaggcaagaacuuucccuuucaacuucaggcucauuuucuucucaacucuggcucucucaaggagcuggaggguggcagaagugggacaggagaaguuuuccaagagguucaugggaggcggaggugacuggcuggcugucuugcaucagucccaggccucggccaggggagccagccuuugguuucguuuacuugccuacagugcuguacgcaauaagaugaugaucccaaaauaugguaaagugaacccaucugucugcauuuucuacucugagcccauuuguuaauaaacacuuauuuuuauauaauua

SEQ ID NO: 192508 - RNA, 28212 nt, Homo sapiens
agcgcgcgacuuuuugaaagccaggaggguucgaauugcaacggcagcugccgggcguauguguuggugcuagaggcagcugcagggucucgcugggggccgcucgggaccaauuuugaagagguacuuggccacgacuuauuuucaccuccgaccuuuccuuccaggcggugagacucugguaagaggagcuuuuuuuuugcgagcccuggcgggggccgagcccggagccgaggccucugcgggggcuuucgugacaggggaggaucugguuacagccaaagaaggauuuuggcagccagccccuugugagccccuggauugggguaaacagucugaccuccacccccgaacccugcugagcgugugagaugcagaggaccugagagucaugcggcccacacuuucucuuugcuuccccuuggaguuucuacaucuacuuuguuucucuuuucuccuuuacuuuuucucucauucuuuuaauuuuccguuuucugcugcccguccgcgucguagcuuugucaguaguguccagguauuuguugagucccagggucccaggcuuagggcccaaaggucacugacguuugacccgguaaaucuguagauuagcuugcuugagcgcugcucacuuuaaugcugccucuuaaacaguacuugauuguuaaaaauaucuuacguauuccacagaguaugaaauucugcucacggucauccuacugccauuucuaauuuaucuucaucuaaauauucacuguuuuuuuugcugucaucuucaugagaaccuugugauuuagaauuaguaugguuauuuaacaauuaauguuaagaaugcauauacaauacauaacauaaucugaagcagagucugggcuacuggccaaaagcuaucugucagcaguuaaugccuaaaccugagugugcagucuggaaaaaaguggcccucagacaacugugaaauggauaggacaugguacauugaggugcaaauagcuuagaguagaaggugggacucagucguaagagaacauaaugaaauguuacgacuucuguuuaaaccuaguuguuuuuagagauagguuuucuuuuuuaaaacgugcugcuucugaauaucaaauccuccguagagugagcgggaaaaggcagugagacucauaaggcucaucauaagauuuccaggacacucuacgcgccaggguuuucugcauccuacuuuguuggcaccuccuugguugcuuuguuuuucauuucucaugcuuggaugcccuagggcucaccccucuucucucuacaguuacucccuagaugaucuuaccuagucucuuggcuuuaauaacgucugcgugcugccaucccacaaacuuaaaucuucagcuugcauucuagauccguauccacccaccuauuugacuccuccacaaaacucuccaacagcuuucuguuucucaguacaagcugaaaucuugacugugacuacaguugaguagaagucacaguccuguggcuacaaugcucuacuugacuugccagucccuacccucagccucccugacuuugucucauucucccccuugcuagcucgccucuucgugaagauuucugccucaggucuuuguauuucuuguccucucucuggaagacuuucacuagauacuugcuugggccugcucccucacuuccuucaaaugaguuucucaaggagaccuuucuugaccacuuuaaacucaaauauuaagccccuucccaaggccuucugcucccuucacugauauauauuuccccugaaauaguauauguuuaucuucauacuuguuugggucuuguuugcugcucuauuuccagaguguagaacagugcacuguuagagcacaugguaugugcucgaacagugcacuguuagagcacauuguaugugcucagugugugcauauugacugagugaaugaagaguagcuucacauagguagauagaaaucuuagaagaagcuggaugugguggcucacgccuguaaucccagcacucugggaggccaaggcggguggaucaccuaaggucacguuugaggccagccugaccaauauggugaaaccccaucucuacuaaauacaaaaaauuagccgggcaugguggcacaugccuauaaucccagcuacuugggaggcugaggcaggagaauugcuugaaccugggaggcagagguugcagugagccgagauugcaccauugcaccccagccugggcaacaagagcaaaacucugucucaaaaaaaaaaaaaaaucuuagaagaucucugaggugccacaucacagcaucccauggggaaagauaacacagauggaagaaggggagucagaaugacauggggaaauuauuuccgaaguagaaauaccuccugcaacccacucugcuaaauaguuuauccuuucccaaaguucugaaacugguuucagaaauucugcuguuccuaccgucaaguuaaaugggucacuucauaaaauuauuauacucuugacaaacacauguaaaggggcucuucgguguucucaggacagguaaaucugaagacaauagugauuguagcuacauuuuaaacaagaugaacaagcuugucauuaauaguuaaagcugggccuuugagaugauuuucuuccccuuaguacaguuuuuaaagaugcuauuauuaagggcucuauaaaaaauuuaagcaaaucugucugccucccaacuuuuuauagacaaaugagcuuauagacauguaggaacaguuuugcuuuauaauaaauaaaucuaauaggaaaccuaauuuuuuaaaaagaaauauaauuuuuaaaauaaaaaaauucuuaaauauguuacgaagaaguaaacacauugaguugcuuuguuuauauaugugguauguacauuuucuuuucuuccguucuuuuuuuuuuuugagauggaaucuugcucuuuugcccaggcuggagugcaguggcacgaucucugcucacugcaaccuccgccucccagguucaagcgauucuucugccucagccuccugaguagcuggaaugacagguacacgccaccacaccuggcuaauuuuuuuguauuuuuaguagagacgagguuucgccauguuggccaggcuggucuugaacuccugaugucaacugauccgccugccuuggccucccaaagugcugagauuacaggcgugagccaccauacccggccucauuuuauuuucauagacaauuuuuauaaccauuuauugagauaauuaauguaucauaaaaauccaccuuuugaaaguguaaaauucaauaguuucuaguauacucagagaugaauauauuaaaccauuaucugguuuuagaaccuuuucuucaccccagaaagaaaucccauacccacuggcagucauucugcauucuuugucucccaguccuuaguaacuauucagcuauuuuugucuccaugauuugccuauucuggacauuuccuaaaaaugggaucauuggacgggcacgguggcuuaugccuguaaucccagcacuuugggaggcccaggcgggcauuaucacaaggucgggaguucgugaccagccuggccaauauggugaaacaccgucucuaccaaaaauauaaaaauuagccaggugugguggugggcgcugguagucccagcuacucaggaggcuaaggcaggagaauugcuugaaccugggaggcagagguugcagugagucgagaucaugccacugcacuccagccugggcgacagagugagacuccaucuaaaaaaaaaaaaaaaaaaggaucaucauauauguagccuuuaugugucuggcuucuuucauuuaguauaauguuuucaagguucauucuuguauauaucagcacuuuauuccuuuuuaugacugaauaauauuccauuguauagauaugccacauuuuguuuauccauucaucaucugaugcagaguucuguuguuucugccuuuuggcuguuaugaauaaugcugcuugaacaguuuccuuaaaggauauaagagagcuguuaacaacugcuccugggaaguauaacagggagacauacuguuuacuuuuuuguacuaggugauuuuuuuuuuagcuaagugcauauauuacuuuauaaugaaaacaaaaauacccaaucacuaauauuaugauggggguaaguaauuguacuuuuugguuuuaguuuccucauuuuaaguaaaauugggcuaaauguuuguugagguccuuuuuagcucucaaauuuuguuugugauaacgugaacgauaauguuauaggcuuuuuuuuuuuuuugagacggaguuuugcucuuguugcccaggcuggagugcaauggcacgaucucggcucaccgcaaccucugccucccagguucaagcgauucuccugccucagccucccaagcagcugggauuacacgcaugcgccaccacgccuggcugauuuuguauuuuuaguagagacgggguuucuccauauuggucgggcuggucucgaacucccgaccucaggugauccaccgaccucaggugauccacccaccucagccucccaaagugcugggauuacaggcaugauccacugcgccuggcuauuggcauuuuucuucaugaaugagaguuguauucuuuauaucugcuguguaacuugcaauuuguuuucaucguaggacugagaguggcuuucacaauggaagggaucaguaauuucaagacaccaagcaaauuaucagaaaaaaagaaaucugguaagauagcagauguaagauuuuuuuuuuuacuauuguuguuucucuuagaaauguccuaguauuauuuaguuugauccuuuauuaucggucacuuagaaacuuuaauguaacuccccuuuaugauguuaaucuuaacaaauaagacuuauuuuauaggccacgguuugaucaucucuggacuaauuuuauugacaaucuaacagguuuggaggcucucccugcccaagaaucaacuuagcuugacccauuaaggaacugcuuuaccuuucucccucucauccauacauugcucuugugagggaaagauauuuuccaaggcaacucaauggacaaaggaaaaucuuuucaacaaacaccuagauauccacgugcaaaaaauaagccuugacccuuaacuccuauuauauaaaaaauagcuacaauuaaauuucuagaaaauaacaugagaaaauauucuguuguccauuucuagugacagauuuuucauauugaccuuguauccugcaaccguccuaaacucacuuauucuauuagcuuuuuaauagauugcuugggauguuguauaugguuggucauuuguggaugaagaaagacaguuuuacuuuguuccccagucuguauggcuuuguuucuuuuacuuuuuuuaauugcacuggcuccaguauguuuuugaauagaaauguuaguggauauacuugccuuguucccaauguauuauguuagauguagguuuuucacaaauacccuuuauuaguuugaggaauuuuucuucuauuucuaguuauuaucgugaguggguauugaacuuuguagagagcuuuuucugaaucuauuaaauuuucuuuuaaaaucucucaaugugguaaauuauguuaauuuucaaguguuaaacugaacuuccuuguguaaagccaguuuggucaugauauauuuuauauauugcuugauuugcugauauugucuauauucaugagggauauuggacugcaguugucuuuuugggauaucugucuaguuuuaauauuagguuauucuguauucauaaagaugagaaauguuucucuuuuuuuaauagaaauaucuuuuucuuuaacuuuguguagaauugguauuauuccuccuuaaauugguggaauucacuaguaaagcuaucugggccuggaguuuucuuaguaggaagaguuuaacugugauuucacaguuaauagauauagggcuauucaagugaucucuuauuuucuuugugaauuuuguuaguguuuuuuaaggaauuuguccaucacuucuaaauuuucaaauguacuggugugaaguuauucuugauacacccuuauuaaccuucuaguguccuuuuucauaucugguacuaguauuguauauuuucuuaauuuuuuuccuuaaucagucugacuugagguuuauguauguuggugaauguugcaugcacuugaaaagggcauuuuuuucuacucuuacuggguacgguguucuacaaaugucaauguucuacaaaugucaaugauauucuguauacuuuuuauauuaauuaugagagaagagaguugaaguuuccaacuacaauguggauuugucugcuuccccccacccccaauuucuaucaguuguugcuucauguauuuugaagcuuuguuauuagguacauacacauuuaggaugguuauuucuuuucuuuuucuuguuuuuuugaguuuccuuuugucacccguaauggaguacaacagugugaucucggcucacugcaaccucuaccuccugggcucaagugauucuggugccuuggccucuggaguagcugggauuacaggcgugcaccaccauggccggcuaauuuuuguauuuucaguagagacagguuuucgccauguugggcaggcuggucucaaacuccuggccucaagugauccacucuccuuggccucccuuucaagugcaugcaacauucaccaagacacauaaaccacaagucagaucccaaaguguugggauuaccaugccuggccuaggaugguuauuucuuuugaugaauuuauaccuuaacuguuacgaaauacccuucuuaauccucagugguacucuuuguucuggaguccacuuuaugugauaguaauggagccacuccagauuuauuuugauuuguguuuuaaugauguuuuucaacccuuuacucuugcccuauuugcgucuuuauauuuaaauugaguuuauuauaaauggcaugucucgucuuguuuuuauccguucugacaacuuuaauuuccuuuaacuggacuguuuugccauuagcuacauguggcuauuuaaauuugguuauuuaaauuuggauuauuaaaugugguuauuuaaauuuggauacaaauuaauuagaauuaaauaaaauuacaaauugaguuccucaguuguauuagucacauuuuaagugcucagcgcucagacagcacagauauagacauuuccacauggcagcaugauguauuggacagcucuguuuagaccauuuauacucaauguaauugucuauuguuggauguaaaucggcuguuuugcuauugucccauagcucauugaugauuuuuuucuaaccuuuuucucucuuugcuucauuuuugauaguuuuuguugcucugucuuaagauuuaguuauucuucugcucuaagaugauguuauucuuauccauuguauuuuucauuccuaagcuucuauuuugucuuuuuuuuuccguuaugcucagauuuuccuuuguaucauugagcacauuuuuaagauuugucuuaagguucuuaucugcuaauuuugccauuccugucauuuuuuuuuuuuuuuuuuuucuugagacagaaucuugcucugucacccaggccggagugcaauggugcgaucucagcucacugcaaccuccaccuccuggguucaagcaauuauccugccucagccucccgaguagucgggauuacaggcacgugcuaccacgcccagcuaauuuuuguauuuuuaguagagacaggguuucgccauguuggccaggcuggucuugaacuccuggccucaagugauccaccugccucagccucccaaagugcugggauuacaggcgugagccaccacucuuggccuccugucaucuuaugguauguuucuauugauugauugauuuuuuaauuuuuugagauggagucuugugcccugucgcccaggcuggagugcaauggcgcuaucucagcucacuguaaccuccgccuccuggguucacgccauucuccugccucagccucccgaguagcugggauuacaggcacgugccaccacaccuggcuaauuuuuugccucuuuaguagagacgggguuucaccauguuggccaggcuggucucgaacuccugaccuagugaucugccugccucggccucccaaagugcugggauuacaggcgugagccaccgcgcuaggccucuauugauuuauuuuucuccuauauuggucauauuuucuugcugcuuucaugccugguacuuuuugauugggcaguagauauuuugcauugucuaguacuggauuuuguuauuccuuuaaagaguguuugauuuaguuauggucugagguuaaguuaccugcacauuagccuguuccuuuugagacuggcuuuuaagcuuuguuuugaauguuuaucuggggcuaaacuuuagcuguacuaucuaguugugacccuuuagaggacuuuacuauguguuacaggguuaccauccucuagcucauggugauaugaaguguuccuagacuuguaugaucucugguaauuguugagccaauugcuuuccucuggugcuuucccagcuuuggggcaucuacacauuguuaugugcggauaaguacuuggccaaacacucaaagagaaacuguucagaucuuuggagugcucucuuuggagcucucuaguucucugcuccacaaauucuagccgccuaguccuucuugaccucugaucucugucucuucaaugugacaggacuucuggauuaugugaccucuguccugcagucuggaaacugccuucaagcaguaaguuagggcagugauagggcccaccucauuuguuucucuucucucaggcaucacaacacugcucugccuguugucaagugucugaaaacaauuauauuuugucuaguuuucuaguuaauggcgagaugguaacucuaggagcaguuaauuguccaggaguaguuaauuauuuuucaugagcagaagcagaacuccaucuuuucaucuuuuuuuuuuuuuuuuuuuuuuuuugagacugugucuugcucugucacccaggcugaacacagcucacugcaccugcacccuuaaccuccugggcucaaguguuucucccaaguagcugagaccacaggugugugccaucauuccuggcuaauuaaaaaaauuuuuucguguguagagauggagucucuuuauguugcccaagcuggucucuacugggcucaagugacccuccugccccggacuccaaaagcguugagauuauaggcaugagccaccacauccaaccccuuuaucuuuuaacaauguuuuaaaaaugugaaaacaguucuuagcuuguaggccauacaaaaacaggccauuucccaaucucugcuucagaguuacuguaggauaaaacuccaaaaguaggcuuggucaaaagauacccauuuaaaauuaggauauauguugucaaauugcucuccaaaaagacugugccaauuaauacucuuggcaguaguauauugagaauguuaagaugcuuuauuuuuauuuuuuauuaauuuuauuuuuuauuucucugacauuuaguauuauguucaacuccaacuauaaauaucccggccucuccguuuaugcagaagcuuggcuuugguacugggguaaauguguaccuaaugaaaagguaaguauaagauuucagauuaaccuuuuuucaugcaacuauaauucuacuguacuuggagacaaagaaguagucugaaaauuccaguauuuagauucgguugucugcuccugauccuggcugauggcuguauuccggucccuagacccuuuuguaacuuugccuguagcucugccucugcuuuucuccuagcuuccuccugauggguuauuaaaggggaagucauuuacuuuuuaauuuuuccuuggcuuccauaagaaggggaaguggcaggggaaaggguuccuuugugguaauuaaaccagauucuucaugagaaaaccucaaagaggaagccaguauugggugaugucagugacugcugucuuuucugcagcguugcccuccuaagauaugcucuucuaaaagaaguaaaagauuuucauuucuuauggcauuguuauuaagaaggguaaauacaugauuuuaaaguaggaauauuguguuaagaaaaaugaaauaaucgaacaaguauggugccaauauagcugucaacaaaguguuuuuuuaaauuacuuuuuuauuauucauauauuuuuuugaaacagagucucacucuguugaccaggcuggagugcaguggcacgaccucccagguucaagcgcuucuccugccucagccuccugaauagcugggauuacaggcguguaccaucacacccagcuaauuuuuguauuuuuaguagagacaggguuuugccauguuggccaggcuggucucgaacucuggccucaagcgaucugcccgccuucgccucccaaaaugcugggauuacagguguaagccaccaugcccagcccaaaauuacuucuuuuaaucauuacucuguaccuaguuucauguuuauuaaguggcaaacaacuacaucaauauauauuccuuaaugcauucuuggaaucagucuaacuaguccaacccuccguaucuuagcuucaucuagguuuacauuguuuccagauagaaaugcuuucuuuaauaagaggcuaauuaagaauaauuuaguaauuauauacaauggguauuccugaagcauuuuugcaguuuaaacauuuuuuuuguauguuuguaugguauuguuuucuaauuuguuuuuuaguguuaacuccuauuuugaaagaaaaaaauucucacagguuuauggcuaguuucauuuuuuucccccuuuuuaaaaaaaguuuuuaaauguaaaguguuuuuaacaaaguuacacuguaugugguuuagucaaaaagcuucaaauagcugaucuuuuuuuuuuuuuuuuuuuuugagacggagucucgcucugucgcccaggcuggagugcaguggcgcgaucucggcucacugcaagcuccgccucccugguucacgccauucuccugccucagccucccgaguagcugggacuacaggcgcccgccaccacgcccggcuaauuuuuuguauuuuuaguagagacgggguuucaccguguuagccaggauggucucgaucuccugaccucgugauccgcccgccucggccucccaaagugcugggcaaauagcugaucuugaagaacagcagugccugccugacccuacacuccuccugauucagcccugucaaccugggauuucuuuuauccauaaccugcaaauuuccuaugcuucucugcugaauuauauccuguguuuuuagguaucuugugucuuauuauuucuugauuuacaucccguuuucauuuaggacaucugguagcuccccaugaaucggugcacagaagauauauuuuuuugagaauuugcauuuccaaaaauguuuucauuuuacucauacuugaauggcccuuuuugguuuucuggguuacaauucucauuuggaaacaauuucccuccagaauuuugagaauaucagucacugacauuguuuuuuuucuagcuuacacuguugcuguugagaauuaugaagccuuuuugacugcuaauucuucauauguaauccguuuuauguuaucugucccccccacuguccuggauccugguaugaucuucuguaugucgguagcauucugaaauuucacaaugacaugaguggauguggggaucuuggaaucugaauaguuccuguucuuaaauuucugagacauuauuuuaaaaauuacuuuguugaugauuuucaccucuuuuucucuguucuccaucuggaauccaauuauuugaauguugaacuuacugauuucucaucuaccucuuuuuugcuugguuuucuuauucgcuaucuuuuuucugagauuuccccagcuuuaucuuucaacaauucuauugaguuuuuaucuuguuuuuaauuaauuaucuuuuuaaaaauagcaucuuuagucucuuggagugcuagaaauguucgguaucuagguguugauaacacagguauaugcacauguaaaaacucauugagcauuuaguaugcauauggugauuaauuauuaaccugcuucuguauuacagguucucaacugacaguaaaccucaggcuaaagacuuguuuuauaccuuccaaagcuagucuaccaucuuuagaagcuggggaaggggggugggcagcugccaguugguacagaauuaaggaggguaucuacgaguccaccuguuuuuuaccauuauuauuuagagacagggucucauuuuguugcccaggcuggagugcaauggugccaucauaacucacugcagccucaaacuccuugguuugagcaauccuccugccucagccucccaaguagcugggacuacaggcgugggccaccacaugugacuuuuaaaaguuuuuuguagagaaggggucucacuauauugcccaggcuggucucaaacuccuggucucaagucauccuccugacuuggccucccaaaguguugugauuauaguugugugcuaacccuuccaggccuacgugcuuuuuaaauaacuugcaagcaguucauuggggcuaagucaguuacuuucuucugcuuuccagcuucugaaauuuuguugcuguugucucuucugcuguuauuuccauucuugcuggcuuguaugucuaaaaaauauccauuugcuauuauguuagugggcuuggaaaggauaaaaacaauguguauguuuaagcuacaauuuuaacccagaagucuauauuuuuuuuguuaaaucaaguuugcauuucuugguuaaauccaacauaguuuugauguaguauuuuuaaauaaacugauggauucaguuugcuaauauuaaaguuuauuucaauuuuugcaucugauauaagugaaguuggcuugugguuuuccuuuuucuacugucccuuuugauuuuuuaaaauuaaaguuauaugagacucauaguaccuuuucuguucccuggggaaacaguuuguauaagauugaaugguaaauucuuugaaagcuuaguaaacucaccuguaaaaucaucugcacuuuguauuucuaguaggaacauuuuaaacuggugauuaaauuucuucauucaucaguuuucuuagauuuuucuaagucuuugaccauuuugucuuaaaugauugcauaaagauuuuauuuacuuacauauuuuuucucuuguaucuguaguuuuguuuccauuuuuauuugugauauugucuuuauuuuuucuuguguaaucucaucagaaauuugccuuuuuucuauuagucuuuuuaaugaaccagcuuuuugcaugguugaguauucagauuucauaaaucuauucuuauucgauagauuagaauauguuauggaaaaggugaagauugacuuguuuacuaaauucuaaacuuucaagagcuaaacuuucaacccuugaaauuugaaaaauauauuuuucauaauaaaaugauaugcaggugcucaucauuauccucaaaugcugcuguuauuuaaaacuggagguuuaagaauaguuuagaucaacuuacggaugauagauguacaugaauuaagaaaucuugugauccuuuuaguauaggcuuuuugauuaaacaaaaaagguucugcagucuuagagcuauaccugugagggaguccaaagcuaaacagaucuuugauucaaucucuuguuuuguguucuuaccauuaaacuuucugucuuaaacuucugaggcucuuucacuagguuuugugcuguuaugcugcauauacuuaaguauuuugugauuugcucuacucauaaauaucuaccaccucagguaaaccuuucccugacuuuauuuuaccuauuuaggccuuaaaacauuuauaccuuaaauauuuguaaaauggcugaaucuuccuagaaaauagaaaguuuaaaauuuucucauuuguauguucaucauuaucuccuuaagcacauaucuuugagcaugugguaaaagguauaaggugaauuggucaguguaggggagcaauaagaacagcaugcuguucuuuggaugaugauauauggguaaaauguucuugauuaucucuucuuuaaauuuccuaauguuuuuuucuucaggauccuauaacucaucucugauacauauaauuaaauauuuaauaaguuguaguccaacaugcucaaauggaaaaauuggaaaguuacaauuuucagguuuaaaguuuguaacauuccaucuuuacccuucaaauucuuuucauccucucccuuccacaguauagauaguaagacuuguuuuaguauauuagaucuuaccucccaauugaaauggaaauguagcagagguguucauaguccaaacuauuuuaaauucuguuuuuaaaagcaaauuucuuucaagcuuuuucccaaaaauuuggaagucauuuuaaaaaguauugugguuuuauuguuuucuauccuuuuuaaaugaauuuuuuucuuagaucuccaagagguuugucucauucuccuugggcuguaaaaaagauuaauccuauauguaaugaucauuaucgaaguguguaucaaaagagacuaauggaugaagcuaagauuuugaaaagccuucaucauccaaacauuguugguacguuuaaauuugguagcaguaucugguauauuauuuuguuuauucagaaacagcuuauaugcucucuuaacugguuucacuaauagaaaugaagaggauggggcuggauauuuaauggguaucaaauuaaugugauuggucuaaaauaaaaauuugcauauaguauuuuuugaugccuaaguauauaaacuucaugagaacagauauaauaauuauguugcuaguucuaugaagauuuuaagaauauaaaaugaucuucauuuagauaauuuaaauccauuuagguaauuuccuggauuucauuuuucauuuuuaauacaaguagggcuggugaaacuauuauauuuagggaagcaaaggaaaauaaaaguauuuuaauuugugguacuacuggcaaacacugaaggcauuuuaaaugagaucuacugaauuagucuuguaaauaguagcuguuucauuguauauuugucagcguuaguccagauccauauuuucaaucacguuacuauaaaggacuuaaauauuauuguucuucucuauauuagugaagaaaugucauguuuucuuuaagguuaucgugcuuuuacugaagccaaugauggcagucugugucuugcuauggaauauggaggugaaaagucucuaaaugacuuaauagaagaacgauauaaagccagccaagauccuuuuccagcagccauaauuuuaaaaguugcuuugaauauggcaagaggguuaaagguaacuaugucauuauauuuuaaaugacuucuguuuuuguucauauuuuaaaugaacaaauaaucacuuugcaggacaucuuugaauguggauggauauuguuacuugucaguuccaaaaagggguuagcggaaaacaaaauagaggcuuacauuucugcuuccaaauuacauucauguguagcuuaauauguucugagaaaugugucauuuggcaguuucaucacugugcgugcggacaucauagaguguacuuacacacaccuagaugguagagccaacuacacaccugggcuaugugguauauauagcccaguucuccuaggccacaaaccuguauagaauguuacuguacugaauacuauaggcaguuguaacacagugguaaguacugugugacuaaacauaucaaaacauagaaaagguaaaaucaaaauaugauauuauaaucuuaugggaccaccgucguauauguuguccaucauugaccaaaacauccuuauacguacauguggcccuagucauucauugucccacauggucucaacaauuuauguaugcuucacugaagauuccaaaauuauuucuaaaaauuacuagacuagccucaaaauugugguaucuuuugaaaucugcaguuguaucuucugauauaaaguauguaggauuaguuaacuuaccaaguuaaccaauuuauaaguauaguuaacuuauaagcugucgguauauauacauacuuauauauaaaaauaguuaacuuggcugggugugguggcucacgccuguaaucccagcacuuugggaggccaaggcaggcagaucacgagggcaggaauuugagaucagccuggccaacauagugaaaccccaucucuacuaaaaauacaaaaaugagccgggcaugguggcggcaccuguaaucccagcuacucgggaggcugaggcaggagaaucgcuugaacuuggaaggcagauguugcagugagccaagaucgcgccacugcacuccagccugggcaacaagagcaagacucugucuuggaaaaaaauaguuaacuuauaauuauuuauuuuauaaguauaaaagguuagcagaaguaucuauuucuaaauaaacuuuuagacuucuggucaguauggcagacugagauaacaugggauguucccuucucuuguuucaaauacuuugaaaugcugggcacaguggcucauaccuguaaucccagcacuuugggagacugaggcaggcggaucacuugaagccaggaguucgagacagaccagccuggucaacauggugaaaccucgucuuuacuaaaaauacaaaaauuagccaggugugguggugcccgccuguagucccagcuacuugggaggcugaggcaggaaaaucacuugaacccaggaggcggagguugcagugagccgagaucgugccacugcaugccagccugggcaacagagugagacuccguuuuaaaaaaaaaaaaaaaaauuuugaaacgcuggacaaauguaaaccuagaguuuaggaagggaguucaaguuguuauauuuggagguuaucacauuuuuuuauuaguuuguguuucugcacauauguguuaaauuuuuuacuauuuuaguaucugcaccaagaaaagaaacugcuucauggagacauaaagucuucaaauguuguaauuaaaggcgauuuugaaacaauuaaaaucugugauguaggagucucucuaccacuggaugaaaauaugacugguaaguuguacucuuaaguuuuaaaauuuuguuuuuaauacaguguuuacauuuuuaaauacguaaguccacauggaucaaaaaucaaaaacuauuuuuaaaaaguauaugguaaaaaguccccuuuuuuucucucucucccagucagccugcagucuucucccuugccacauguacaguauaaauuacuguauuauuauuaguaguaguauuaguauauauuuuaacuggaguuaucuuugggaaauauuucuaacuggauugggaucuuuaagcaguaaagcaucugggaauagaaaguaaaauuuaguaagguuguguaaagcgguuuauuuagcaugaguaaagugacaagauuuaggaaacugguagaagaaacuggaaugaagcagaaaagaggggugcuaaugaaggcuggucuuuggcucuuugcccuuucuucucuauugcauagcuucucagggaauuuaagauauguucuuggugagaaacaagagccagccucaagagaaagccucugcuugcaacauauuauuuaguaaauaauacuuaaauuugucucuuuauaucaacagaaguuaaacaaaugguuaauaaaugcuguuuagaacauauaaaugccugaauuucuagcugaaguaaaaguuuacaaguugaguugaaggcaagagucagaaugaauggacagacuuuauaaauaaaugaugucuguaaucauuaauaaaaauagaacuguugugaaaccuuaugcuaaauaacuuacaaaaugggaacuuuagaaaguaaaaggauaaauugucaaacauaauaaaaaugaggguuuuuaaaguauuuuucucaaugcuuaauagagcaaacagacaaauguaaggauguuaaagaucugaguaaauaguaaggcaaguaccucugcaccauaauauuuauuaaaauugaccauauucuuagaucacacaaaaaaacuucgaauuauaaaaaguaugaauagucuaauaggugauauuccuuaacaucaaugcuguaaaucuagaaauuuguaauaaaauaggaaacaaaaacuccaaacuuuuuaggaauuuaaaacacuuccgaauaauuuuuggcuaaaaagagaaaucaaauuccauuuauaaaauauuuagaaaauauaagaauauaacaagucaaacccuauuugauauguucaaaacuacucaaaggaaacauuuucauuauuuaacuuuuaugaaguuaaguugaauauucaacugaaauugaaaaaaaugacgcccuaagaacagaaagcagaaaugaaugaauuugauagccuauaaauucuacauaaucuuaaugugaucuauucuagaacaugucagaauuaaucugaaguuccucuuugaggauacauguucaaucaaacauggcugggaaaacucgaugaaaggaggaggaaucuuccugagcagauaaaaaguuuuauaaagcuacaguaauuaaagcgaugauacucaugccaaaauaggcagaaaaauagaacaugagagucaggaaauaguucccaaauagaggaauuuguugugugauaaaggugacauuuuuguauuagugagaaaagagguaguuuagucaguaaaugauguuaucuggacauuuuagaaaaaaacacagcuguuuucuauccuuacacuugaauccccauauauugaagauugggggaaaaaguaacaguagaaaaaauuguagauaaauaguucuuuaauguuggcuguggagaggacuuuaaagaagacaccaaagcuagaaaccaucauuaaaaagccauggguaccuccauuuaaaaaaaaagaauucuauaucacaguggguuggagaggggcagggagcuuaagacauuagaaacugagauaaauguauaagauauuuaauauuucuaaugcauuaagaguuauuaguaaucaaugagaaacagauaaaagcucuauuaugaagagacuguugagaaaugaaaaaaauggcaauuaggaaaauauauauguaauguucuuacuaauguuuuaaaagcuaaauaacaaugagauaaucugcuaucaacacucaucacacuguguaaauuaucuguuaaacguuucuccauuccuccauuaggcuuguaagcucuaagaagggaaccuuguauaucuuguccacugaaauauccucaacucuagaauagugccugacuuguaaauauauuauugaaggaguaacaagauugcuaguaaauaaaaagauugcuaguaugagcaacaauguagguuaacauguccucucauacacuaaguagaacuuguaacugcuguuuuacugagguuagaauagguuuugcugugguaacacagaccucaaaaacuucagugacuuacaacaaccaaggcuuauuacucaagcugcauggccauuagcaccuuguucugugucauucucccuuuaggacuuauacugauggaacagccacuauauggaacauggccaccauuauggggagggugaaaaagcauuggagugguacuguccaauacaguaguuaugagcugcauguugcuauuuacauuaauauuaaaacauugaaauuauuuucucagccacccuagccacaauucaagugcucagaagcuacaugugguuaaugguuaccacauuggacaaugcagauuuaggagauuuaaucaucauagaaaguuucauugaacaauacugcucuagaaagucuugcagugauaguuaaaugcucaagcucagaaaugacacaagucauuucuugugguagaaccuuucaggugacaguuuggaaagcuguauuuaaaauaagaaaaaccuuuaaaaauguuuaugcccuuugacccuauaguuucauucuuaagaacacaguccaaagaaguaauugaguaauuaggcaguacaggcauuuuuuuuauaauaaccugauauauuauuuccugcaaaacuucauugcgcaaaaguuucaagauauaacuagguuuauagaaaaaaaaaacaggguuaaaaccuaugcaacuuugaaaacuaaagcaguaacaaaaacaguuaauaauccuaauaaaagauacuaacacauuaaaucugcaagggcauaaacauuuuaaaauauuuuucuuauuuuaaaugcagauuuccaaacugucgucugaaagguucuaccagaagaaaugacuugugucauuucugagccggagcaagacuuucuagagcagugcuguucagugaaacuuucuaugaugauaaaauguuccuuuguagccauaaacccuggguuuaugcugaagguuacauaugagaguauuuucaauagauacuuuucaucaagaugaaaaauuugaucuggcuuucucacuaaaaauauauauauauuuuuaagcgugugggaaauguguuggcagcuccuuuaccuggacucacucacagcuuuuguaguuagcaauagcaauucuuaaagcuacuacaccaggcauaugcucagggaaggcauuucuguaggcaaaggcuuucuauuugugagauuugccucugaucacuucaaaaauaacauuuauguacugggaaaaauaucaaucuuuuuacuguuucaaaaauacacauuguagcagaacagacuaugcaacaaugugugagaauguccaccaauaaggggugguuuaauuuauacuaccacacaauagaauaccauauauccauaaauuauacggguuuauauuuauaggcauaaauauauccagugagauaaacagaguauaaaauagcacuuauauguauuuacauauaugaagaaaaguuugaaaaaaaauacccaaaucuuaaaauuuuuuuuaaacagguaauauauuaacauuucacaacuaaaauauaguauucuggcugggcgcaguggcugacaccuguaaucccagcacuuugggaggccgaggcgggcaaaucaugaggucaggagauugagaccauccuggcuaacacagugaaaccccgucucuacuaaaaauacaaaaaauuaaccaggcgugguggcgggcagcuguagucccagcuacucaggaggcugaggcaggggaauggcgugaacccaggaggcagagcuugcagugagcugagaucaagccacuguacuccagucugggcgacagcgagauuccaucucaaaaaaaaauaaauuaaaauaaauaaauaaauaaauaaauauauauauauauaguauucgaugaaaagccaaaaucuuaaguguuuaucucaagauaaauuugcaaauauuaauacuauauacaugucaggcaccaugaauauagaguacaugagacagacacagucuuacccuguugcagcuccuaaucuaggauggaaagcagcuuuugaauacuaaugagacaagaugacaguuaugauacaaggaauuauaaacacagcaguggcccuuaaccuagucuagauguugaggaaggccucgcuaaaugauguuuaauaagcugagaauugaaggauaaguaggagcuccaguuucaucauuuuucaguuugggauaguaacuaaagcaugucugcuuaaacucuuugaauguaguaaagggaaauaaaguauaaacuguuucuguaucaaccaaaagaaaugacugaaccauuaguuuaugaucucaucaaacuuuuguugucagaacaauccaucuucacagggagcaaacccaaucacuaacauagguggcagggggcccaauccauuauguuuaaauacuauguuaaauucacuaugucacaugcuauuauguuuacagacuuggagaacuguaaacauacauacaggaaaugcacuugugguucgagucucaaauuggagccguuauuuuagacccagaguucuagaaaacuacuuuuuagccugauggauccuuguaggaaucugaccuacuuagaauguauguguacacacacauauacguguauauacugaacgguguaaguauccuuccuuauugccacagagucacugcccaugugggccaugucuauaggcuuuucucuugucaugaauuccaugaaguaccucuaauauauaagguacaguauaggggaaaaccuuuaaggagcuuauaauguccauggcuaccuucuaaacuguaaugcccaaagcagaacuaaguacaaaggcuaccauagagacaccacucaucuuuccuucuugccugcugguacuggguacccuccuagucugguauuuuuguucucacuuaacagagccugcucauuuaucaggcauaccucucaaaauguuaacggaauaaaugagugcuuguuaacuggaaucuucaauuuccuggcuuauggauucucacuuuuccuucuuuuaccccucccuuuuguucuuuaaauguuaguuucauccucuuuuccuuguaaaguucuugagacucucagggcagaacuuuccuucaguucuggagaaauuucuuucaguaaacagccccacugugucuucuuucuauuguuucaaaaugaauuauauuguuuucacucuaaccuuauuugugaggaaaugcagauuauaguaaucaaauacugaaaauuuucauuuuuuaguauaauacacucuaacacugccuagugaauauucugucuguaagaguuugaguuuauccuaguuauagcagaaguaaagguuuguaugacacuaugggaggaaucauagaguauauuuguuggccacaauggaauuaaguuagaaaucacuaacaagauaucuaaggaaaccccaaguauuuggaaauucaguaacacaaauuuaaauaaccuaugggucaaauaaaaugacaagggaaauuggaaaauguuuugaauaauuaaggaaaauacagcauaucaaaaugugcaagcaauagcuaaagcagggcucagagggaaaucuauaguuguaaauuauauuggaaaaaaggaaaguucuaaaucaaugaccuauguucauugauuuaaucuagaaaaagaaaagcagagcaaauccaaaggaagggaauaaagcuaugagcagaaaucaaugaaauaaaaaacaaauacuauaaaauauuaacaaagccaaaagcugguuauuugaaaagauaaugaaauauauaaagcuuuaucuagacugaucaagaaaaaagagaacacaagucaccaacaacaggaaugagaaaaggguuauuguaaauucuacacacauuuaaagaauaauuaggcuauuauaaacggcuuuauggcaaugaauuugacaacuuagaugaaaaggacaauuucuuugaaaaauacaauuuaccaaaauuaauauaggaagaaaaggaaauccacauagcccuaugucuacuaagaaacauucccacaaagaaaacucaagacccagauguuuuacuguugauuucuaccaaauauccaaggaagaaaugauauggauuuuacacaaacuuuuucagaaaauagaggaauaaggaccucugcccagucuguuuuuguggucagcauaacucuaauaugaaaaccugacacauuguaggacauccuaucgguccugaugugauuauuauacacugcaugccugcaucaaaauaucacauuaacacauaaacauguacaccugcuauguacacagaaaaauaaacugauaagaaaaaaaaaucauaguccaauauccuucacaaacacagguaucaaaauccuuaacaaaauauuagccaauucagucuaauacuacaugagaacacuacaucuugaccaacuaggacuuauuccaggaaggaaaaguuguaacauucaagaaucaauguccucacuaugcuguacguuaggucaccagaacuuacucauccugcauaauggaagcuucgugcccuuuguuaauacuguacacuugagauuugcugagaguagaucuugaguauucucacacacacaaaaaaaugguaacuauaugaggugauagauauguuaauuagcuugacuguggcuaugaggucaguguuuacauauaucaaacaucaaguuguauaccuuaaacauauauaauuuguuaauuauaccucaaagcuugggggaggagucaauaaaauucaccauauuaacaaaauuguuuaaguucuaggguacaugugcacaaugugcagguuuguuacauagguauacaugugccauguugguuugcugcacccauuaacuagucauuuacauuagguauuucuccuaaugcuaucccuccccccuaccccaugacaggccccagggugugauguuccccacccuguguccaaguguucuuauuguucaguucccaccuaugagucaggacaugugguguuugguuuucuguccuugugauaguuugcugagaaugaugguuuccagcugcauccaugucccugcaaaggauaugaacucauccuuuuuuauggcugcauaguauuccaugguguauaugugccacauuuucuuaauccagucauugacggacauuuggguugguuccaagucuuugcuauugugaauagugccacaauaaacauaaacguguacaugugucuuuauaguagcaugauuucuaauccuuuggguguauacccaguaaugggauugcugggucaaaugguauuucuaguucuagauccuugagggauugccacacugucuuccacaaugguugaacuaguuuacagucccaccaacaguguaaaagcauuccuauuucuccacauccucuccagcaucuguuguuuccugacuuuuuaaugauugccauucuaacuggcaugagaugguaucucauugugguuuugauuugcauuucuuugaugaccagugaugaugagcauuuuuucaugucuguuggcugcauaaaugucuucuuuugagaaguugucuguucauauccuuugcccacuuuuugauguuuuuuuuuuuuuuuuucuuguaaauuuguuugaguucuuuguagauucuggauauuagcccuuugucagauaggucgauugcaaaaauguucucccauucuguagguugccuguucacuuugaugguacuuucuuuugcugugcagaagcucuuuaauuagaucccauuugucuguuuuggcuuuugcugccauugcuuuugguguuuuaaucaugaagucguugcccaugccuauguccugaaugguauugccuagguuuucuucuaggguuuuuaugguuuuagguccaacauuuaagucuuuaaucaaauuugaaaacuacauaucucaauagauaccgaaaaaguguuugacaaaauccaacauccauucuugauuuaaaaguuaguuuaaaaucuaguuaaccucucagcuaacuagaaauagaagggaucuuagcuugaaaaaggcugucuacaagaaaaaccugcagguaucauacugaaguagggaacaagaccaggaugccugcucuugccaguuuuauuuagcaguccuauagcccuagccacuaaaauaaggcaagaaaauggagaaggcaaaauuggaaaggagacgaaacuguccccguuugcaguugauauguuguuuagguagaaaaucccaaggaaucuauaaaacagcuauagugaaguuagugauuacauuucuguguauuagcaguauauaauugaaaauggaauuguuuaaaaucuauuuacaaguaccaaaacccaaaauauuucggaauaaauaaccaaaaaagucuaaaaccucuguaaugaauacuauaaagcaucacugagaaaauucaguaagauauaacuaaguggagaaauauaugacugcgguuuggaagacucaauacuauuaagauguuaaugcuuacuaaauugauccagagauuuaguccaauccuaaugagaauuuuagcuggcuuuuucauugaaauugacaaguugacucaaguuuaaauggaaaugugaguggaccuauuucuuucuugggcuuuaaaaaagagccuaugugugauuggucccuuucccuuuuccuugacauagcaaucauggaagcauagaaaugguacuucucucagccuaauauuguucacaaaaugaagaaauucaggucuagaagugaucugcucaaggucacgcagcuugcacacacaugucuuugaaccaacccaagcaaggcagucuggcuccagagucuguaaucucaacauccacauucuauauuccuacuaauuuguaagagaauugcuguuucucuacauaccugccaacugaccagcuucuugaauauuuaccaaccugaaagguagaaaguaauccuuauugagguugaguguauuuuuacauuuucuggcuacacugauuaaccugugaacuacuuguucaaaucguucgccuguuucccuuuggguugcuugccuuuucgugauuuguagcuccugccuucauaaccaucuugcuuguuucagugacugacccugaggcuuguuacauuggcacagagccauggaaacccaaagaagcuguggaggagaaugguguuauuacugacaaggcagacauauuugccuuuggccuuacuuugugggaaaugaugacuuuaucgauuccacacauuaaucuuucaaaugaugaugaugaugaagguaugaauacaauuucuaacauaaaucccaaucucuucauuucacacuaaagauuauauaauuuuaucuuucuaagauauguauuaguacugaugacugauuugguaccaccaagguuuaaucucacacaaaugagacauagauugagaauagggagaaaaauugaggcuauccagagaagcaaaacauuaucuuaaaaacuccccuuuccugagaaaaugauugauuggaaaacuaucacaggaaggguaaaaguaggggucgauaaccuauaaauccaagacuaaagcaaaucuacuugauggcaggacaauugaagacauuuccauucugucuguggcagaauggaaagcauacuggaccauaaauucuuguuucaggagaagggugagcuauuaaacuuuuccaugacauaaagugauuuuguuuauuguuucaaucucuaacuccuucaagauaaaacuuuugaugaaagugauuuugaugaugaagcauacuaugcagcguugggaacuaggccaccuauuaauauggaagaacuggaugaaucauaccagaaaguaauugaacucuucucuguaugcacuaaugaagacccuaaagaucguccuucugcugcacacauuguugaagcucuggaaacagaugucuagugaucaucucagcugaaguguggcuugcguaaauaacuguuuauuccaaaauauuuacauaguuacuaucaguaguuauuagacucuaaaauuggcauauuugaggaccauaguuucuuguuaacauauggauaacuauuucuaauaugaaauaugcuuauauuggcuauaagcacuuggaauuguacuggguuuucuguaaaguuuuagaaacuagcuacauaaguacuuugauacugcucaugcugacuuaaaacacuagcaguaaaacgcuguaaacuguaacauuaaauugaaugaccauuacuuuuauuaaugaucuuucuuaaauauucuauauuuuaauggaucuacugacauuagcacuuuguacaguacaaaauaaagucuacauuuguuuaaaacacugaaccuuuugcugauguguuuaucaaaugauaacuggaagcugaggagaauaugccucaaaaagaguagcuccuuggauacuucagacucugguuacagauugucuugaucucuuggaucuccucagaucuuugguuuuugcuuuaauuuauuaaauguauuuuccauacugaguuuaaaauuuauuaauuuguaccuuaagcauuucccagcuguguaaaaacaauaaaacucaaauaggaugauaaagaauaaaggacacuuuggguaccagaa

SEQ ID NO: 192509 - RNA, 39338 nt, Homo sapiens
uucuacucaaacuauaagcuuuuauuauuguauuuuacagaucauucauucaggacaugcugcaucugggguuggcaucauuucccuuuugaaugacagaaugugcauaaaagucucuugcccacgcugaacucacacgugcccggcaggaaggagcucucacgaagugccagcuggaugugagcuugcucuggcagcagcagugcuguccuuguuucugagcugccaccuauucacuggaguuaggugggucaaagcugaaauuuagcuuggaauuuaaguuucuaauuuuauacuuuucauuguggucuggucagauuuuagucugcuucaaaaucaaaaggucacucagucacucuaauaugaucauuuugaauauggaaauuuguuauuuacaugcuguaccucaaaucaaagaaaaagcacgcgucaauaucacgcguaggaaaaacuagaaaauuguuccuuuuccauuuugccacccugcucaguuuuccucauaaacgguuccagcuuggaaaacaagagcuuccccucucagacagaugcagcagcgggaggaagggcuuuggucuuaaacuagaagcugcagcugaaacucuccccgucuaauccugcuguguguauggcucacaccaucuuuccugaguggggaaaaccgcuggcacugaauagcugaaaggcucgcugaaaucugugcuucaagaacgaguuaaagacaauacaauaaaacacauagacacugaagggguucaacuaauguccaucacuuauucugcuaaugucagugccuuucaauaaacuucucaacaucuguguugguaaacuucucaauauuuguucuagcccaaccacggugacaaagcucccuugcccaaagaucgugagccuagacaaagguggauaagaaauaugaagucuaaagcuauagaauauagcaguuagugaaguaaauuaaacaugccccucgccugcaugcugaucagaguguugaaacugaagacgacauuggcaaagugacucagacccacagcacagauuugaucaagggcacagcucauaaaaauagcaacaauuucgaauucuccuauccaacguuuaggaaacaauccaauggcaagaaaugagaggaguucaaugccaacaguuugaccugugggcaaucaaccuauaaguccucaaaagaaaauuuccuugcuuucccugggaccaacagagauggggaaaaaaauaaaacaaagaggcugcaggguuaggggcauaggaaucaacacagagcuaugaauucaacaagagaauucagcagagaccuggacauuuuaaaccaguguaagcugaguuaggaaauguuuaaaguuugagccccaggaccucucauacuauaguaaaaauauauguauuuuucaaaagcgcuaucuacauguguugcagugugagguacagaggaauucuguagaagccggacuccuuggaaguauggaaggagcacagcuacgaauacaucugagauguaucaagaauacaucugagaaaggacaucccuuugacccagugagcagcuggaagaaagaggcauuuagcagaggaggagaaagaugauagccccguacagaaccugucagacugagccuaugaugaaugagguuuuuuagagcaagaucacccucaaaaccagcuuguggaaugggggcuacccuuuuuaauagcaaauucuaagaauucauauaucaauguccuuccagauuaaaaaaaugguauuuuauuauaacuuuuaaaauugcggaacaucagacugaauaucaucagacacauacacaaaaccacucaucucuaaagucauuuucuauacccucucaaaauuuggccagugaguuuugccucagggaauuuuccaguucaaccccauacaccaacauggaauaaauggaaacacuagccuuuugguuuugcccacaguuccaaagugcuauuacagguggaauaucugcugcaggaggucauucuugcugcugugggugugaguaaaaugcuuaguuccuucuaaaaucauaauugcaauauggacuucugcuucacgcugcauccuaaggcacaaaucagguaaccuacaucucccaaaugaucaacagagcacuccauccuauuuuacccucaaugcugagaaauuacuccugggcccagaaguugucacauagguggcuuggguuacuuggugcucaggcaacaacugccacaggccccagcuugaugaacaccaucaauuucuuuaaauauguugauacuaagauggaggccucugcucagaggaagcaaggacguaaacgcugggacagacugcacugagggucacuacacuaacagacccagaugacacgauggaacaugaauacugaagcugacaaucuucugaaaaaucucuuuuucaaaacccauacgccuaaucgagaaaucagggacagggaaacauucgcauaauuacccaccaacauguucuucuuaacagaagugaagauuauuuuaagaauaugaaaaguguuucaagacaucuguuuucagggauagaccagagcagcagaaguacuuuucagagcugguucauuuuaaagucuaucucaagaacaagggcagccugcuuucacaagguaccaagacauguucuggcaaaaacauuuucacuuuaaguuauaugcugucaaguucaacuauuuuauacauaucugauccuuuucugucagcaaaaaagguacaauuuuuuuaaaacuugaaaaucaauaauuucuggguaggaugaagguagaauuuugguuguauuuuauauuucagaacacagaugaaaccaaaaggucugcaauugucucuacauucacaucuuucaaagguccuuuucuccuuuucuccuuuuacaugaauucaucugaaucauugccauccuguaggaaacacaaaaaugagaacauaaaagccuugaaaauaauucaauauuuaaaauuuacaauuaucuuaauuagcgagcugccuucucaucucagucacugaguucagaaaguaaaauaacuaaauugacucaucacuucuccgccuuaaguugucaguuuccugacauagcugaauuaacagcuauauuuugugaggugucauuacauggccugauuacacagcaguaagugaccacugaucucuaaauaaugcaguaagucccaccugaccuaguauagugcaaaacaaaugugacuguaagaaaacaugacagauccuucaacaaauguaccaagcaaacacugccucaauguccucaugccaacaauucugccaauaugcaaacugauucuggccuaaguuccaguaauuugagccucaacauugucacagauuugugacuucacaacauggcuuugaucucuucuucuuuuuuaauaggaaaggccaucaggaagucaaacauaggcuaguuuaccaacuuaguugguuugccacauuuuuuaauuuaaaaaaccugcauaaugguauacagcacaaagggacugauuuuauuguguggcuuacaagcaaguccugaaggccacacacaaagguagagcccugacuccuuuuuggacaacauucacuaagagugugcauucugauuugcuugccaaugucacaaucugaacacuacaguuguuuuaucuuuuuucucuuucccauugcuuaacaccagcauuguuagagaaagggaucagacuaaggcuuaucuaaauggcccuuauuaaagaugguagagaaauacgauauggguagaaaacauugguuccugugaagucugguuuuagcuccaacuucacuuagugguuuucucugugguucucuuccauuagcacgaugaacugaagccaagguaaaaaugccuucgauaauuguacaaagaacagacuaaugauuguguuauauccaggcgcaaagacuaugauugccccagagucuuaaucugaaauaaaagcaguagcaauguuugaaagagucauuuaguaucuucaaaugccagcuuuagaucccaaacacugaggaugaacaacucaguaagacagucuggguugucaucaacgaaaguaagccauucccuauaaaggcugugaguuagaugugcagaguccccacuugucuggggcuauguuuuggaauuacaguaauuauucuucuugaugaaccuguauaugcuaaauuaaaacuuaaguccuauauuacauaaacacuugccuuuaacuuaaaaaucaacugaucacguucuaaauuggaucauaaaacaucuguaucacuuacacuucuucacugcuggugggaauguaaacuaguacagccacuauggaaaacagcaaggagauuucuuaaagaacugaaguagaacuaccauuugauccagcaaucccacuacuggguaucuacccagaggaaaagaagucauuauucaaaaaagauacuugcacacacauguuuacaguggcacaauucacaauugcaaaauuguggaacaaacccaaaugcccaucaaucaacgaguggauaaagaaacugugguguguguauacacacacucacacacacacacacacacacacacacacaaaggaauacuaugcagcuauaaaaaggaauauauuaacagcauuugcagugaccuggaugagacuggagacuauuauucuaagugaaguaacucaggaauggaaaaccaaacauuguauguuaucacugauaugugggagcuaagcuaugaggaugcaaaggcguaagaaugauacgauggacuuuggggacuuagggggaagagugggaggggggugagggauaaaagacuacaaauauggugcaguguuuacugcuugggugacggaugcaccaaaaucucacaaauuaccucuaaagaacuuacucauguagccaaauaccaucuguaccccaauaacuuauggaaacaaaacaaaacaaaacaaaacacaaacaucuguaucccuuaacagaagacgguuacaaggagaauuagucuauucuuuuaaaguauggagaaaaacuaggaaaacauuuucacugaaagagagaauaaaaacacccagugcaaaacuuccuuggaaucuugaacuugauucauacuuggagcucaggaacagggguugcaagcaacagagggagaguuaggguagaaagauuagcaaucuuuugggcuacaaauucaauuuccuagucucgggacuuuuaacaucugucacugaucagaugguguuuguauauguauguauguaggucgguagguagguguguguguguguguguguguguauuuguuuauuucucaacucuagaauuauauacaagcuuuaaaaauccaaaaugaugagaauaaaaugacuaaggucaugaaauaauaugggggcuagauuucugguggaaagugccucuaaaacacagaaaacuucaauaagcaaaauaaccacaacaauggcaucugaguugugguauguugaagacuacuguuuaguguuaaacuguuccaauaguuucaagaaaucuaaaauuagcuuccagaaaggauuaaacacaucucaucuuuucauaaugauauucuggaaaaacagcaaccaaagacuaucuggauaagguaugacuauuuacaaaguaggucaaggaagacuuucacaucgaugugucuuugcuucaauucuaagcagcccugugaaauaauauguguccauuuuacugaugaugaauacucccucagagagguuaaaugacuuuauuaggaucuaacccaaccacugugacaacguucccuugcccaagggauguuuaaucccccccaccucaauuagcacaugacaguuaagucucuaaacuucaaauucaaagcucuauuuaauuuaauaaugcuauucuggaauuuuucaggaauaaauuauaaagaaacaucucugauucauaaaggagccucguacauuuaguucuucauagagaugggaauaagaauguuguucuuacaaauuuuuagaagaauauguagauauaaacaagauguaaaauccuauuacuucuaauucaugcacuaaaucugagguuugacuagaugacuuguaagggaucuuaaauucuguuacaguuggcccuugauuucuuuaucugugaauucaaccaaccucagcucaaaaauauuuagaggaaaaaaacaauuaaaaaaauacaauaaaaauaauauaaauuaaaaaaauacaguauaacaacuauuuacauagcauuuacacuaauuagguauuauaaguaaucuagagauaaaguauauggaaggaugugcauauguuauaugcaaauacuacuccauuuuacacaagggacucaagcauccuaggauuuugguagcuucggggaguccuggaaccaaucccccaugaauacugaaggaugacuauauuuuuaaacuauacuauaaaacaugcaaaaucccaaauacauccacccaguuuccauuuucugcagacugcucaauagcagcuaaauugugcuaucucuagacacuucaagauaaauuuugggaaagacagcccucaaggacaauaauucucugacauaguuccaaucaaauaauuagacgcaauguuaagaagauccuuucaguacuaugucauaggucaccaucuguuucuaucccagguccuaaggaacaugaaaacaaacaauuuugucacuuaggcuucacugagucacauaagaucuuaggguaaguuauuuuaauugaaggugauaauuuuguucucauucaauuauaauauggacucuacagucacagugauaaagaacacuaauaaauaaaggcacuuuugcaugccugcaaccagaaaagaggggaaauaaagaauaaaguccuguaaauauaaaaugaauagaccuguacgccacaguagacaagcucugacaaucucuuucccugagaugaccuacuuaacaacacaaaugagaaaguccacagggaaggaggugcagugccuaaaagaauccagccugagugguguccugguugccaaaucaugguuagcuauuugcaacauguaaggcaauaauggccaguaacacaauuauuaaaaacccuuagugaauuauuucaaggcaaacauucaugcaaaccacuugaacauaccugauuugaagacauauuuucaacuuucauuagugaugaauagcuccuagaaggaaaaaaacacacacacacauuuaaaauauggugauccagucaacaaauauuugaugaacauuuccuguguauccagcacugcucaggggcuuuagaagaaacacaagagcuauuagauauaaucucugcacucaaggagauugcaacauucaaaggaugaauauuuauaaacaauaaaaaagaugugcacagcacuuuauaauuuacaaagugcuuucuccuacuuguuucaugucaccaccuccacaauaacuuggcgagacagguggcauuauuccuacuuuucagauggggaaauucaccuacagccaagaucugauaagauucacagcugagguauacagcucagauuguaaacgcuacaggaauucaaaggaggaaacacaucagugugggcaggagcugucagggcacccuucacagacaaggcggaacccaaaccaagccaaucaagugggcaggaugagugagggggcauuucagauccagagagugggaugagcaaagagacagagaugguaucuuuaaugacuugcugaauauccagcuaacucagguagguucucaaauaaaguagugggaaaucaggcuggauguggugcccaauuauguugucuugauugcacgacugaacacaauguguuccgcaagaagccauaauacacaacugaguaaagccauaaugagguucaaugggcauucauuaaauauccaugugcauaagacccugugcuaagccuggguagaggaucggaugagaagaaaacagaaaaugaugacuaacacaaagccuggacccacagaacuuacugggaggggaaauaagacuuauucaucaauaacuauggugaaaagcacuauuaaaaaauacacggcugggggcaguggcucacgccuguaaucccagcacugugggaggccaacgcgggcagaucacaaagucagggguucgagagcagccugaccaauguggugaaaccccaucucuacuaaaaauacaaaaauuagcaagcgugguggcgugcaccuguaaucccagcuacucaggaggcugaggcaggagaaucacuugaaccuaggagguggagguugcagugagcugagauugcaccacugcacuccaacaugggcgacagagcaagacuccaucucaaacgacaacaacaacaaauacaccaagagacaaaggaaagugagacuacauaauaccaauguuuugaaaagaauaaucuguagcaaacaagauuagagaggugguuaagacaagaagguccauucacaauaacaguauuuaccagaguauuuuaagcccauuguacaaaauaagaaagcagagucaggaugguuaaguaaguuguucaaggucuuagagauaagaagauaugccagguuuugaacccaggucagacuccuaagcuuauacucuuaucaggccacagcuuauugcgauacuccaauuugagggcaugaaucccuggaguuaacagcuguaaugguaagaaggaauacagagaagaaacaacaaugacaucaagguuuguagcuugggcaauuugaaaaaaauaggagaaaugggaaaauguugcaaagaagaugugccugguuugagacaugccgcauuugaagucauagugagauacccaaguaaauaugaacuguagaaacugaaaacugaagaccagugggaaggagaaaugucacagucaaagauaaugaguugggagacacccagagggagagaccaguaagucuuucccucuggagagacuuguaagcuuguaagaguuaagugguauccacaaggaauuaaaacaaaacaaaaacaaacaaacaaaaaacagacaagaucaacagguugcaugagcaggaggagaaagacauguugaugaaacaaaaguggugagaacagagaaugucaguccugacugcaucugaaaaucacuugugaagauuuaacuggauccauaugcccaguuguggggaucuacccaggcugaagaaucacugggucaaaauucccaucuaugugacaaugaugcacaaauuuaccuuucuugggcugggcacgguagcucacaccuguaaucccagcacuuugggaggccaaggcaggcggaucacuugaggucaggaguucgaggccagccuggccaacauggugaaacccugucuuuacugaaaauauacaaaaauuagccaggcgugguugugcaugccuguaauuucagcuaccugggaaacugaggcaggagaauagcuugaacccgggagguggagguugcagugagccgagaucgugccacugcacuccagccugggcaacagagugagacucagucucaaaaacaaaacaaaacaaaaaaacaaacaaaaacaaauuuaccuuucuuuaguuuccucugagcucaauuuccauuaguccaacuaccucccugacaucuuuuuggagaucucaaggguauuuucagauucuuaagucccuauccaacucauggucuucccccuaccaaaccaguuuaguucuuucccaguguucuccagcucaaagaaugucaucacuauccauuccauuuccaacuagcaaccuaggagucauucuuagcccccuuuucccugcccuuugccucaauccaaacuaucaccaaauccuaauguuuuaccuagaaaaacaauaauccacuucucuccaccccaagucaccaccauauucuaagcuaccaucugugauguggaaugcucuuaaccuagucacacccacucugguucccuuuacaaucaggucagcaaagugaccuucucaacacacaagcuucauuguaucaacccuugcuuaaagccuuuugauggcuucacagugcucuuaggaugaagacaaacacggccagcaagggccugcauggacuggccccuugauccaagugcccauugaccucugcugcuucagacauuugggacuuuaguccugcauuuugccuugcugcucccauacaaggucuuugcauacauaguucccucugcuuacagcacuccuuccaacucuuuagcuaucagaguuuugaucuuggcuucaagaccaccauaucaggggacaagugugguggcuuaugccuuuaaucccagcacuuugggaggccaaggcaggaggaucacuugagcucagggguuugagauuagccugggcaacauaggaagacuccaucucuacaaaaaauaaagauauuagcugggcaugguggagugagucuguagucccagcuacuaaggaggcugaggugggaggaucgcuugagcccaggaauuggaggcugcagugggcuaugauggcaccccagcaauucagccugggauaugucuggcauguguuuagcagaaagagacauaccaauuguuuuuaguuuucugaauccauggagauuauuaaaaaauacaagugauuagcgacagcuuagaaagggggacuaauuaaacuuuugaagcaaaaauuguagucaaugagacugggaauuauuuccccucaguuaauacaaauauuuuauauguugaggacccuaaggaagaaagcccagaagauauaaaaacuguguuuuaguuuuuaaguuuuguuuaaaugcuuguaauuucugaaacucauaaaaugauacuaacacccuaaauuuuaguagcaugcagcuuaauaugaauuaugacauauauaaguuacuugguuuauauugaauaaaaauuacuuuaaaauugaaacaaaaaaggaaucaccauaccagggaagcuaaucucaguauauucaugacguaugacuagucacucacugcacagacaaagcacucugucaccucuaaggggaggcaaggaugcacgauugcuucccugaaggaccucacagguaacacgaagaggcacagcacacacagcauuauuuacaguagaaggcaguggcaguguguauaagauaaacaaaaaaagguacaaagaaguugguucuucaugagacugucauccauuuaauuaguuacuggucucaccauuuccucuccuacauguuacuucauucauccuguaagucuauuccccaauauuccacaaaaccuauaaaggcucuuuaucacuuacaacaugaaauucuggacuaaaccuuuuaagucacucuacaauguaccuaauuuuucauucuuucacuugccuaugugugaccuugacucuggccuugccaguuuguucauuccuugccucaaaggaagcacgauagacuauuggcuucaggauuagacuugaguuuggauuccugcuuugucaguuacaggcuacaaucuuuccacauuauccuccaugcugaaguaaucuuugcaugaaaaucaaguucaugucaauguucaaauugaugauauauuuacugacuuaccauuucaccugggucuuguacuucucucauuccaauuaccugagcuuuggguuccaauucugaucucccagucucuaucacagcuuuuuauuuuuauuuuuugaggcagaaucuagcucugucacacaggauggaaugcagugagcucacugcagccucagccaacagggcucaagcaauccucccaccucagccuccagaguagcugcgacuauaggcuuguaccacccacgccuggcuaguuauuugauuuuuuguagagacaguccuaauuuuguugcccaggcugaucucaaacuccugggcucaagcaauccuucugccucagccucccaaagugcugggauuacaggcaugaaucacuuugccuggccgcaucucaacuuuuaaauaucccucucucagguagucauaguccuuacccuuuguuuugacugccucaaccucucaucuguuauucacccauccucuuuaugacguuucccugacuauugcuuauuucuucugguuucgacaucuacauggguugacuuaauuuugauguaauaaauguuugguacaguaacacaaaaagccaaauaaaagaaugcaaaauuaaaacagguaauagacacagauuucuauaucuuggguggaagauucaaagacagaaauuaaagugaaugcuagcacugcaaaauguauaaaaacacauuacaaaacaagucagaagcuuagagccuauugcuggaauuucacagaugcugcagaacacagcaaacggcagcucuggaugugccaagcaaagacuugcaaugucaccgcguuccauucccggcacugcagcccugugccacguucuucugucuucugcagcaugugacagaaaguugucuguguggcacacgguuaacggaaauaaacauagcaauuguuuuugguuuucugagauccauggagauuauuaaaaaauacaaaugaccagugacaacuuagaaagugggacugauuaaacuuuugaaggaaaaaucuuauucaauaagauugaguuuucccuucaguuaauaggaguauuuuauauguugaugacacuauggaaaaaagcccagaagauacgaaacuguguuuugguggacaaauuuuguuuaaaugcuuguaauuuuugaaacucauaaaaaucauacuaauguccuuaauuuuaguagcaugcagcuuaauuugaauuaugacaucuauaaauuacuugauugauuuauauugaauaaaaauuacuuuaaaauggaauaaauugaacaaagggaagaagaguauaguaaguaauauguguagguuugagaaucagacugagacuaacuagccaaaugagcuuauaacaaguuucuugauugcuucucaggcucaguuuccucuucuauaagaugcagauaaaaaucuacuauggcuauuguuggaauuaaaugacagaaugcaguaaagcacuuugcaaugcaguguuuggcagauggaaaauguucagaaggguuagcuagucuuccuuauucaauguuguaaguaaauuaggugaucuuauguuccuaauauauguuccaucauguuccuaaacaaaauuauguucgauccguaaagggcacuaaaaggcauauuuucaguuuccccccacuccaaacucaaaacaaaaaagaauuaacugcucuaaauccugcaucacucagaauuucacaaauuuuaccucacugauggaguuaauaccguuucuuucacuucaaacacaaagcagacucagaauucuaggccauaccaaauacuuaaacauauauguuaguuggccucauauuagcagauuguaacucaggguaacauuucugaagcucuccauuugaacacuguauuuuaagugaagccuguuuuagcagaaccccaaccagaaacacgugcaugcgaauaauaaauaacaguacguguucauuauaccuacauucugacccaacaaucuuucuaagaauccagggcauuccaaggaaacuggguuaggacaugccuaagcaacauguuucugauucuacaccauuuccaaaggcaauauauguuauaaguaacucuuuuuucuuuuuggcauauguauugcaaauaaacaaacauggaaaaaucuaggaguucugugaugagaauucgcaggauuaauuuccuuuaauuagaacaacuaggggcucugcggguacagcacuguauggcagaacauccacauucuagucuguagaaccuauaaauauguuaucuucuauggcaaaguagacuuugcagaugucauuaguuaggaccuuaaaauggagagauuauugugaauuaucuggauuaacucaaucuaaucacacuguuccuuaaaagcagaaaaggcaguggucagacagggggcugugaccauggaaagcuuggagaaggagccacaagccaagaaaugggggugccucucaaagcugaaagggaagauucuccccuagugccuccagacacuuugauuuuagcccagugagaaucuugcuggacuucuaaucuacagacaauaaauguguguuguuuuaagcuacuacauuuguggcaauuuguuucaauggcaauagaaaacuaacauaaucauuauucucauggccuucuucacuagaauuucaggagccaaauuguauuugaacuauuuagcuguuuaaaaauguagugcuuugaagcagaccucacuacauuacuuuaaacuuucaaaauguaaaaaagaguuuuaaaaacagcuuugagaguuacuagcauugguuuuuagagccaacacaacuuuacuuaaauagcacagcuagucaauaguaaauaccucccacagcaccuuuuccuuuccagaagaacuuuacaaaccaaaccaaacuagggauaaccuaugaagguuucucuaugaauaaaauuaguuauuuuauuucauccacuuucauauccugcugccauaaacaagcaauucuuuuaaccaacacauuaauauaaaugccuuuuuuuaaaaaacugauuuaagguugagcuuaagcugagcuuguuacaugucccuccuuccaccaauauaucguucuuaauggcuaauacaugauuaaaaucaucagggaauaaucuuugaggucagucucaaugccacagcuccgacauaccuaaguucauccauuucccucuucuucuucauuucuucuuuuucucucuuuuucauuuccugaauuugggcuuuuuucucauuccucucuucacgaucucugcauucuuucucugcugcuaggucugggaaccgcucgacuuuggucuuuucuaaucgguucaggaucucauuuacuuucuucuccacugucacaauuuuuaccuuuaagggagauaggagaaaagauauugcaucuuuuuguuuuuuuucucccagaagagggaugaggcuuuccagggguuuagcaacccaguuuaauucccuuuagaaaacauauaucaugcucagcccucaacaacaauggugucagacagaaaagauaggauacuccauucaguaucagggcuccgccuccuucaguggcacaaaacacuuacauccuucugccugugaaagccuaucugccccacauccaugucagcuguuuucuucagguuagaccacggcguauauaccacauuaacguuguucaucuugcagccugccaagagagacugucuucaacaugcaggcaggaugagacugagcaauguguucccuuacccacuggcaaacugccauaagccaacaagggaaacggcuuagaacgaacaggccaccccuuguuuuaaaccaccaauacuuuuucaaaagccacccacaaaaggcaaaugguaaagcugacaaaauucaaacggaaguauuacuauggcaaguaggaguccauggauuagcuucagggacuucugaggacucucuaaaauuggaugcaaaauuuaucauugaguuuuuuuuucaagagaaaaggacugaauauguuuccucagauucucaaagaaguccuugacucugaagguuaagcagcaacggaaagccauggccuggaacucacaagcccuggacucuauccgggacuaccacgagcuagccgagccucucuggagaaguccccuggcccucugaauuucauaugaaaugugaggaaauuggacuaguuuaauagaguuuuugcuuauaguuucuucagcaguggaacccuuuuaccaaagaaaacacagaagucaucaaagcagaggcgcucuggauggaaggagugccagguacccuguucacuccuccuccugccccuucaccgccuccuccaccacucauacccucccuggcagcucuggaaaucgcaguuuaaucacuggucugacacucucucugguccuuccaaauuagauggcaagggauuucaaugcuuauuaaauccccauguacacuggaaaaagcuggaagaccacuuuacccaaggggucaagguuaacaccaccaaaaauggcacaaaaugacaucaugugcugccugacuauaaugugcaaaacuucacuuauguaauauuccugcuccaaagugcaugaugggauucuaauccagaggaagcaucagacaaaccccaacuguggguuaguaaucccauuacuacaacuggucuguacuuuuugaaagacaaagcaguaucucuggauuaaaggagacuaaagagaaguaaauacagcgcaaguaaauacagcacauggcccuggauccaaaaaaaaaagcuauaaagaaacaguagcgggacaaguggcaaaacuuaaauauggacuguauaucagaacacaguauucuauccauguuaaacuuccugaauuuuaccacuguaauacaguuauuuaagacaacguccauguucuucagaaggacauguucaagggucaugauaucuacaauuucgcuuuggaugguucagcuaaaaagguuaaugaguaugcaauauauaaagcaaauaaauauggaaaaauuuaaaaauugaugaaucuaagugaaugguauaugguagcuguacuauucuugcaacuuuucuguauaccugaaaguuuuuucaaaauaaaauuucuuuagaaaaucuccaugugcaaggcacugugggggacacaaacaugaccagacaaugaaucuugcucuccacgacucuaacggagcaggguaagcacaucaauaacuuggaucaaaaggagaacugaucaaaugcuguuggaaagcuacaggaaacugcuaagacagcacagagaaaguggggccacucaaagcugaagaaggaaaaggcuucaucgaggaggcucacagagcucagggguuacggcagaacacuugagccaaauggguugacaucaaauccagucucuacugcacuuuagaccucuaagaccuugaacaaguuccuuaauucucuuuaagaucaguuuccuccucuauaaaaugaaaauaauaucuaacucaacgggguggauaauuuaugaaguacuuagcacagggccaggcauguaauuaacacuccaucaguguuagcaauuacuaccaccacuacaccuacuauguggaccuugaaccuuagcuugaaucuggacucugaugacugacaaagacaaaccugagggcagagggaacaauacaagccaggugcaaggucagaaaacagcaaauauuggcuuuggcuguagugugaaauacgugaagggaaagaagucugcagucaaaugagagacgcuuaaaugcugguuucagaaguccggacugaacaguuuaggccgaggagagucaagacaguuucuaaacuucuaaaaguuuaaucuggaaagauucacugggugaacacagaacaggcugaccuaagauucuagaccuaugacccagaacaggcugauucuauagcgacaaacaaauuuagccccaaagcccuugguucugagcacugcagaugguaaaccgggggaaaacuuugucccuacaaagugccacaaguggaguguccucuggaaaucucauagcaacgaccauuuucuccacuccucggcacauaaucuucuacugacucacaagagcaagacccuugggcauagguccuuauuugcuagcugagcuaucguugcagaaggcugaagaggagagaaacaguaauucagugucaugacucuuugcuccucuuuguuuucucuagaauuaguaaacuaugaagagauuaagaagaaagcagcugggccaagaauaaggccuccaaagcucuuuuaacaaagacaugucugcuagccagcagcaauggaagggauaaggacaugugaaggaaguuggaacacagaaggaaagaauauaaugauuguuucaauucuucuuguuauuucaguaacugaagaucuuagcugaaaaucuuagaaaauucuguucuccucauacaauggaaugucccaaaauguauuacaauuuguuaacuuauagaguugaaaaucaguggcucuguaaagcaacaguucuaccuucuuuggcuaggugcugacgcaucauucaggcagccuaagugaaggugugggaagcgcagucggggaaaggggaaugcugcgcugcucuuguccuguaauugccaacuccugguaccuguuaucagcuguggguccgccccauguuuaucuucuucccaaaccaugauugcuuuccaacccucuggagcaucccuucacuccaucucaagccacaauaaccucuacccgaucuagaccuguguucuacacccuaaaaucggaucuacuggcucauuauuagcagagcaccaccuccugguuucccuucuuaaaccccgccccuacccuaauaaucauccuucuugacccuucaugacuaugagaugaaaucuugcauagcagaaauaaauaccagguaaugaccaagcacgguaugccaggccccaucuaaaauacuuaggcuaauuguucucaacccaugcugcacaggagaaucacccagagagcuuuuaaaagcaguaauauuugggaaucaccccagacaaacuaaauaagauucucuuugguggggaggggaaguaacaagaucaacugacuugacaacuucgcaauuuaagagggaaaaaguauguaagaggaggagggaaagaaaaaguagagaagcaugauuuggggacuuuaauucuagaaucuaaugacaaauaauagaaauaaagauaucaaacaacauuaaaaauaaagccauaaaacacauuguucuugcuuagcuaucaacauugccaaauuucccaaagucuuuuuauaauaacacuaaguacagacagaucuagacaaccuucuauucaagguaaggaaacaguaaaaagagccgagacuuagacaggacggucaaaaugacaaggguggggagaucaguuuuuaguucuuugacagguaccaaaauugccauccaucuuaaagaacaaaacauggcaaaggcacagcacauguuauucuuugauggaggccaaagucaacagcaugcucacuaaaauguaauccauuucagacacagagaaaguccgugcuaauucuaaaaacaccucuaggaaaacugaccuugaaugcuauuggccuucacaaggugggcacaguccaucagcacuuccuuugggaugucuucuauauucucucccugaaacacaaaaauaaaccaauugguccacuaccucauuauccauugacacuggagcacucaaagggcauuugcugccuuaccuacuaggcaugauuuuacuaaaagcagagguucuucaacuguuacagaacacugaaaaguaaauuuacugugugcauuacgggaauguuuguuuaaaauaagagaaggcuguaauaugaaaauauugacacuuaauaaguaaaaaaaaaaaaagcaaaaaaaaacaggaaaugaaaaaaacucccagaauauuaauuauaauuaugucugaguaauuuuuauucucuuucuucucauucugacuucuagaaaccuugugggaaaauggugccuauuuuugacaacuggaugucuucguggccgaggucccuaugaccuuccucucaaaagaauacguguaguuuuaguucucagacaucugguaggucaucuauccucagcuuuaaucaggaaaaaaguuauuguuguguagaucucaaccauucacuguaaagaagaaauaacagaaaugacacugauccuuuuucucuauagaaauuuguaucaaaaucaaaggugaauaagugaggugaugccccuuuuacagaugcagaaacaggccaguuaaguaacuugcucagagucacguggugaguaagcagcagaaccagaauucaaagccagcagucuggccccagggucugaaugaaucccuuagucuuacugcauuuccaacuuccuugguaccuacuaauuacaauggcuaugucauuuacugcaggaaauuaaucagguaaaaguuccucaaggagcauacacuuucaaacugggcacauuaggcuggguuuaggggcucgugccuauaaucucagcacuuugggaagccaaggcaggaggacagcuugagcccaggcguucaagaccagcaugggcaacacagugagaucccauaucuaccaaaaaaaauuaaacugagcucauuauguguuuccaaaagaaagugaaauugaacuuguauucaaacaaauaauuggugguaaugagaacuugggacuaccaccaguauuuuccaucuucugacacagcagaucccccaaagaagacauuaaucugacccaaaaugaaacuugguaacaccauaauuuauuuucucuaaaucuaauaguuccaaaauggcaagaaguugccuaaaagaauucagaauuuugcuccagcacagacuucauaauccucuuuuccuucaccauauaguccucaaaaacauaaauaguaugagauggggcacacuguuuaaccuugcuaguaaacuaaaaagugaauauuauugccauaaugaaguagcaucuuauauucaucaaaauggucaaaagguuuuauuuuuauuuuuuaaguuauaaaacccaaaaggguuuuggaaaaccuauaaauaguagagagcauuuuaaacaauacuuucagagggcaaucuggcaaaaaagcaguuagcaaacuauguacaucuuuugacccaggaaauccauuccuaagaauuauucuaagaaaauaaugaaaaacaaaaaacaaaaaauaaaaccagaagguaguucaugaaaaguuauuucuuggugauucauaaugcugaaaaauuggaaacaaccuauauucugacaaaagaguuucauauuaauugcagcauauuauuaacucaaugcagccagucaaaauaacaaauaugaaaauuauauagcaacauaaaagaguucauaaaaugucauguuaaaagguaaucuaaucaaccaggggaugucaagauggaauguggacaagauaauuuaacuguauuacaaacauaggacaucacgucacugaaagggguggggaaaaaaaguagcuuacagcuaacuguggaaaaugauguguuuuuguuguuguuguucuugacacagggucuugcucuguugcccaggcuagagugcaguaaugugaucauggcucacugaagccucagccuccgccuccugggcucaagugagccuccuaccucagccucccgaguaacugggaccacagguggguaucccacaaccagcuacauuuucuuuauuuucuguagugacagggucucccuaugaugcccaggcuggucuugaacuccugggcucaagugauccuccuugcucagccuccccagaugcuagcauggaaaacaauguuuugauuggaaaugguuuaaggcaaaaagacaaccuguagcaaaggaugacaaucagagccauccccaugagcucauguuuagcuuaauauaaauacagauggaaagauacagaaaugauuacagauaugugcauauacauggguuaguacacauacauguaucuccuucucugucagcucagagggccgaaaagugaugacacuccaguaguaacaggcgcacccagagcccagaucuuuuuaaauuuuuucacaucagacaugacaagguucaaggguggcacaucucauacaugcacaugaacagccaaucaucacacucauaaacuacagaaggaucggucuagaucuugauuucgaaacaccauuaccacugaaaagaaccaggguuccuuggagaaaugccccauucuagagcugggacagggaaaauacaagacgagccuggagcucucuguagugccggaaagcaaggaugugcucaaagaacaaaaggaugggagcaugucagaggacaugggagcacacgggagcccgcugaaagagcuccagcugaagcugcaacaauaucagaguaaaauaaccugguuacagaacauaucucaaaggauaaaauaaacgcaggagucuaggcugaugcaaauaaaugacugaauaaauaaauaggggaaaagagacaaauguuccuuccagaauuccaaauaauguauauagacacuccccucuccaggaaguagugcuuaauuccauccuccacuuccuugagugugggcuggacuuagugacuugcuuccaaauaagaauacagaaauggggagaaaagcaaccuuauaguagagcaaccuccaaacacuacacuggccaggccaucaaggcucacgucaucaaugauaagucacgguaauacacgcacccgauaugcugugacgagacaggcacuucaccucugugauauucucccccuaaacccauaacccgucuagucacgagaaaaaauaucagauaaaugcaaacugagcaauagucuacaaaacaccugaucaguacuucucaaacugucaaggucauaaaaaacagagaaagaaugagaaauugugauagacuagaggagacuaggcagacacaacuaaauguaauaugguacucuagacuggcuacuagaacaaaaagagggcauuaauagaaaguuggugaaauccaaauaaaguccagaguuuaggugacagcgaugugccaagguuaguuucuuugucuugacaaaucuaccauaguaauauaagauguugaugaugggggaaacuaggugaaggguagaugggaacucuguaucacuucugccacuuuucuggaaaucuaacauuuuuccaaaguugaaaguuuaucaaaaagaaagcaguacacucgcaagcauauauacccuaugauucaacuauauaaaauauaugaauagagauagauuggaaaaauagugguauuguauuacuaggggccacuaaaaauuuuuuuccuuuauuacuagcauguucuuuuaaacuuccuaaagaagcccaugauaacugggaacacgggcccuucacugaggcaggagaaucacaugagccacacaugauauccacuggaggagacagaaagucugggagugucaacugaauugaaagaaaaggaaagcagagaugacagacagcacaccggaagugacaggauaagcagugcaucuagcugggaaauauguacacugccuccuucuauaucucaaaaaucaucuagaauguuagagugauuuucugggucagagggaagacacgucuucauuuguuaacuuuuagauuugcguaccaacuuauuacuguaagcaauuuaauugcaaaggauaaagaacaagauaugaugcaucaucaggagaaaagucaagaauccauguuuaaauucaguuaccuuauguaaucgaagguauacaugagccgaagagaguuuguccacaugaaaccuacaaagaaugaaaaccacuuuuagcaagagguacaagacaaucaucuccucaggccacaugccauuuaaagcauucuguucuaaaaagucuucacuccaugccugccacaugugaagcaucaugaggaguauaaagcacagucaccaccuccaaagggcuccccaucaccaugaagagguacgagaaacacugaauuauggagcugugaguaagugccaagaugaguagagauacuaaauauuaacuguacugggaagggugauuuuucaagauauaaaaagaacuaucagugaucaaaggcuucaugauaaaaaggaggcagugagauuugguuggccccugacugaagcauaggacuuagagcaaaaccaaggaaaggaauuucaggugaaaagagugggggaugaaagaagucagcaagucuccaaugcugccagccugggagauuagcagaaccacaguuuggcggaaacagaugacaguuucguuugugacaucccaaauuucaaguuauagcaaaacaauccaaagagaaugucgaauagagagcuggaagaguuagguggggccuaaagacgcuaagcagaacacgucauuaaaugggucacaauucaauaauguaacccaauaauucacaagcacaacaguucauccggcccuauauucugacagugauaccaauauaugucucuugggugagcacugcccuuuacugacauuguccuaaaaacauucagaaugucccccaccccuuaaauuuaccuuucaugauggaucuaucaucuaucaauuuaauuaaaccuuuuaaaaucuaugcaacauucaggauaugagauuuucauguuuucaauucacccaaugaacuugacuuucucuuuccaauacccagaaaugcccccuccgcaucccagcaucacacaacaaacaagguaacacuaucgccacuucgugauucuguuaacuuuaguugauaugauuuggauuugcguccccaccaagucucaugucgaauuguaauccccagcguuagaaguggggccuggugggaggugacuggaucauggggguggauucuucaugaauggguuagcaccaucccuuuggugcuauucuuaugauagaguucucaugagaucuguuuaaaagugcacagccccggcacccugcuccugccauguaagccgccucgcuuccccuuugccuucugccaugauuaaaaguucuaugaaugaggccucccagaaacagacacugccaugcuuccuguauagccugccaaaccaugagccaauuaaaccucuuuucuuuacaaauuacccagucucagguauuucucuauagcaaugcaagauggacuaauacauuagucauacugcuuccuugguccuuaccuuuccagacugaagaauguucagaaaauccuaaagaggcaucauuacaucccauuauguuucucuagccauuuucuuaagcacuaauaaauguuuuagaggugaaaauggucaccuucacaccuaguacaagauguagacuguaugauucuauauaaaagugcccucuuuaaagagguuagucaucuugcuauucacuaugcauacagaaaaauauuaggcacuuuuggcacacaguuuaugaugacucgagguuuuacucuuaaucauuagugauagccagaaauggacauaacaucuuauuugacuuacauuucuccaagugguucacuuacucauuugcauucccaugugagagauucauacuaauuaucaccuucagcuggacauuuuccagccagaaaaaccugugcuuuuugcaaaucuaaaaauuacauaucucauuauccucuuucagaaucuuaggaaaauaucacacuaguaaccaagauaacugaaaaguaacuuuacccauuccaacuuuuauuugccuuaagccaguucucuauuuacaacaucuucuucccuauguaccuauaauagauugaauucugauuuuucuuaaaggucucugauguagaauuuugucaaaagaaauacccaaauaauucaauauauauuuaaugauauucauacauaaguagagaaagaaccaaaacacacacaggaauaucacugccaaaauacagcaacuuuaucaauauacaccaauuucagguuuguauaugauagauacaccucuacaaagagcaggggagaauggaugaaaguauaagagaaaaaaaaaauccagcucuauaaacaaacuaucuugagcgaguuuccuuaaaaaagaagcaaacgacuucuccaaucuuucuaaacauuuauucaaaguuuaaauuacagccauaguucccucuuauccuuguuaucuuccucucccuguuacccuuuccugaaugcagagaccagaagcuucacuaaauaagcaucaacugucugaggauacagauucagggcccuggagcugggcuguccaacgacuuaaagcagagucuguggaaauacuaaucauuaggaggucuggacacaguaaauacacacuauuucuauuuuccuacauuuaaagaugaauuuagggcugggcacaguggcucaugccugucgugccagcacuuugggaggccgagguggguggaucacuucaggucagggguuggagaccagccuggccaauaugaugaaaucccaucaccacuaaaaauacaaaaaaauuagccaggcacaguggcgggagccuguagucccagcuacuugggaggcugaagcagcagaaccacuugaacccgggagguggagguuacauugggcuaagaugguacuacugcacuccaaccugggagacagagcgagacucugucucaaaaaaaaaaaaaaaaaaaaaauuagccugguguggugguacaugccuguaaucccagcuacuugggaggcugaggcaggagaauagcuugaacccgggagguagagguuacagugagucaagauugcaccacugcacuccagccugggugacagagcaagacucugucucaaaaaaaaaaaaaaaaaaaagaugaauuuaguuccauucucacugauuccuaggaaaacccuuugcuuaaaggagccucaggagguuuuccgggauaaauccagaugcugacauucacagagguaaugaaugauucaacagcuccacaaagugaagcaggugaacaccccacccuggaauggugaucaacucaggaucauucuuagcacucccuggaauauguccaaaauugacagcuggaauggguuuugaggucuacaccuacucacaucacaccucaaauguagcuucugaagguaaaagccaaucacauccaacaacagucauucaucucaagacuacuaaagggggucgaaauaggccucuugguaucuguagaccaauuugggaaguacuaaccuuaaugaaaugaaaaacugaggucauaauuuauuggauguggguuguaaacuggaaauuucucuuccauuuauuuaaacaaaugaaagucagguagaaggcugugguacacugauuuucaggcugcaucugauuauguaaccuucucuaugcagguuuuuaugccucaaaccugauagguuaaaaauuuccaucagcuaacugccuaacaggugcagccauucuuauucccaugagagucuggagaucuuuaaaaacaacugaaaaucauccagcugggguuggcaggagcucaaaauggagauaaccaugauguggccauuguagggaaauguccauggagacugcuucuacgcuggcagggagucaauuaggaaaucaaccaauauuuacugaauaccuacuaugugccaggaccuaugcuagguacuggggacauaguaguuaaugaaauaggugaucauuguccucauacagcuuacugucucaggcccuaggaaggcgggcagccccagucuggauguuuucagcauugcacacugcccacuugaggcaaaagagcaccaagcaggguuuaacuugaugacauauuuggauuuagaagacagguuuuugugcuggaauagggaccagauuuaaauaagccuuuaaaauuccuuuguucuggcugggcgcgguggcucacgccucuaaucccagcacuuugggaguccaacgcggguagaucaccugagguuaggaguucgagaccagccuggccaauguggugauagccccagucucuacuaaaaauacaaaaaauuagccaggcaugaugaugggugccuguagucccagcuacucgggaggcugaggcaggagaaucucuugaacuagggaggcagagguuacagugagccgagaucgcaccauugcacuccagccucggcaacaagggcgaaacuccgucucaaaaaaaaaaagaaaauuaaaucaacucuucuaaaaagcaguagcccaacucuaucacuagagggaaauaagugaagggucuguguccacauuuggagaaaagagguccagagagagcugcagcaacagccugggagaagaaaggagcugaagccaaaagagcagcagccuggagaagacagaagcagugacuuagaaccagagccagagccaguagcagacagagcagacccagucaguuucucuuaaccuuaauuuccucaucugaaaaaaugggcauaaauauuaauaucuauuucacaggguuguugugaaguuaaauguauuaauggagguaaacacuuaguaguauuuggcauauaguuaagugcuugacagauauucacuaucauaauaaagcaaacgggacccaggugccuuuaucuucagggauagcauuugguaggagguaugaggagucaggaagaugauaucccacuccauaggcaggacugugcucuagaagagaggcaauacuagggucagagucagugguggaagcugaagaugaagaaaacgaaaguagacugggugugacaguguuauaggacagaagcccauguauucauaaaaggccccaggucugaaugguagaagucuauaugguguucuaagacagagaaaagaauucagcuuaaaugaagucuuuuuguuuguuugguauucuuuuuuuuuggacuggguuuugugagcaaaauaaaugaucucaaaaggagacuaagaaaguauauguuauuauuuaaaacaguucacauaaauuguuuuagaaagaaggcgucgggguuggaucaagacagagcuaaacucaucagggaguuuagaagacaaaggggaacaagugugcuuccuuuaaagcuggaccaguaagaaccuccgucuauuccauccgcauggaugcuuguaucuauuuucuucauugcuucaugugaagucuucauuuuuccacucaagaacaguggucugaauauuuaagugagguguggucucaguaacuuacuauggcguggagacaaaaaggaggaaaaagaaggccuguguccuagaggccuuugcucucaagccugagaucaaacccaaaaacaucauuuccaacuugcaagguaauuagaaaugaaggaacuggcagucagcuguuuaacccugaagacccauaaaccacaguacaaagcaugauucuaguuugaaugcuuggccaagucuaagaaaggaaaugaugaucuacagagggcagaaccaaaauuguuacuuaccagauaucuucaggccagccaugcuugaucagaucuucaucugcaaugagauaugagaaacgaaagaaacaaaaacugucaaaugaagauaugccaggguuuauaagaaugggagaaaugucagcuccucccacaaauuucucucucccucaaugaagaagaguaauucggaggccuugaugcuugaaaauacagaaaaaauaauaauuuucauaauugaacaauaugaacuuuauaauuuuuauaaauuuauauaauacuucuaaucuaaagcucagauauuauuucuauaugaagauaauaaaacuaacacugacaaaacaaagcaaccaauaguucagauguuucagauaaucaauucaccuaauaauacuuaaacauuaaaaagaacuggcugaaacuuuaaagaaauauuuuacuucuuuaagaaaaauuaacuugauuauaaaauuacagaaaauuuaaaacaaaacaaacauuagaaguauaaaaagaaaauaaaaaucaccuuaaauucuaucacacauggaaauaaaacaccagaagaaauagcuaacagagugaaaaguaauugucuggggagguagcaggugggguggaacauggguauuaagaaggauucuuuuuuuaauucuaagcauucuauuacuacuugacuuuuuaaacuauguauuuguuagauacaaauaaaaauaaaguucuuugggaacaaugacuaccuaauucucuuauaugaauaaacuuuucuauuguuggcccuugguuuguuucuaauuauaaaugguucaauaaauuuuuuaaguaaaguuguccauauuucugauuauuuccuuaagguauauuucuaaaagcuaaaguauucgcucaaagugaaugcacauuuuuuaaggcuaauauauaucacuacauaaagguuauaucaauaaauauuucuacagccauauuaauaauuaguaauaauucuguuuaauacagaauuauuuaaguauuaaaugccaauuuaaaaaucauaaacaauacugggcacaguggcuuacgccuguaaucccagcacuuugggaggcugaggcgagcagaucaccugaggucaggaguuugagaccagcuuggccaacauggugaaaccccaucuccacuaaaauuacagaaauuagccaggcaugguagcacgugccuguagccccagccacucgggaggcugaggugggagaauugcuugaauccaggaggugaagguugcagugagcugaaaucacgccacugcacuccagccugggugacagagugggaaacugucucaaauaaauaaauaaauaaauaaauugugaaugauucauaugugaugauuuaaaauguacccaagaaaguauggucuauauaauuugaaugggguauuuaccauccagaaaaggaaaagcaaaaggaagacacaucuuggguaaaggcacucauaacagucguagacacuaugaguuuucugaaaggcuuucuaaugcuuuaaguaggacugagcaaauagccaaaagguaagcaaaaaaaggaaagagaaauuuaaaaaaucucuuucccucagucaggcaaaguuuggcucccugaugacaccugcuggcugauaaaaagaacagaccugaaagcuuuucagugaaaguaaaucauuccacuuaaauugauguuucuaucgaguucuuggucugaagucauaaacacuauuagaaauaaauguaaugggcuaggaaugccagacaauggggugauuuagagaaguaauguccguucuuacaaggcaaccuaggaaaaguugauaccuccaaaugacucuaagaguucccagggaaaaaguguuccauacauacauacauucacuuacuucagacaacagauucucgcugucucuuaagcuggaaugcaguggcaugaucacagcucacugcagccuaccucccaggcucaagcgaucuuccugccucagccuccagaguagcaaggacaacaggugugugucacuaugcccagcuaauauuuucuuuuauuguuguuuuuuguagagacagggucucccuauguugcucaggcaggucucgaacuccugggcucaagugauccucucgccucagccugucaaaguguugggauuacaggcgugaaccaccaugccuggccucuuacguuuuuuucuacaaagguuuuuaaugacagcaaaaugccacuccagagggcucuaaaaauaucaucuaaauuuauaucugugacauaaauuauguaucuagauuuguaucuauauauuccuacaauagacauucaaaggauuccacaaucuaguccauccuaacccacuccuccacaaagccuucucagcuuucaaucacauuuacuaucucugaucugucuacuucgacagcauuuacuauucauguuacuucauuuugucuauacuuuuuaaaaaauagaccuuaguacuuuuucaugauaauaaaguugugacauuaacuuugggugugauuuaauggugaagcagucugcagcauauuaacacuugaguuuuacauuucuccuacuaacccauaaaucaucacaaguaacauugauaguuaaagcauuuuucuuauguagcuuaggaggugcugcugucucccuaugugagcuuguucuguuucucaaaagcuaguuuaucaaaguaggugaaaacucagaaccaacaaacuggguggggggcauggaagguggugagugagagauaacacuuaccugcugaaaauuucaaaaucaaaugcuuuugaaaacuuacuuucauauuuaucuuuucccauguaaauaguguaggcagaugaauuaacuaagauaaaacaaaaauaaaaaacaauuaguaacuucaucaccaacaaaauuguuucaugugaaaaacaagugacaauucuuagacuaggggcuggcaaaccauggcccaugauccaaauccagccuaccaccuguuuuuggacagcccuugagcuaagaaugguuuuuacguuuuuaaaggguuggaaaaaaagcaaaacaaagaagaauaagccacggagauuguaggugacucacaaagccuaaaauauuuacuaucuggccccaaaagagaaaguuuaccauccuuacuaauagcuacuuuccuacuuucucaggguuacaguucaaugguaucgccaguccaguccuauacuuuugccuucuuuaagaguuaaaaaaaaaagaaaagaaaagaaaacuaaacaccacaacuaaguucccauguuuaccaaaguuuuauugugcauaauuguuuuuagccaauauuacccauauuccaggugugcugcauauucuaacaggcucucuaucacauucagggagaccaugacucuccaacuucuaaaccagugacucugaccccugaucuacauuagaaucaucuaauuaugccccagcuccaccucagaucaacucaauccaaaucucuggugggcaagagugagcaucuguguuuucuaaaagccuuccaagugauucuaauauaaggucaggguuagaaacaacuauccuaacucaaauggaaucuucuggguaugguuuauccuagaaaugauauuugcuuuaccaaggugguguuuuauugcagacgucccuaccuuggauuccuacugaaaggauaacugagugccagguuucaaagcuaguuuaccaaaacuuguuugauccaauuggacuaaacuccugaauucauagacacugggcccucaggcuacaaagccugugauggagaaguacugaaaaauaaauacacacugaagcaaaguacugauaagugcaggguugggcugaacagccugcuggcuaucacuccacagcacagaacacacacauguaccuggagcccugaaggacaaagggcaauacgcucuccuaaauuaaaaagccuuauaucagagagaugcccuguacuuucaguaaugagaagcuucuuaaaugaucaauccuaguugccuuucucgggggagagaaaacuaauuccuuuguuuaacauuuauaauaacugaaguccagaaguaguugagaaaaguaccuugaaagaaugugugcaucgccaaguuuauagaaaugcuugucuauuauugagcauuguaguaccuugaucaggccuuaguguagcguguaacaaaugccaaaagggugggaauaaaacuaaaaagcauuucagauuuucucugcauggccuggcaauaguucaaguguauacccuuucaauccuauaacgucacuaccuauaauguuaccauaauagaguaccaaaauacuccaccaagcaauaaucuuuuuacaaccuaaacaucccuuaauagagacucuuuaaauauauuacagauuugaacauccauaaacaaaauaccauguacccauuaaaaagaaacggcaggugaagaaauuaaauauccgaacaguauuuuuguguaucuauaugauucaauuuauaaaaaauaaaugauuauaaugguauguguguguauauacauacacauacauguuuuauuuuuauauaagcacauacuucauauguauggaagcauaaacauuuuuuaacaacaguuaccuugguuagccugcuauaaaacauacagauggcuuuuguaauuagaacagaauuuucaaaauaacaauauaggccaggugcaguggcucacaccuguaaucccagcacuucaggaggccgcggugggcagaucacuugaggccagaaguuugagaccagcccggccaacauguugaaaccccaucucuacuaaaaauacaaaaauuagccaggugugguggcacacgccagugguuccagcuacuggagaggcucaggcaugaggauugcuugaaccugggaggcagagguugcagcgagccaagaucaugccacugcacuccagccugagugacagcaagacugucucaaaaaagaaaaaauaauaacugauauaaaauauuaauaaaguugucucugcaggccaagcugucuaagcuacagccaaaauaauaauagaggaauguuuugaugguugacuuauuaaaugaggugauuaagaaaauggccauaacaaaccuaaagugaggggcauucuacaaaauaauucaacuaacaaugccaugaaagacaaagacugagcaauugcucgcgauuagaggaggcuacagaauaaugacaccugaagaaugcaacaaugauuuguaagguauuuuuuguuacaaauacaucauuaggacacuaauggguacggaauaaagccuguugauuagauaaucgcauugcugcaauguuaauuuccuaauuuugaugaugaaaaacgucuuuugagaagagaaugcccuugauuuuagaaaauaaaucugaagcauucagggguuaacugcaacuuacaaacguuucaggaaaaaggugugugcaagagaaaaaaauagagaaaaagagaaacggaaaaagaaagacaaggcauguaguaaaaugucagaauuuguagucacaguggcucacgucuguaaucccaccacuuugggaggcugaggcagguggauuacuugggcccaggagcucgggaccauccugggcaauaugaggaaacccugucucuauaaaaaaaaaauuuuuuuaauuagcugggugugguggcuaaagugggaggaucacuugagcccaagaaguugaggcugcaaugaucugugacugcaccacuacacuugccacuacacuucggccugggugacagagcaagacugucucaaaaaaaauugggggacucugggagaauauacaggaaaucuuuuacuauacuugcaacuucucugaaagacugaaauuaugucauaauagaaaauuagucugggcgcaguggcucaugcauguaaucccaacacuuugggaggcugaagcgggaggaucacuugaggccaggaguucaagaccagccuggccaauauggcgaaacccugucuccacuaaaaauucaaaaauuagucagccguaguagcacaugccuguaaucccagcuacuaaggaggcugaggcaagagaaucgcuugaaccuaggaggcagaagucgcagugagucgagaucaugccacugcacuccagccugggagacagagcaagacuccaucucaaaaaaaaaaaaaaaagaaaagaaaaugaaaaauaaaaaggaacaucauugcugcacaacaagucugaauuaaguuccuuuccauguuaagaaggaaaaguaaacugaauuauucuaguucauuuguuauucucaucuaaauaauaugguugauuaguacuggaaccgguuauuuggaagacacuugacuuacggguagcaaccaacccaacuucagaggugaucugauuauuucacaauuuauagaacaaucuacuuuuaggcagaugauauuaacagguauuaaaaguacaaguggacuuugagccaaguaucuauaaucagauggucuuaaaugugacacuggacuuauuagacuaauguucaauuauucccuuaugagacagcaugaaagaaugaaaauggaacacauuuuagucagauauuaaucuuaaaauguaaaagaacaacuuccuaugaagauuuucuucccauuuuaaaaaaguuuuuaugcaguaaaaaccaucaguuaguuaaaaacuuggcaagccauacaaauucauuuccugaagauucuauauauuuguuguuucuauacugccaauauguaaagucucauuacuauuuuacugagaaaguuaugauuuuuccauuaacuuugcaguuuuaaaagaucagcugcacaagugcacuuuuauuaggcuuagaggccaaauauuuuucuaacaggaaacaguucugacauuauaauggaagucaaugaaaaaaaaacaggacccacaaaucuagugaagcauuuugcucuauuaagggcagauguguaugugugacuaacacuuaaagaauucagaguaacuuuaaggggaauagaacagcacaaaauacauucaguaccuauacacccugccuguauauuuguuuuuccauuguuggguuuauauggauaucuauguuguugaagauucacaacuggagaaguuauaaagagaugccugaguugccaaggacgaaaaugcuuagaggccuauaaggguauaugauuuuucaggcugguuuugaauuuuguuucuaguaauuuuaauaauauggguaaaacaaaccacauguacagagacagagaaauagcucauggcacacacuguggaaggcuaaacuacugagaaaaauaaggagaugucagugugaugaagguggaagaguagggucugugaguuacaacuucccugagccucaaucuuacuucuaaagagaaaguauugccuuauucaaacccacacaaacaauguggaacuaguuucacuuaaaucuuaccuuuuggcugagcguggugauucacgccuuuaauccuagcacuuuggaaggccgaggcggguggaucacuugagguaaggaguucgagacuagccuggccaauauggugaaaccccguuucuacuaacaaaauacaaaaauuagccacgcaugguggcgugugccuguaaucccagcuacuugggagacugaggcaguagaauugcuugaacccaggagguagagguugcagugaacugagaucacaccaccguacucuagcccgagugacagagggagacuccaucucaaaaaaacaaaaaacaaaacaaaacaaaaacucaccuuuuguaauuccagcacuuugggagguuaagguggguagaucacuugagcucaggaguucaagaccagccugagcaacaugaugaaaccccaucuuuacuaaaaauacaaaaaucagccaggcauguuggcuggucccuguaauccuagcuguaccagaaucgcuugaacccaggagauggagguugcaguaagcugagaucgugccacugcacucuagccugggugacaaagcaagacuccgucucaaaaauaaauaaaauaaaucucaccuuuagaccgggcgcaguggcucaugcugguaaucccagcacuuugggaggcugaggcaggcagaucaccugaggucgggaguucaagaccagccugaccaacauggagaaaccccgucucuacuaaaaaaauacaaaauuagccaggcuugguggcgcauuccuguaaucccagcuacacaggaggcugaggcagcagaaucgcuugaacccgggaggcagagguugcagugagccgagaucgugccauugcacuccagccugggcaacaagagcaaaacuccgucuccaaaaaaaaaaaaaacaaaaacaaaaacaaaaaacucaccuuuaacaagcauauagaguagcaauagaauagaaagugcuauaaguaaguaaaaaaauggcauucauuuauucaacaagcauuuauugagaacuacuaaccagucacuacguuagggaaacaaguacaguaguccccccuuaucugugggggaugucuuccaagaucuccagcagaugccugaaaccgaggacaacacugaauuccauauauaaagggacuugccacauaaugaugcuuuggucagcaacaaaccacacauacuaugguggucccauaacauuauaacgaagcugaaaaauucugaucacuauugccugaugaccugguagccaucauaacagcguggugcaacucacuuuuucuacguugagacccguuuaaauacacaaacaccauugcguuaccauugccuacagccauucaguacagcaacgugcuguacaaguuuguacccuaggagcaacgguauacuguacagccuacauuugugguaggcuauaccacagguuuaaguauacucuaccguguugcuacaacaaugaaaccgccuaauggagcauuucucagaauguauucuugucauuaagggacgcauggcuacugguauucccuauauauguauaccuaugauaaaguuaauguaucaguucgguggaguaagagauuauugacaauaacuaauaauaaaauagaacgauuauaacaacguacuguaauaaaaguuaggugacucugcucucucucucucucaaaaccuuauuguacuguacucacuccuuuucuucuugugaugaugugaccacggaaagcgaaauacaggacaaguagggacuacuguaaagagauccuguccacgcccucaagggacuuacacucuagcucaagcagacaccauuuaauaccacgugauaagugcaaugccaaaggcauacuuggaacguuaagugggucccaggaaaggaauagcuaagcaaucuugggguaggagcuagcaucaggaaaggcaucuuggaaaagaugggccaaaacugucuuaagggaauuagcuggggguugauuuuaggaaaggggaauaacaggaacagaacgaaaccaagucgggacacugcauuuccugggaacgaagggcacccuuuccuuaucugucaaagauaagucagaagcauuaccauaggucacuucugagaucugggacaucaacugcccggagaguggcuggguggacaucccagggucuuuuuauuguuuucuguugcaucccagacccuacaaccccuuccugaaaggguaagucgcgcuucccuuaagaaaaaguuguuagcaggugucuccuuucucacaggggauaauuacaaggguucagccagaacaaaggccgcagauggaaggugggaagaagacuugggauaagguguguggaggagcccacaggcucugcccaaucccagggagugacgggacgucuuuccgauuaggggacgagaacuccccgauacaaacauagcaguggcaucgccccuccgcgccccccacgccaugacgaggggacgccgggggaaauccugcagccgugggagggacggaugugcugggggaccgagaggccgcgggaagaggcacucgcauccagaaggcauuuuagagcgagggucaggcgcagcggcggacugcgggucccggcuucggagcccgcuguccagcaggguccaggaggacguggcgcccacucaccgcugcugcuggugaaguagaacaccaugaucccgggagcggugcggugacuccaccgcggagcagcagcgcucaacucacgaagcucaggauaccagacucgcggcggccgccuggcccccggaacuccuccgugcacuu

SEQ ID NO: 192510 - RNA, 79464 nt, Homo sapiens
auaugaaucauuacuccuuacccaggcaguaauguucccgaaguuuucucuucguucuauguuucaugguaguuuaaccuuauuaacucuucugcaggcuuuuuguacacuuaagaaaacucuuuaacucuugguauuuacuuuuuuucugguaggucuugccugaauguaaggcuuuuacuguauuugacaggaaguuugugaacagauguuuaaugaccacagaacaugugccuuuaaauauuucguaccuggaaucuuuuuuuucuuucuaaugcaguaccaaguauuggggacuaaccucuuuccaaacuggugcucuuggugguaguuguaugugugggcagaacuaggcuguuaguaucaugccaaccauggauaccaucuuuguguuuacgagagucaacauaagcagaacucgguuuuaauugguauguuuucuuuuuccaggagcuggaggagggaaugauauucagugguguuuuucucaggugaaaggagcaguagaugaugauguagcagaagguaagaaagcguuuaaugcaaaauuuggauauauaauuuuugcagaaauguuuccuacuggaggauuuccuugaagccgagacugcuauaaauucaagaugauuuuguuguccaagaaauguaagaacaguuuuaaaagauaccuuucugaaaaacagccuuaaauuucauuuguuauuuacgccuuguuuuuauuauuuuuuccucugaauuuacauggaaggagcgguagaugaugagacauauaagauccucacaugaaagcucugagcuccauauaaggguuucuuuguuauguaaauuccacauacaaauaaauggugaugcauuuuuauguuuguacauugguuuuagauaaguaaauugaaauaggugccaucaacauuuggcucagaaacauucuuaacggcaucuuugauuuuuaugggaagauuuuuuaacuacuuuugaauuuguccacuuugggagugugaugcugcuuggcauauucugugaagagaugauagcucagauuauucauuuuguugucuuucugguauuuagguggauaagacaguaacaaugcuaugcauauaucgcuugucuuuuaggaaucguauauucuugugcagguagaaacuguguuugaucaguugaaguacuuacgucuaauuuucuccccaaauuuauuuucuaacguguuucagaaguuuaaguuuugaaacuucaagguuuugcauucauuugagauggucuuaggcagcggaggcauuuuccacaaaguuguugcauuguuucauuccugagaaauguugaaguuugaguuuuaaugguauugugugucuugaauuacaguaggaauuuuccaaacaaaacucagauaaauuuaaacauguacuugugaguuuuaaaaauuuggugaaaauucauaaaccuuuuuucccuagauuguguuguccucauauuucugaccugucuguaggguacuguuuguucuggagauuuuuuuucagguggugggugguagccgaacucucuuauuugcuugugucagugucauccuuaauugucuguuuuagaguguggugaauccuauggcaagccaacugguguagauuauacuugucauauuuugcagagcucucucacguuccuuuucuauuggauccucaucuguuucuuagaugagaaaccagaaacaaaagagacugacugauggucaugcacauaguguaaaucaagguuuucugaugaagucagugguguuugacuuguucagagaaguaaguccugacuucaagggaggaguuguguauuacucauguuguaacuacauuaccuguugaauaguaaacacuccaguauuggaucauuaguucugugcaguuguguaauacucaccaaguuaugaaagugcuguauacuuggaaaauguucuuugguugaauuccauuuauucccuuaggaaaguuccccuaaaugcugagcacugaggguacuuggugucuggaacauaaacucugcccacaaggagcucauaguuugcuuguuaaacauuacgcagaaagaucacauggcuuuuauuuaaucagaagaaauugauaguucaaagugaacaucauuuaccuaccugaaccaaauaacuugugauauacauuaaguccucccuuaauguauagguucugucaauaauguaaugucaauagguucugugacuuuaagcaaagaaagcaacuuauaacaaaaccauuuuuuauccauaccauaacaaaagaugcugagcagaaaacaaagucaaaguuuucaagaaccuauugacgugaaguuaggagauaaaucaguuauaguuccccuuugcugauacuuaguagcugcauuuuucuacugauugguuaaauaauuuucuuuagagguuguuaaauauuuuaacguaagcauauucuuagcaucguaaaaugcugauacuugguauauacauuuuaguaagauaacauaucuuaguaaaaauaugacuaguucuaauagguauugcuguacaaauguauuaaguauaaaaauaauccaguuuucaaaugacacugcuuuaauuuggauauuucugcauacuagaguuugcauauuauagucuugcuuauuugacuaaggggagauuugcuuuucugaaguaaaauaagguuauuaacacauuccccaccccccuaccuuuagacugaucucuucaacagguuacauguagcucaacuuuuacuugccuguuuucuguuaaugauacauuuugauugucuccauauugccugccuuucucccgucuacaugcagucagcugccagggcauaccauuuuuacucuguaaugccuuaaucuucuuugcauaccugcuuucaccucuauucagguuugcacucucccucauccagauugcaguaaguuccuaaauuauucccugcuucuucguccuguuuugcuucaaaguuaaucuuaaaugcagucccaguuuugucauuuuccucauaagucuacaaguggaucacuguauccacuggauuaggaauuaaguucaaacaucucagucuagaauguaugaccuuugcccaauauggccucugcucucaguuuauuugcugcuauggcuaaugacccagcuaaacagauacuguucuuaaaaggcguucuaugcucucucacuuuagggucuuuguuuuugcugcuuccaccuuggaaugccugacaaucaucccacaguucucuuaccaggauccugcucaucucucaagucacgccuuuaaccuuuuugcuaauuuccucuuuuggaaauaaccuauuuuuaaagucuuccuuuauagcacuuuguuacguagauaucauaugguaccccacaucucuacuguuacauacuacagaguuuaguguaggacugauuuaucuucguaccuuaugcaggcaugaagcugcucugucuagaacagugccuggcacacaguaguugaauauuuguuugaaugaaggaacguaaauguuauuguucuuagguuuugaaaggggaagagaaaugguaaaaggcaggaugauugagauguaguucuagcagucauggauuuauuuacuugguaggcuuuuuaaaauaaaaauuuaaaacgcuuucugcagaaucaucgguaggcuuuuuauaaccagauugauguuauacaaccguauaaugcaaagaaaucaggagaccuuggguuuuuacccuagcuccagcacaaacuaguguaugucacuggggauaaguacucuccuggguuccuguguguuuagcaauggaauaacaagaguggauuaggugauuucugcucuuccuuguacuuuaaucuuguuaauuuccaaaggcauguaaaaacagcccaaauucuuuuggugugugugugugugugagacagagucucacucuguuaggcuggagugcaguggcacgaucucgacucacugcauccucagccucccggguucaagugauucuccugccucagccucuugagaagcugggacuacaggugcaccccgccauguccggcucauuuuuguauuuuuauuagagaugguuuugccauguuggccaggcuuguuuugaacuccugaccucaagugauccaccugccucggccucccaaagugcugagauuacaggugugagccaccggccacaaaauuauuacuacugguaauuaauacuacugguaagcuagauuguuugagauaccguacucucuagaggccuuaaauaaaaaauaaauuauugcuaguaauauauuuuacauuuuuaauuuuucuuuuauugaaaacugucugucaugagacaguagguuaagagcacagacucaggugcuaggcuacaugguuugaaucuugcucagucauuuaucauuucuguggucaucucuuugugccuagcuccccucuauaaaaugaggauaacaauaaaaccugucuuacaguguuguuuugaugauuaaaugaguuuauacacauaaaacagaacaguacccagcagaaaagagccuuaugaggauuuagauauuauuacuugaaccuucauauuauuguuacuuugaaggaagagucuuuggaguaugaguauauugaggauuugucuuuaaagccuacuaaaaauuucucaaagugaaggaaauagcauauauguguguuauacauacucuuugauuccacuaguaaauuacaaaauacauucaaaauuaagcuauagguuuagaggcacauaugcagcugguaaaacuaugaagaaaagcuaugaaguaaaaggaaaaaaacauacuguaaaaaguacuauaaaagucaguauaguggcuacccuuaagcuguuggaaaggaguugugaucgggaagggcuggggaggcccuugugggcuaucuugacugggauggugguuguacagauguuuguaaagaguaaccuggacauuuuuguuucaauuuuugguuuucuuuaucuguuacauuuuacaguaagaaguuuuuggaaaucuaauaauguauuaaaggguuuaggaugaaaaauggcaguccccuaccuccccacuccuuaaucccuaguccaucuccuaagagcaguuguucaacucuuccgcuggguuccuuggugcuucauuuccuuuuugggaauaaaaugguauuucuauaucuugucaauuuuaguauuuccagcugacuugcuccucuaguagaugauaacuaagcuauucacauuaucacccccauuucuguccccauugugccccgauguuacaucacacacuaugauuaaauuggacgucagugcuuaaauuguuaugaccacgcacacauucucugcugaaccaguagugcucugcaguguuuauuucauccucaagguaauacaguaauugcuuguuuguuaauuugacuauuugguuuuuuaaaaaacguaaucaaucuggaacauuacagaaaguauguggaauaguauaaugaaccccugucacccggcguugucaauggccaguguugccccauguaugguuccaucacuggacccuuucccauccuuuuguuauuuaauaauguaauacuuguuuuuaaaaucugaauuuaacaaaauagaaagccaaguucauuucuuaaagucgaacaguaagaaauuuuuucuaaugauuuugauaauguguuuaaauuuuacuuguggaaauaaauuauuaaaaauucaaauacauguggauaaucugaaguguguaauaauuggucaaaauaauagaacaggccaggugcaguggcucacgccuguaaucccagcacuuugggaggccaggcgagaggaucucuugaauccaggagucugagaccagccuggacaacauagugagaccuuuucucuacaaaaauuaaaaauauuagcagggcauggcagugugcaacuguagucccagcuacuaaggaggcugagacuugagccugagaggucugcuacaguuaggcugugauugugccacuggucuccagccuggacaauagaguaagacucuguuucaaaaaaaaaaaaggaacaacuuaaccauucaagauaguuauuuuaauuauuuuaauguagauuuuucauuguuuaguaaucuuaaaauaucagauguuauuaaauauuuaauaaugaaccucaucugcauauuugauagucuuaaacuuucacaggaaauuauuuuaggauauuaucuuauaaagucuuauuuuaugaaacuuggauccaaguacauuguguguuuucaacucuuugcuuucuguuuacuuuugguaggauuuagccuuguggacugggucuugaaaaaauauuuuuuaaaugguagaggcuaaaauaugccccaaauaaggacauaaguaaaaauuugaaaaacaguccauauuaugauaucucacacaauuuaaugguuuuaguccauuccauauguuuaaugcuauaauguaaacaauuuaaaaucauuucucuucugcaucucuuuuuuuuuuuuuuguuagagacaaggucuugcuguguugcccaggccgucuucuguguuucuuagaguaguaugcauguuagauuuaggcaguaagguaaguuaguagaaaaaguagaacccuguuguuuuguggauuuaaaaauaguggcacauuagcuguauuccgaaaccuaaugaccuaugguaaaggucuuauuuaauauccuuaccuuguaugacaugugacacuucuuuuucuuaacacuagcauuacuacugaagucuaguagaccucacucaguacagucacuuaaaguaguaguguaaguuuacccauuaaauaccaugaaugauaguaucuguuuagcaucaaauaguuuucuugcuuuguuuuaaaauacuaaguuuuuucacauucauuugacaaaaaauuaugagagagaauggccauugaaaacauauugcugacauuuugucauguuauuaaaauaaaacaaaaauuagccuuagguguuucuuaguacucuguaauagugaacaaaauauuaaaaucaaguucuugaaaauuguggaauaagcagaaugaugagagguugaagcaaaaauguauuaaaucagugaagagguuacaguauguuacguauuugcauauaaguguuugccuaguuuaucuuaaaguugauuguaggaagaaagguacguuucuuaaugcuguuaaauaggaaaacugaaggauuggaaauagcuaaaaaauuuuaguuaauauccucaacuguaaucucguugcccuuuaaggugaugauggaauuuguaauuaaguaaucaaguauccauaaggugcuuccucagcagacagaaagaaaaguaaaagcuggcggggcgcgguggcucacgccuguaaucccagcacuuugggagacggaggcaggcagaucacgaggucaggaguuugagaccagccuggccaauauggugaaacacugucucuacuaaaaauacaaaaauuagccgggugugguggugcgcgccuguugucccagcuacucaggcugaggcagaagaauugcuugaaccugggagguggagguugcagugagccgagaucgugccacugcacuccagccugggcaacagagcaagacuccaucucaaaaaagaaaagaaaagaaaaagccuaggugcaaauuagauuuucuauaaauaaacugcuauauagucauuguaaggaaggcauggcauggccaucuugaguaccuacauuuuuugagugcuuaacuauguaucaggcauuguuuuagguccuuuacaucuauuuauuuacuguucuucacaaauacccugugaaauaaguagauacuggugggaaaguuaauuaacuguauaaucuugagcagguggugaagcugggauucuuaccuuagaccuuucacuuuuccuaauauaauuuuauuucaaaacuuaaucuccuuuuaguucaggugaaggcguuugauguugaacugcaacuccuguuuauaacaagguuuauuuguaaugccuaguagauacuuuuuauuuugaaguaauuaaauauaauuuggagauuuguugaauuuucagcuaaugccauucuuuuuuuuuuccuuuuucuuuuuuuuguuuuuuuuuuuugagacggggucuugcucugucauccuggcuggagugcaauggcgugaucauggcucacugcagccucaaccucccaggcucaagcgauccuccugccccagccuccugaguagcugggacuacaggcacaggccaccacgcccggcuaguuuuuaaaaauuuuuuuuuguagagacagaucucaccauguugcccaggcuggucugcugauggcguucguuagcugagaugugcuauauauagauggguuauaagggcuuugugaacccucugaugaugugugugaaauugugugugauuguacauaugugcauuucucuggucggaguccguagcugccaucaaaauugauaucauuuaguccagugguucucuaaaugucgucuggcaaccccugaacucauuccaaaugucugugaaguaaaaacuauuuucacaguaguacucaggugauacuugccuuuuucaauacauugacuuugcagcagugcugcagaagccaucuuagcaugagaucaagacaguagcacaaaagaguaccuguagagguaaucuucauuaccauguacuagcaguuuaaaaaaccaucaguuuuaagaauguccuugaagcagugaaaacuuaauuugauuaaauuucuacuugaacacaugucuauuaaacguucugcaugacagaauggaagguauaccuagagaaagaacuucugcaaggggguaaagugguugucuggaggaacagcauuggugcagcuguuuugaguuucaacugcaguuuucauggaacaucacuuuuauuugaaguaacugaugaacuauaguuauucagacuuggauauuugguggacauuuucucaaaagaacagugaaacugauacuucaguguacaguguuuguugcccaugaugaaauuugagcuuucaagcaaaaauuagaauuuuggaaaacacgucucugccauugugagcuugacagccucccaauacuuaaaauauuuuuucaaauaaaaucaguagucauauuaacgaaugugauuuuuugauacuauguaauguguuaacauuuggaagaucuguauaacucaguaaaucagucuuuuacgggugaccgaugcaugugauguuaaacagucauacaucaguaaaagugcgugcuagagcauugaauuuuaaugugacagacuaccgauauguuuugagauuccacaaaccuucaagaauccaccacuguggaauuuugguguaguaucaaagguauauccauaacuaccugaaacaccuauuaaaauauuccucccuuucuaacuacauaucugagugaggcuggauuuucuucauauauuuaacugacagaauauauuguggugcaguacauugaauacagaagcaauuaagagaaucuucauucuguuaggccagauuaaauuaaagagauuugcagcaguguaaagcaaugucauuaauuuuguugguggggagggggauguagucauuuuucauaacauuuuuguuaaugugugagguuuauuacuauuuuacaaugaagaaauauuuuaaaguuuaaaaggucuuugauggucuaagauuuuaagaguuaaggggauccugucauucagaaaauuugaguuguugguuuagucuguucauagauuucauuuuaguaauaaugcuuuacaagucucaugaaccacaagguaagugaucagaauaguguacugcuuuuguggaugaaugucuuaaaaaauugccuacgaaaguaguuucugugacuugaaauuguuucagucuccucccucccuguucuuuuagauaccaaauuagaucugccuuaagcuccuucagcuggugaucuuggugaaggaagaauaccuucaggacguuaaaguaucuauuuuuaaacuuaccucucccuuacagagauuaaauaccaguaacauauuugccagaauaaaauaauuuuuuacgguuuuccccacaaugucugcucagguccaacuaucaggaacacugaaauucucacagccuaauuuagugccacuccuagguugccugccucgucauuagaagugaguuggugaccuugacauuguguuuuauuuugagcccaacuuguagcaguuuggugauguguugucuguucuaggaaagaaggcauaaaauuggcuugcuaacuuucccaacuuaacuacugaagggaagagagagagggaacaauguuuuucugaaaauccugaagugaacaacauaauuauauuuuaaauaguuaaauuucccauucuaaggauguaguaucaacuauugcuuaauauuuucaguauuuuuguggcuguuuucuacucuugaaugccaaaguuuguagacuucagcaguuuucuguccagguuuaaacacugaauguaauuuaaaaaaaaacuccgcuaauuuuuaaaaaugaauaugaauguuuuuaguuaauuuuggcaguaguugauuacaauaucaucuagaucuuugcucuuggcauauguggaauccuuggcaagucguugaauacuucuauauaccacauugccgggaguuacgcucuuguagcuuuuaguuucuauugguuaaauccucucuguauguucaaauaccagauggaguuuucucuucuagaaucuucgaaugaucucucuuuuuccaguucacagggucuguggaccggugaucugguuuaagaacuucugcucuaaucuugaguuaugccuguguuuacacacuuacugaaacuucugugcuggauucuaaauuuggaagaaucaaggauauuugugugguaauaaugguguuuagacuauuuaggaggguauuuuuucuuaccgguccucuuauuacuuuuuccugagauaauaugggagggauuaaucaucuguaaaauaccagacuugacagauuuaguguguucccaucuuuuuuuuuuuuccuuuauuaaaaacugucucucauggguaaaaacauuagaaggauauauuggauuuugaaccaguugcuuauuuuauacuuuaaucagaaggaaauuuaaguuuuucaguagcuuguauuaagagagaaaucagaguagguaaaagggauugggggcaaaauuuuaaaaauuuucuaaagauccagaagaacaugguuagaucuggagcaguguuacuuuucaaaccugccauugcaggcucauuguaggucugucugcucuguaugaaaguagaaauaguaccuuuuugguguuacccugcgugucuguuuuuuccugcuuaccacaagguaagauucuuaaggguggaugacuuucuaagggaacaaaagaggaaucuuuccuuuuggcuaauagagugggaaggcucuaauucaagagaaacaggcuauuguaggcaauaaauaguucugaccaaauuucuuaucaaggcaugcaacaugcaaaaauguuuguuaaaggaauugguaguagcaaaggcauugcuuguucugucuuucuucuccuugacauaaaaugagcauuauuuuuuuuucuagcaacagaaccaauuuuuaaugaaaauuuuuagcuaccuaauguuuuuaugcauauuauagaaaacauauaacauuaaauuuaccaucuuaaccauuuucaaauacacuguucaguaguguuaacucuauucauauugugaaacagauccucagaacuuuuucgucuugcaaaacugaaacucuauacccguuaaauaacucccuucuuccccuccccucagcucuuggcagcuaccauucuacuuucuguuucuguaaauuugacugcuuuagauuccuccuccaaguggaaucauacagucuuuuugugacuggcuuauuucauaaugucuucaggguucaucccuguuguaguaugugacaggauuuccuuccuuuuuaaggcugaauaauagaccauuguguguauauaucccuuuuguuuauucauucauucuuugaugggcauuuugguugcuuucauguuuuaacucucgagcuccuagucuuuuuauauauaugggguucggugggaaggaaccagguagguacuuucuguaauuaauuugaguagucuagguagaacaugaaagugucaguuuaaaggauuuagagauugguguaguuuuauuuuuaaaacuccuguuugauugagucuacaucucugauuuuuauggggagggggcagagcuaaggugagacacagccacaagucaacagguaucuguugaguucccagcacuguggagaaugugaaggagauagaagacauuauuccuucauuuuagguacauggagguccauuuuauugaaauaaacauuucccauagcacuuggcauuugguauuacacccuacguaugguacugugaaaaccuucucuaaugccauguaaaaauuuuacagaugauacuagagucugaguaguaaauuacuuucccuuuucuaaguugauuuuaugcugcuugauauugagauggggauguaguacaaauauuuacuuguuucuuggaguuaaauuuuaaaaaaucccauauugcaggucuaagaccauaaauuugucuuuuacugcuuucaaauggucgugaguuggaauuuuccaauuaguauuuuuagagacuucucuaggugaauguuuaugguagccuacaagcuaccauacagaauuacaaaaauuagcugggcaugguggcacgugccuguaaucccagccacucaggaggcugagacaggagaaucgcuugaacccaggaguuagagguugcagugagccgagaucgugucacugccuuccagccugggugacagagcaagacuccaucucaaaaaaaaaaaugaguuucuagacuggacguggugacucacaucuguaaucccagcacuuugggaggccaagguggguggauugcuugaggucagguguucgagaccagccuggccaacauggugaaacaccgucucuacuaaaaguacaaaaauuagcugggcuugguggcgcuugccuguaaucccagcugcucagaaggcugaggcacgagaaauacuugaacccaggaggcaaauguugcagugagcaaagaucgcgccacuguacugcagccugggugacagagcgagacucugucugaaaaaaaaaaaaaaaaaaaguuuucuagagccaauaaacugcauuuacaaaagaaaaacauuuuacagcacuguacuucugagucauacacagacuacauuuacaucuaacuuuucccacuguauuaaucaaaucuaguuuguacgucuguuuuacaaaccaaauauagguaaagauuuuuauguuuuaguaacuagguuaaaaaaaucuaauaaagguugggcuuuauuagaugaugcaugccuguagucccagcuacucaagaggccaaggcaggaggauugcuugagcccaggaguucgagguugcaguaagccaugaucgugccacuacacaccagcuugggugacagaaaaaauuaauacauauauagaaugguaaaucaagaggaauacagcaaauguaugcuucucucuucuuucucccaguuucuucguccucucaccagagaugccaucacagguuucuuauauaucauuccagaaguauuuuauuuuguauuugcaauguuuuuaacagcgcaucuuuaucauuuuggacuugaaaguaggaaaauguauucuaggaauccaugaauuauuaagcaaggucuauaggcccugccuuaaagaggaucugaugaguugccugagaaauuagcauuuucuuuuaaccaguagauuaaaaccauacagauuucuauauggagaguugcugagaagguuguacacauuuggaauuuacaucuagauguguaauuaguggacucuaaacaaagcuaaguaaaaucuauaauaucuaagauauacaagucuuuaaaaauaacaguuuggguucacagauacuggagucuucggauuguagaccuuaagucuucuuucuccacuugaaucugauuguuccuggcaguguguaaagugaucgguucauuuuggugauuuauuuaauuaagacuguacuacacauuauagaauaggcuagauccuaaagacauaauguguguucuuaaguguucaguaaacacguaggccuuuuuggucacuuguccaccaugucuaauucucgaccuaauuucuugggaguuuuguuaauauuccuuaaaaugccaaaaugucauaauuuguauacugcucagguugauuggaauaaagcuuuguuaaauucuugcuaugcagaauucuuuuaaucuuuaagaauuuuuguuuguuaaaggaaaaacaacuuugauuauaaaugucugagaaauuuaaaaaauaagugcucaagagacugagcugucuauaagugcuuuauaugcauuaucucguuuaauccucucacucugaggauaaauuauuacuuucauuuuauagaugaggaaaucaaggcuuagauaaaguaacuugcucaaagucacguaguuggaaaaugggggagugagggguugaaccuuguugguucuucugacuucacagcccauguacuauauguaaaugaaaaaauaaaaucaaauauaggcauacgucagaaauauugcugcuuugguuccagaucacuguaauaaagcaaauauugcaauaaggugagucacaaauuuuugguuucccagagcauauaaaaguuauguuuacauuaugcaguagucuguuaaguguauaauagcguuaaugucugaaacaacaguguacaugacaauuaaaaaguacauuauugcuaaaaaauguuaauagucugagccuucggcaaguuuacauuuuuugccaguagaggaucuuaucuugauguugauggcuguugacugaucagugugguguuugccgaagguuggagugacuguggcacuucuuaaaaagugccaaaugaaauuugcugcaucaguugacucuuucaugaaagauuucucuguagcaugcaaugcucuuuaauagcauuuuauccacaguagaacuucuuucaaaauuggagacaauucuuuaacccuacugcugcuuuaucaacuaaguuuauauaauauucuaaauuuuguuuguuucauuucaacaauguucacagugucaucaccagcaguagauuccaucucaagaaaccauuuucuuuaaaaagaaacugcucaucuauugaugguaucaugaaauuggaccaauacaucuuuaggcuccacuucuaauucuaguucucucgcuauuuccacuacuucugcaguuacuuccuacauggaagucuugagccccucggaguuauccgugaguacuggaaucagcuccuuucagacucuugucaauguugauauuuugacauccucccaugaaucauggauguucuuaauggcaucuagaauguugaauucuuuccaggagguuuucaguugacuuugcccagaucuuuaagcggaaucacugucuaugucaguuacagccuuacaaaauauauauauauauauacuuuuuuugagauagggucucuguugcccaggcugcagugcaguggugugaucauggcucacugcagccuugacuuccugggcucaggugauucuccugccucagccuuccaagugguuggggcuucaggugugcgccacuacaccuggcucauauuucuacuuuuuguagaguugggguuucaauguguuguccaggcugggcuugagcucaugggcucaaaugauccacucaccuuggccucccaaagugcugggauuacaggagugagccaccaugcgcagccuauauuucuuuaauaaugcuaacaauugucuuguaagucagaaucacgccuugauccaugggcuacagaaugaauauuguguuagcaggcauguaaacaacaucuccuugucccucucuaucagaguucuuggaugagcagcaauauuuggaaaugagucuuuuuucuaagcaguaggucucaacagugggcuuaaaauguuuaguaaacagugcuauaaacagaugugcucucagcuaggcuuuuuucuagaguacaggcagaguagauuugggcccuagaauucagaauggucaaugagcauuggccucaacuuaaagucacccagcugcauuagccccuaacaaaagagccuguucuuugaagcuuugaagccaggcaucagcuucuccuuuccagcuaugagaguccuaggugguaucuucuuugaauacagggcuguuaauacagagcuguuuaguugacuuugaaaaucuguuguuuaguguagucaccuuuaucaauuaaauuaucuuccuuucacuugaacacuuaagaggcccauaggguaauuguccuaauuucaguauugugucuccaggaggcccaaggagggagagagagaggggaacugccaguagguggagcagucagaacacgcagcauuuuuaagaauuacauuugcugucuuauggaggugcuucauggcauuccaaaacaauuacaauaguaauaucaaagaucauuggucacagaugaccauaacagguauaaugauggaaaaauugaaguuuugcaagaauuaccaaagugugacacagagacacaaagcuagcacauguuggaaaaauggugccauucggccaggcgugguggcucaccccuguaauccuagcacuuugggaggcugaggcgggcggaucacgaggucaagauaucuagaccaucuuggccaacaugaugaaaucccgccucuacuaaaaauacaaaaauuagcugggugugguggcguacgccuguagucccagcuacucgggaggcugaggcaggagaaucauuugaacccgggaggcggagguugcagugagccgagaucacaccacugcacuacagccugggcgacugagcaagacucccucucaaaaaaaaaaaaaaaaaaacacagugucuaugaagcacaauaaaaguaugccuguauaaucucgcaauuuuuauauuauaucuguuaauauuugggcauagaucuuuccagcauauaguucuuuuuccacagcaaauauguauuuucaaaacuguuaucagacguacaguuuuguauuauguuuuuuuccaguuaacauauaugagaagauaaauggcuguaugauauuuaauuggaucucuaauguauuucauuuagacauuuagauuguuuauaauguuugcuauuguaaagaucaugaugaacauccuugugagaaucuuauugcuuuaggauauauuaucuggaaaugggauugcugggucgaaaggugugauuuuuuuuuuccuuuuuuuuuuuuuaauggcuuaugguauuuauugccaaaucaccauagaaaguugguguugauuuuucacuuccuccaauagugaaugggaguggccauuuccugaccucuugacaauaccuggcacaauauucaccauucagaaaaaucuuuuccaguuauuuguuugagcacguucaaauguuggagccuuuuuguguucuuugucuaguuuucuuuggugaugcuuuuuuaaauuuauuuguaguaucacagcccuuuuccccuucugaaucauacauuguaguggaggaauguuggagggaagcucaaagaaauaauuugggucuguauuacaugggaaagacuuccuaaaugaaguggauuuuuuuccuuuuucuuuuuucuuuuuuguucaagcaaaggaaaccagagaguaaggaaacaaacauuugagaauugcuguguuuuaguuuucuuaucuguaaaugggaauaauaguacuugucuuuuuauuuagaggauuaaauauacaugaaugcuuaguuuuggcacauaguaagccucagaacauuuaauugauguaguuauuuuucuaucugauacccaauuaacagaauuaacaguugauagcagaagaauaaaagccuauuccgguccacaaauugagaucaacuaguuuuugagguuuugggcacauuuuaggcacuuccaauaaauauacguuacauuaaugacuaacauuucagcuugguugaguuaggcauuugguaaaacuagggagagauuaguuucccagcuucaucagaauugggauuaguuuagggucuggcacuuugacuauuaauuugacuaauuuaaaauuauugugcugagccgggcacgguggugcaagcauguaaucccaguuaauugggaggcugaggugagaggagcacuugaagccacgaguucaaagcuguugugcacagugaucaugccugugaacaaccacugcacuccagucugggcaacguagcaugacccugucucugaaacaaugaacgaaaaauaaugugugacaacagaaauucaagcuucuuuuuuucucucuuguuuucccuuuuuucuccaguuccuccaguguuuuauucuucccuauaauuauauauucugcaucuucccucaagaguaauauaauugggugggguggggugcaccuagaacaugcaggaggguccaaagcacccuucacuauuggugucaguuucucauagcagggagggauggaguuugggaacaucugaagggauggugucaggcacacggaggcucuaaaacacccugcuauuggcuccccuugcuaccuagggcaacguuguaaauagcauauuuuuuacauuauaaauauuuucucuuucuccucguucuucuacucacuuguuuguaugaugaucugaaucuuuuaucagaguuucaaguaggcugacaaauauauuuagagcccuuggaaaauucuccagaagucugaagagaauagaaauggaaagcaaauguuauuauaccagugaacaugcuuaauuccccucaauuccuuauucagaagugugcuguuuuguuaaaagaguuguauuggccugauaaucaacacuucucuagcuuuaugugcaugugaauguccugggaaucugguuaaaauacagaugaugauggugcauuuaggucuugugggggauccugugauuuuugcauuucugaucagcucccagugaugcugguguugcugcuggugguccccagacuauacuuugaguggcaaggcagcuuauagccucucuuuaaggguaagggagaccuaguagcuuaauuuuuuuacucagcauuuuugacagaauaaauagaucuauugugcuguucucacaucaguuaacauuucuucuguaaaugaauaaaauaccucuuugggaguuuugcacuagcucuuaaaagagcagauugcaucauacugcaacacguuagccaucucuaguuguuacuuuaaauuuguauuucaauuucaaguuuggcucggucuaagaccuuacuauacuuagcaaagguguguuuuuugcugguaauuugcccuuaaauuuuuaucuuugccauuuuucuguuugcuuccuuacccuugaggcaccuguucaucucagaucagggccucccuuaccagcuaucuaaguuuaauguuguuuuagauugauuuuuauuuuauccauguagcucauguauauaguuuuuaaauaaaaguccauauuucaaaauacuuacaaggcaaaugaacaguuuucuguuucucucaccuguccucaucuugauccacuuucccaaacucuuuuagcuauuucuucugguguuuauuuucauauuucuuuuuuuucuuuuuuuuuuuuugagaugaaaucuuguucugucgcccaggcuggaguggcaccaucuuggcucacugcagccuccaccucuuggauucaagugauucuccugccucagccucccaaguagcuaggacuacagaugcgcgccaccaugccuggcuaauuuuuuguauuuuuaguagagacaugguuucacuauguuggccaggcugaucucaaaccccugaccucaggugguuugccugccuuggccucccaaagugcugggauuacagggaugagccaccgugccuggccuauuuucauauuucuaaacuacaugcucauacagcuguuuuuaaaagcaauccacagauggaaaugguagcuaagaacugagguccgcuaggcucuuccuacugcuccucccagcuuucuugguguuguuacacuguguugauuguuuaagccaguguucacaguuguaguagacuggauaaugguccccgaaagaaaucugcguccuaaucucuggaaccugugacuguuaccuuauauggcaaaaggacuugcagaugugaguaaaucaaggauuuuugagauagggagaucauccuagguuauccugguaggcuguaaauauguaagcacaaggaugcuauaaaagggaggcaagaaaaucaaaggaggaagcaagagauaggagugauugcaaggaaagggucacaagccaagaaaugcagguggccuccagaagcgaggaaaggcaagaaaauggauucuccccuuaaagcuucuagaaggaaccagcccagcugacaacuucaccuuagcccagugaaacuguuuuuugacuuuaacuguaagagaaaaaaauuaaugguguuuuaagccaccgaauuugcaguaauuuguuacagcagccauaggaaacucacgcaggaguggacauuguacauacgggcuguauaauaaauucugauuuuuuucuauuauuguuuucuuuagaguuaaaaauuaccuuauucauuuggcuuuuaaucucccaucacuguuuucuuucugcaccuucaaaagccuucuaauguaauuuuccacaugaucaagaagaaucaguuuauguucuuccuggaguucuccaucauguuucagucuggaguacuucguuucguuuucugugaaucugucacuaaaucaucuucaaauccucugcagagacugaauccccuccuaguauauugaagcacaucagauguuguaucaguuuuacuuuugccuuaagcucuaucccuccaacccgcgugcuucaaucugggcaguuucuaagccuggugcacagcuguuguccugggauuuuccuucaucauuaucauugugaucaucaucaucgugggaauucuuuugccucugcuguguuggagcuccuuguucuuggaucucacaucuuuuucuuucuuguuuuaugcuauuauuuugggauggugcacaguauccagugcuuuaugggaaagguuucauaggagguaaaauuuuugagaucuugccugccuggaagagaugucuuuauucuacuuccacacuuucaaguuuggcugguuaacauuuuccguuagaauuugggagguguuucuuuugucuguuagcuuccgguguuacauuugagaacacuaaugccauucuguuuacugauuuuuccuuucuggaugaugugcuuuggugugggucuuuuucauuaauuggacucguacucauuggacccuugcagcuuguagauucauuuccuucuguuuuuuccuucucuguuucauuuguucuuucuggaacuuaucuggaucuuggacuuuuuguacugguccucuuuuuuuuucccuucccccccccccccccaacuauuuuccauuuccuuuuugcuuuacauucugggggaguuccucaguuuuguucucaacucuuucauuuauuuuuaccauugcauuuuuaagagcucuuuugcucuuuggaaauaauguugguggugguaguuuuaagcagccccgguuuuauaaauggaguaucuugucuuugagaagauuaauaguuuuuuggguuucuuuucauuuucuaaucugagcaucuauuuccuuugaguuucuuuuuucuuauucauauugguagacugguaucugggaauccuugguugucuguuaguucuuaagaaugagguaguaagaguaaauuaggagcuuuguguccacuggcagagauauucggcuggugggcuucacuguagggugaugagccagggacccgcagucaguaucucuagaugagaaggaacuucuagugucuuaucucagugggagguggguaagugggaugggucacaucuuaagccuggcugcugacauucugggagccaggaagaucaccgagcaacucauggauuacuaugcagccuuucauuuaaucuuguuuuuaauuugacgccucaccaccagcuuccucucaaauugauaccuucucaaggucagguucaguuucuccagaagguaaauguguucucuauuuuagagucuagcuucucugugucuugcauagauguuucaaccaauagcuguuuugagucucaugcuucacugcagcccugcaagguaccuggugcuucuguguccugacuugacaaccccuuuugcaugcucagagguuucacuuuauuuugcugaguuuucuauuuuucagcacauugguuguuaccuuccuucugcuguugccuugcguuuucuuuguucuuauuuuagacuguuuuuauuaguuuaccgucauuuuaguggguuuagaagauaaaugcguguuuuacaucuacauguuuaacaaguguaucaaaauguuuauaguuucuuuucauucaugucuagaacacuugguaaucacuuucuaugcaauagaaaaggggaauucacagaauuuauauaaaaguagauuuguuuucuuaaaucuaaauucugauauuguguacuucuuuuuuugagguggagucucacuguuguugcccaggcuggaguacaacggugcgaccucggcucacugcagccuccgccuccuggguuaaagcaguucuccugccucagccucccgaguagcugggacuacagacaccugccaccacgcccggcuaauuucuuuuguauuucuaguagagaugggguuucaccauguuggccaagguguucucgaacuugugagcucaggugauccaccugccucagccucccaaagcgcuggaauuauaggccugaaccaccaugcccagcuuguguacuguuuuuaauggccuuuucuuucuucaauuaauagcaaaaaaaugauacaaauuaaaauagcuuuugucuaagauacuaaccugcauuuuuagaccuaaauuucaggcaugaagcagucagccaaaagccgugagguuuuaaagaacuuaauauaucagagaaaacuucagcuuucuuagauaaaaaucaguuuauauuuuuuuacuccugaaauaauuuaaauuaacacauauauuugucuuagaaugaagacauuugucaaagaccuuuugggcugcuguuaacagaauaguacagacuggguggcuuacaaacaaacaacagacauuuauuucucacaguucugaaggcugggaaguccuagaucaaggcaacugcagaucuggugaggaccuacuuucugguucagagacaacugugucuugacaugauagaagggacaagggcuuucucuuaggucucuuuuauagggacacacuaaucgcauucaugagggcuccacccuuauuaccggaucaccugccaaagaccucccuuccaaauacaucauauuagguuucaacaugugaauuuugugggggaugaacauuuaguccauagcaacauaaaguagaacauaagauuauagucaguuacugauugcagggcaacuaaaauaccaguuuuccauugggaagaugauuugucuugaaacuaagacaaaggauuaagagaguaauggcuuucuuuguuuuccaucaggaauacucgccuguuacuaguaguacaacauuuguaucguagguuuaguacugugcucccucugccuaccccagaggucauuccugucauucuccccuugcucacuaguagguccagccacaggagcuuucuugagggcuuugaacuugccccuuuuauucugaaauagaccuuccuucauaaucuugacuacccuguguaaauuaacucauuuccauuccaaccccaaaagagauguacauuuaauguuaucuguuuuuaaaauaucuuuacuauuauuugaaaugauguuacuuauuguuugcuugcuuauuguauguaggcuucuuucucuccaguuugugaguuucacguaugaggaaauccugauuuuuuuguucugugauuuucauucuuagcaucuguaacauuuuuaggcacaggacaguaucuggcauuuagugggcauuuguugaauggauagauaaauucugcaauaugucaucucauuuuaaaauauaugauaacuucaguuguuuauuuuacuaaauguacacuuuguuguuuaaaauagggaaaugaaauaagcuaaaaauuaguagcacuucccaguuuuuugaaccaguaaaaggagacccagacaaauccccacagucacacaagcuaguauauguauuauugaccaaacuacuuuaaagacccacauacacagugguucaaaaaauuagcuuguuucucucucacgugaccauugguggcagagagggaucugaaguggauaagcugguuuugccagagauuacccaggauugcagguuuguucugcucagggucuagguguauugcucuugugugcacggucagaucuggcucaaaucuguguucuaucuagcccaugggggagaaaagagagagaagggcaaguagcuaccuuuuaaugaugugacagaaauuuuauucauaaccuauuguuuagaacuugguauuagagaaacaugcagccucuaauuuccuguuaaaacucuguguguaugugguuuuuuggguucugagagugaaggugccaggaugugccauuacuaaaggagaaagggggaaauggccacucuuagggacgauuagucucugcuacagcuacuaauucuuagaacuuuuacucaggacuuuguucauuccucuuuccuuccuccuuccaguguuacuguaaaagccuuauaggauccuaauucaaauaguuuaauauuuuuuaugacaugaaacaauuggaaauuugaacaguuacuggauauuucauacuaaggaagugcuuuugauuuuuucaagguacgguaaugguguuugauuauauugaaaaugguggucuuuuauaaaucuuuccugaaauauuuaugggugaaauaauuugaugucugggauguacaugaaauaauguggcauggguuuauagaugaaacaagauugucuaugaauguauaauuguggaagcucugugauagguacacaggaauucauaugaugcucuucugccuacuuuuguauaugauugaaauacucuguagugaaacuuuuaaaauaccaguuuauacugauaccuccaauuuaaauugauaccgcaggguuauuccuuacuucccucauucuauauuuaugucuuuuggcucucacagugagaaccuuaguucccagcccuguaacuauuuuuugucagaauauaaagauagacagaaccuggauauuugauaacauuaagccaaugaauuaacuagcccuggguuuacuugccaugccuugggacuuuuuaugugggaugacaaucuuuuuauugugguaaaauacacauaagguuuaccauuuuaaaguguauaguucagugucauuaagugcauacaaaucuguugugcagccaucgccaccauccauauccaggacucuuuucaucuucccaaacuaaaacuuuauacccauuaaaacauuaacuccucauuccugucuccccagcaccuagcaacccccauucuacuuugugucucuaugaauuugacuccuagauguuucauauugguggaauccuacaguauuugucuuuugugacuguuauagcguaugucagaauuuucuuucuuaaggcugcauaaucuuauguauguaccacauuuuguuuguucacucaucucuugauggacauuuggauugcuuucaccuuuuggcuauuucaauaguguugcuaugaacacugaucuucaaguaucuguucaagucccugcuuugaauuauuuuugguauauaccuaagaagugcagcuaguguaucauauaguaauucuguguuuaacuuuuuaggaacaaucauacuguuuuccauaguggcagcaccauuuuacauuuucaccagcaauacgcaaggguuuuaauuucucauuaacacuuucuacuuuuuuuauaagaauuuuauacuucuaggucuuuagcccuuugauccacuuugagcuaauuuuuaguaugauguaaagcaaggguccauuuuuuuuucuuuuguguguggauauccaguuuuccuaacucucauguuuugaaaagacuguacuuuuccccauucguuggucuuggcagccuuguccaaaaucauuugaccauaugugcagggguuuacuucugagcucucuauuccauugauagaacccauuaggguggauuuuuuuuuauuuauacaaaaagugcuuuagggauuuuguuaggaauuaaaucuuccaauccaugaacauggaaugucuuuucauuuauuuaugucuuuaauuuauuuuagcaguguuuuguaguuuucaguguaaaagucuuuugucuccuuggaugaauuuauuccuuaguauuuuauucauuuugaugcuacugugaauggaauuguucucuuaaguuccuuuuuggguuguucauugguaguguguagaaacaacugauuuuugugugauuuuguguccuguaucuuugccaagguaagugauuuuauucccuaagugccgugcuaaaauguuuguaaaucaccuuucuuucaacaccucaccuggaaaucuggugagaucagguuugacccuuaggcacugugccuuacaugugcuguacaggauagcuaccuguguugguuauauccuguacagccauaugugguagacguuaugugggugucaacucucuuguucucuugaguauucaucagcagaagacgaaaaagcagaauccugguuauuuggcaaacucuacauguuguacuccaaggugucagaucagcaaauacguugcugccugauucaguuuugguugauucuuccccuccgauaucauuaauauucucaggagauagagugaauaagcuauugggagaggguaaaagagauacaugauguagggaacguuuuuuuaauuguuaaaccagaaguggguauuuugguuugugaguuaaaauacugcugguauucuaacuuacgauuagucuuuaaguauuauguauauuccacagugccaggugcccacugcugggcaugcaguuguagguacuucuuuauaacucuggcuaguuuauccugucugugcaauuaguucauacugcugagcagcugugucucccugccuuuuacaauuguagguauauuguuaguguugcugugcucacuaaguuuugugauguuuuaaacggaaccaaguuuggugguauuauuauuauuuuuuuaaaagaaagcaguuacuuaaauuaacaugguagaaaauauccuggggauugaugguguagauuaaaaaucuuuguuuuauccaacaauagaauugaauuauauggcuaggaacaccagcaagcacuuccugucacaguuaucgaaacagucuuuuaaagaaugucuagagggccuuacuuaaacaaauagcuugucuugacuuugggaggaggaugguuaccuaagcccauguguuaaaacagacagaugacacacugaaaugaccaacgagcauaauaaggagaauucaguauccuuggaaacccuggaacggugccauaacuaaacuaaaaaaauuuuagcaggaaacaguacaaacaagaaacaucgugagagaaggccuuaguguucauuucugugguugugaagcgcuaguaggaguaagugacaggaccuacuuugaauagccagaguuagaauugaagggggagccacuggacaauugguucauguauucuguacuuugaaacugggauugaaaacuaaauggcucuuaccaagagaaaugugaccagagaaaugugaccugagagagaagcacaaaguugaaacucugcccccaggcugccuucuuugucaggcagccgcuuaagguggccccagugaucccuggcuucugguauuuaugucucuguguaaccuugucccuuugaguguuucuggaccucucgugacuugcuuccacaaguggggcaagaugcugggaugcugcuucagagguuagguuacagaaagguuuuggcauccauguugggcugcccuauuucacuugcugagggaagccagcuaccauguuugugugguucccuguggagcucacaugucaaggaucuguugucucuggccaacagcuggcgaccugacaccugucagcagccaggcgcacgagcuuggaaguagaucuccuccuccagucaggcuuucggauaccugcaacuuugugagagaccuugaacgcaaggcccccuggcuaagucacaccuagauuccugaccuguuaugagauaauaaguguuuguuguuuuaagcugcuaccuuugggacaauuuuuaaggcagcaauagagaacuuauauaggaaguaacaaugucaacauuuccccuccucggucuaagauuugaacuugguucuaauguguuuucugguugaacccaacacaguacccaauauuacauaaacacaggcccuuuucuuuaaagauacauacagagaaugauagacacauccagauucaguagguacuguaaaagaaguugaccaguaugagcaguaacuuccuaugaaauagacuuagugcaggaaacaagagaaacuguugaaguuuaaagagcagcuaauuaguugcucugggagacugaugagaauuugaaagaaucagagagcaggaaggaguucuuaagugaaauuugugacucucuggagucaaguagcagcaggguuuuagaaauauucccucaauacaaugggaaaaagaaguugaaaauuguaacaaaaauauaaggaacauagcauuuguuuucguugauuuucucaguugcauugugcacguuucaggugcucaguagcugugugugacuaguggcuacuguacuagacagugcagaauagaacauuucuaucguaggaaguuuugauggacagugcugugguagagugucuuccagagaacucugaggaaaaaacuaugauaaacuaagaauccuaaauugaugaaguuauccuuuacauaggcagugcaacaagauggcuuuuuauaggugugcaggaacucaaaguauaucacucgacuacuugggaaaaaaaaaaagacuuaacuacacccagcugaguaguuagcaucucagaagcaugauaagucaacuucagcauuguuuaacucuguauccuguuucccagaacaacccaaaacuuacauauaaaaguaggggaaaaucuucaucuuugacagcuauuaagaggaugcccuucuuaagccaaacuucagaccgucagaacggugguuucaacuuaguucaauuccagagcuuccccucuccuuuugacgauaaauaaagccacaggaagcagcaguuuuuaaagacauuaauccauugaaaccacuuuugcugaaaucacuaaaaagucuccaagucaccaaaaccaaguuucauucucagcccucucuugaucuuuaaguaccuuuggaugcaauucaucacugccuccuuuuaaaaacacggucuuugccuagcuuccagaaaacuucuuccuacucacuagaaguuccugugcagucuccuuuuuuaccuggucuccaggcuuaauccuuagcccagaccucuggcuuucuuuaucuauacuuauucacuaggaaaucacauuuaagugucaugugacuuuaaauguuuucucugagcugaugauacccuaauuauaucuccuuuucccuaaucugcugucagaucaaucuagcugacuauguagaaaacacacacacaguuucuugcacaacacuucugauaacauauauucaucuguaaguuuuucucuguacaucaagcaagcaaucaguuuugcagcagacaccagcuggguguccccccauucaguuccaacacugucuaccuggaaauagcaucauauuccccagguugagggggcucggucccacaagacugcccccacuuuuuccaaugccaguuggaagccccagguuguuuaccugugccucugaccaaguggccauacauagagguuaccaagaccuccuucuuggguucgauuaauuugcuagaguggcucacagaacucagggcaaacauuuaccacuuuauuaugaagggcauuuuaaaggauacaaaugaacagcuacaugaagagauauguaggacaaggucuggaaggguccugaaugcaggagcuucuauccccguggaguuggagugcgccaccuacgcagcuccuggauguguucuaguuuaccuuccuggaagcccuccaaacuccguggaggcuucauuaugauuaagucauuggccguuugugaucugcucagucuucagccccacucccuuccacuucucuguggcuaccaccugaguucugacuccucuacucucuuaggcuacugcaguaacauaggaaccauuucuuccuuccuccaguuuucauuguuuucacacaacagauuuagaaccucuccagugucuuaucacauguuaggacaaguccacugcccuuuuaccguggccuacaaggccauugccaccauuugucuuacagagucuacauuaaucucacuggcuuucuuguuugcaucaaguuugccagccucuuuucucauuaggccuggcauucuggaaugcuuuccuucaacaaguuuggauggcucauuccuaugucuucauuuugguuucugccuaagucaccaccucagagaggcuuucuuugaccacccuaccugaaauaguauuccccacuccaugacuuuuuauuguuuuagggcuuuauauuuuuagagcacugagcacugccugauacauuuuauauuauuaauuuguuuauaguauguguuuaucacaagaauguaagauccaugagagcagggauuuuuguuugucuuacucuuguaccuagaaauagugucuaauacagcuuccacgugguguugagccugugggugcacagaagucaagaacugagguuugggaaccucugccuaguuuucagacguguggaaaugccuggaugcccagacagaagucugcugcaggggcagggcccucauggagaaccucugcuaggacagugcggaagggaaauguggggucggagcccccacacagagucccuacuggggcauugccucgccaagcugugagaagagggcuaccauccuccagacuacagaaugguagauccaccgacagcuugcaccaugccccgggaaaagcugcagacaauccacaccagccugugaaagcagccagcagggaggcuguacccugcaaagccacaggagcagagcugcccaagaccaugggaaccuacgucuugcaucagcaugaccuggaugugagaccuggagccaaaggagaucauuucggagcuuuaaaauuugacuggccugcuggauuucggacuugcauggacccuauacccucuuuguuuuggccaauuuauccuauuuggaauggcuauauuuacucaauaucuguacccccacuguaucuagggugccuugucucagaugcaacuuuguacuguggacuuuugaguuaaugcugaaaugaguuaagacguugggggacuguugggaaggcaugauugguuuuaaaaugugaggacaugagauuuggagggguuggggcagaaugauaaaugguuuugcuguguccccauucaaaucucaacuugaauuguaucucccagaauucccacauguuguuguggguggacccauggggggguaauugaaucaugggggcuggucuuugcugugcuauucucgugauaguaagucucaugagauuugauggguuugucagguguuuccacuuuugcuucuuccucauuuuucucuugccgccgccauguaagagguaacuuucaccucccgucaugauucugaggccuucccagccauguggaacuguaaguuaaauuaaaccucuuuuucuucccaaucuuggguaugucuuuaucagcggcgugaaaacggacuaauacaguuguauucccuguuuagaugcuguuaaauaauauuucauguaagauaaguaucugccuauuaaugauauuaggugcauucagcugcauaaguaccugaacauuauucuuggcuuucaucuguagcuguccacacuuuaucaauuaucaagccuuguuuuauguacuuuggaaauguaucuuaaaguuuguucacuuaugaccccucuuuggccuugguacuuuaauuucuucauuuguuaaauggguauauugauacagccaacuuaauaguuuuguugugaugauuaaauaccuaacauagaguauguaaacuuuacuuauuuuuauuuauuuuuuauuauuuuuugagauagggccucacccugucacccaggcuggagugugguggcgugagaucuuggcucacagcagucucagccuacugggcucaagccauccucucaucucagccccacaaguaacugagacuacaggugugcgcugccaugccuggcuaauauuuuguauuuuuuguagagacggguuuucgccauguugcccaggcuggucuugaacuucugagcucaagugauccucccacuuuggccucccaaaaugcugggauuauaggugugagccaccauguuggcuuguuagguaaauguuaaauguugcugucuaaugauaaccauauuuuacuauuacuggcucaggucacuaucauugcuaaacugggauuucuguggaguaacuccagguuggucuccaguuuucccuuugcuuagguuccucccaguucucagucuccuucacuucaguuugagcaaucuaaggugcaugucugacuggauugcuuuuacuuaaaauucccaaguggacuucuuuuugucauuggaauaaagucuguaaaauguuuuguaacauaccuuaaagacuccgccauuuucucuaaauauuuugccucuuuguuuucaguuugugggugaacuagaacaauucuggcaggaaacaaacuguauugggugugacucuaccaagaaagauggauagugaagugcuuucugauucuuauagcauagccauaguaauccuaauuuguaaagauuuuagggagauauuaauagccagauacccauucuaauuauaaaaauaccuuaauuaggcauacauagaugcaagaguuucauacuguacuacuuguuuguauaaucuccuugagaagcuauuuacauuauacuuaauaaggccacugaaugaggugguuugcuuuugugaaguuaauuagccaguuaaaaguugaggaacaucuaaugaagaugauaacuaacuuuaagucuagaaugcucaauuuagagcucuucuuucuaacauauguaacaguuauauaccagggcuuauugucuguuuaaaaaaccacaccuauagacuaaauguauuagcagcuguuuaucuuucuguucuugguugcaguaggauaugauuccauuccauuuuauccaaacgggcuaucagauuauccaggaacaaguuacaaagaagggaaacugguuccaggacacaucucuggaaguuaccuuguggacccugagaauguguuacaggugugccaagauccuucagcccuuggaagcgggugccugaguggggucuuagcugacuagagugccugggcagacaagagcagcuccaucuucucuuuagaguauguuacauaagcauuaaaucgagggugugcccugacguaaggaaaguagaagcucaccagccugcugcacucacaucagcgagagggaacauuugccccuccaugccuacugcccuucccgcccuucagccucagguuacaggaauaaauaaguuaauuaaucccaaguggggagagccuuugaagaguauuaaaaggagaggaaggaaugguuggaaccuguucccaucaggaacagaugaguaggucaagcuuuauucacuuuuaaggaggaagggauuccuaaaggacaaaccaaacuugcuuuucagggcguuacaauaaaacguucuuaaauccugaauaucacacauuucugggaggaauguccugcccuuugggaaaaauagcaagaacuucgagcucccucuagaggccagcagugauaaaagagcgucguaguggucuguagggaaaucauuuuacaaugauuagcuaagcuaccuuucagcaagaaacuaucauuuuauagauguauuauccaguaaaauguucucuuauauugggaagaaauuggugccuuugaaaagaaauuuggguuaaucauacucuaauuagcuaugaggggccaauuguaaaguucauuuacuguguagaaauacagcugagaagaucaugaaaaugggucaugugaccuaacagaauaguauauucuaaccauuggaacaaaccagaucaagaugagaaccugauuucugugcuguuuugugccggaauguuucgacaguagaccuuugaauugaacagagguaaaggugaucuauaguaccagcuguguucucacccacuccucccccucaucugaacaaaaccagugaguuccagaagauuaauauuaggaaaugcaagaugcaggcauauguuaaaauuucugaguaagcuaacauauacaguuucuuaacuuuuucagagccucaguuuacuaaaugauccaucuauuauuccaggauagacauuuuagucauaaccauauaugucaaggaguuaguuauggguuuaacccuuugauguauuuaguccuuuuguucucaauauauuuauacuucuuuauagaacucacugagagaguucaguucuaaaaacuuaguaugaacuauagaaugacagaagugauuuuaugguaauauuaauauguaaaaguugcauucccaccaggaauaugugaaaguaauugcccaauaccugcacuaaguauugccucuuuuuaaaaaaaucuuaaucauuggaaugguguguaguggcauaucauuuuuccaccuuguggaaauccaucuauuaucaaaguuuccaugguuuuaugcaaauagcuaucaaauaccugucaccugguuucucuuuccgagcucugguaacuauuccauaauucccugauuguuuuauuuauuuuauacaaacaggaucaaauguacuuuguaacauuuuaaaaacucggugauacaucguagaccauauucuuagagauuuguuauuuuuuuguacuggguaugugcaagcacauauggccagacagcagaggaauauuuacuaaaauaauagugguuuccucagaagugggguuaagagugaugauuauccuuuuucuacaaaguaguuuauuugugagauuaaggaaugaaguuaauuuuaauuaaaaaccuauguuaugauaaucucauuacuacaagugaucuuuaaaaaucauauuguauauaaacacaucugauacauaauuugcaguuugcaugaaucugcuaaaugacuguuccaggggugagauuucaggguuucuuacacuuuauuuuuugugaauugguuaguuuauagugauaauuguaucuuuuuuaugaacauaaugccaucuuaaauauuuacauauuuagauuccuauaaaacuuuuuaaaguaccuuuauugcaguacugauuuuaagguuccuaagugguugauuuaaccauuggcuauuaaucuuuagcuauuuuguuguggucagacaguauggucuuuauaauuugauuucuuggaguuucucugugacucuuaauugcauaccuuuuuagaagaaauauauacuuuuaauuugguauaauuuuucuguguauuugucauuuauauuuuuuaggugucuaucccuucucccucccagcucccaucacuguuccugucuucuacuaccuuuuuuucaacuccuuauuccuaauaacccugaaauuguaaaguuaaaaucugcauugggcauugggcauaaaaauuuaugacuguuacauucucaccauaccuuuuaucuaccuaccugcauaguacaaaacccccuuuuccuauugaauucuuuuuaaaaaaauuccaccagacuuuggggacaucaucuguauuuauuaggcaugggucaaguaugcuagcuauuuggcaguuagcaggacaguuuugaacaagaaaaauuguucgauggucugcauagcuuagaauauacugccaaauguucgugaugcuggaaaaaagcuugguuauuuucuaagccuacaaacuguuuuacuuaccaaggguuuuuucaggggauagaggccacgacuuuuaguacuaaaguuuacuguguaaaucaagggaauguuauacuuugaaauguugggauuuuuuuuacaaagaauucuucacaguuuugcaaaaucacaucacuacugcaaugcugcuaauggauuuugaguuguggguaccauauacccguguaagucuacauuuaacacugaacccuuuguguugaguacucugcauacagugucaucauaccuugaguauuuacauuuagucaucauguuuucaaauagucccgcccugccccuucccaggacugcagugauacuuacguuagagcacuugauguuaucccacaggucaggucuugguuacuuuuucuuccugucuuugcuuuauuuuguuuugauuauaggguaguucuucaacuucuugauauuuuccacuacaguauuuaaaucuguuagucuuauccaauguaucuuucacuucaaauaguauguuuuuuuauuuuuagucacauuuuugucuuucgucuuuuauuucucaucauguugaugauuuauucuuuuuucuuuuuuuuuuuuuuuuuuuugagacacagucuggcucugucgcccaggcuggagugcaauggcaccaucuuggcucacugcaacuucaccucccggguucaagcgauccucccauguucaagcaauccucccaccucggccuccugaguagccgggaccgcaggagcacgcuacagcaccuggcuuaguuuuuuuguuuuuuuaguagagacaggguuucauacguuggccagacuggucucaaacuccugaccucaagugauccacccgccucagugcugggauugcaggcgugagccacugugccugggccaugauuuauucuugaucauauggagcauauuuacaaaagcuguuuuugguccgugucugcuaggaccuuaauucuuucauuuuugucacuucuggcucuguuuacacugguuuuucuucugauuauggguuguauuuuccugccuguuuauauuccugguaauuucggauuggaaaccagacagugugaauuuacauuguagaguguuggauuuuguucuagcacauaguugagacacuugggauagauuugauccuuuccaaggaucaaauguuuguuguuaaacuuuguuaggacaaguuuagucuuuagugcugauuuagccugauuacuaaggugugacacucuugugagaacucuaccugcugguggggauuucucuucucuggcugguggggacccuaauuuuucagagccucaugucacuucauagaugcccagaucaguauucagccaaagauucuaagugagccgccuauagauaccuuuuuugggguacucugccuuuacguuguagcugcuuuaaccucuggccucuggauucuucauaacucucaccaugcugucuuggugcuuccagucaguaagcaagagcuacuacaggaaucacuuucuuuuccuuucuaagaguauccaacccacauucauuguccguugucugaaaaacaguuguuucauauauucuauucaguuuucuaaucuuucacagcaggacaauaaauucagguuaucuuaacuccuuuguggccagaaacaagaccaguuaucagauuuuuaauuuugauuuuuaucuuuuacuuuaaccucuugaaaguaguagugguaaaaaucacacauuuuuauuggguacuuuuucugaaugccuuuguuuauguagucuuaguguucuuuguuagucuuugucuuuuuuacugaaauauaacaaaaaguagaggagacugauuaccuaguagagcuuuacaggaagucaaauguuauuuguagaaagauacgaguuauuauagccagcuugacgagagcauuuucuuccagguaugaacauuuaauuucguauuagaauacuacauuggcagccccauuuguuuguagauacgugcucuuuacacaaaugcagcccuuuguggcaguauuuggaauacagaauuuuaagaaauagugguuacucaauagaauuuucacaaacuucaugauuaucuuaagauuuaugcuauuuuguguugcaugaaacagauauuucuggauuuucaguguuguuuauuugcuacagcaauguuuagaguguuuuaugaguuuuaaccuuuuaaauuguuacuauuucacuguaaagccuaauuauauugagggaaauaacagaauaggguuugucagcaucuuaaggaauggauccuacaucagcuguuucaaauggcacuuucaggaaucuauaaaucagaugguuaaaaauacuuaaacaggccagacgcaguggcucacgccuguaaucccaauacuuuggaaggcugaggugggaggaucacuuggccaggaguucaagagcaagccggccaacauauugaaagccugucucuacuaaaaauacaaaaaaaaaaauuagcuggguguaguggugcauaccuauaaucccaacugcucaagaggcugaggcagggagaauuguuucaacccgggaggcagagguugcagugagcugagaucaugccacugcacuccagccugggugacagagcaagacucuuuugucucaaaaaaaaaaaaaaaaagaagaagauacaaauugauaucaaaauaccuuuugaaaaaaaaauacuuaagcaauuccucucaguuguuucuuccccuccuuuauuuuuauuuuuuuaaaacgggcauuuacauauuaacuugguccuuaugucuuguaauucaugcuguaguuguuuauuuugccuuaggauacuccuuugauuuuucuuaagcauuuacugaauccuuuauugguuaaugcuucaucuguagggauuacagugcuuucucuuagccacauuaggggguagaauuuagaauguguaucacccagugccuugaauguagcagauucugaauaaauauuuaaaaguuguagggacaggcaguaacuguaauguggucauuaauaaguaguauaaaguugauguugcuuggcucuaaauauuuuacuaaacacagacauuuugacaaugaaaaagaggcaauaaacugaauacuuacacauuaucccuuuuuucaucauccagagauuuauagaauucugugcugccaccuuaucccuauagugcuaaauaugaguccugagucugacaguugaucacugugugauuuuucuuaggcugguuaaucacucuaauuuguuuuucuauacauugaaaaugauaugcauauuacagugauguuauaaagauuaagagagaauaaaugcccacuuagcacaauguuuggcacauuuugguuguaacaucuguaugugcuuuggcauuaguuugauaugacuuuguguuauuuuaaugccaguauccaguuaauauaaagcagaguuuggcaaacauuuucuguaaagggccagauaguaaauguuuccagucugugccgucuauucaacucaugggcauggcuaaguuccauuaaagaauuauuuacaaaaacagguugugggccguaguuuuccaaccugugacuagagguuacuuuuguauuucuuugucuuuuuuguuuuuguugcuguuuucauuugacagcuuugguacaauguauuucuuaacuauugaguauuucaaauaccuucagcuguauuaaaaauuauauagguaauacaguuauaacccucuuugcacuuugauuaauuucuuucagaucacuuauuugagacauaguccucaaguggaauuaugaaaucaaagagugacuccauaaagugccucacaacacaagagcugagguauuuagagaaugccaaggcuacuaauaauuuagucuuuuaauggauaguaauuauuuguuacacccauuuauauauacuauuugugaauuuccccuugcugauuuuuauacugagaguuacauuuuugaaccuuuggcuguauguguucuauuguguuucuuauaauacauaagaaacagaagauagguggcaauaaggaaacggccuuaugaaguaaaaaccgaccaaugacacuguugucauucccacuaccaauugcucuuccacucacaaaagaaagcaauuauuucaccuucuaagagugaaaccugccugggugcugacaguuuagaaagaggggguggaaaaaguaagaauuucauucuguauaauaaauuaccaaucccuugguuugcauuaauaguguauagauaaaauuuaagaacauuacauuacuuuuuuuuuaacaaaaauacucuuaugccuuuuaaauacuaccuuuauaucgcacaauuuggaagucaauguguaucuaaaauugcuggguugacuuaaugcauaguagggcaguggacuaauguucugaaagguccuucuuuauuaacuguauuagaauguucuuuuguaagauuaauacaggcauuuuucauuguaaaauaacauugugauuggugauaggacagauuuuuccuuuuaaagaaguuguuuguucuuuggcauuuuggugguggugguuugugagaauauaacucaacugauauacuauacuaaaguaugcacaaauucgguaugauagcucugacagugaugucaguuuuugcuuuuaaaaaacaugauacacagugcauuguuuaaaggugcagaauucucaaauuccagcauucuuggguuugcaauaaaagucaguauccggccagguacgguggcucacgccugaaauuccagcauauugggaggccgagguaggcggaucacaaggucaggagauugagaccauccuggcuaacacggugaaaccccgccucuacuaaaaauacaaaaaauuagccgguggugguggcaggugccuguagucccagcuacucaggaggcugaggcaggagaauggcgugaacccgggaggcggagguugcagggagccgagaucgcgccacugcacuccagccugggcggcagaguaagacuccaucucaaaaaaaaacaaaaaacaaaaacaaaaaaagucaguauccacucuguaauguuuuagaccugugcuguccagucugguagccgcuagcuacauauggguaucagaacaugagaagaauauuuucuaagaguagauuauuuucuaaaaaccuggauaccaguauuuagccagcccuguuuggguguagcaugaaaugguaucccuguuugcaggacugugcuuccucacuuuuugcaugucauggcauuccuaaaaagcagcgauguuuguauggcacacugggauacacagccgaggaugcuuacaacuagggcuuaccgaucugagugcucugcagcaccaggcaagaccauaccccauucuuggcaugccgguaugcaguggcacauacgguacaaagcugcuucagcgugcucccuauaacucauuccuggauguuuuucuuggucuaugagcggaauuugaauucauucucccuucuuauuucaucauuuuuauaugucauauucccagugagacugugagacauuggcauuucacaacuuagaagagcuuucaaagcaucauccauaaacuuagagauuuagugaguaacuguauaugaucuuucucuucucuuuuguuuaagggagaaaggaggaaggaacaccaugacguagugauauauuuaaauucuguuuuagaaaccaggaaaauaguuuuccuaccagaaauaugauuacauuaaauauaugcgguauaaagaucacagcaaggagaccaugaaucuguccaucuaccccuccccgaaauaaaauuacucuacacuauucagauaaaaagugacuugguuggcuguuucugaaacuuucuguuuauuggcuuuuggcaagauaaauaguaacaaacaccagugucuuaaaaucuaaaaauugguaauccauguaccuacuguuuauuucccucaaggauuuuacagugaguugacuuuugugguguaaaucuuugguucuuguccuuuccugauauccagccacuugcuguuugggccaguuguuucuaggauuccucacccuacacaagggucccucuuaaaauucuuuaccuuugcuacaaaacuaguucacugcuaaacacauaaccacaucacuguacgcuaaaaaugucaucauaaaauaauuguuccugccauaagaagugauacguuauuggagcaaaugucuuguuucuguugcaucuugcaaucaagucuuuuucuucuccccacacacccuucaccuuccucuuccauucacauguucagugauuacauuauaacugguugugagaguccccugucuucaguuuggaauauuguaccuacaaucauuacuugauucuuguucugucuucucauaauaaaauagguaagggcuggguguuguguuuugugguucaugcuuguaaucccagcacuuugggaggucaaggcaggaggauugcuugaugccaagaguucgaaaccagccugggcaacauggcaacacccugucuauaaaaaaauaaaaauaaaaaaauuagacuggcauggugguccgcaccuguagucccagcuacuuggggagcugauaugggaagauugcuugaacccgggaggucaaggcugcagugagguaugauugaaccacugcauuccagcuggggcaacaaagcgaaaccccaucucaaaaaauaauaaauuggcguggaaugugccuucccaccccaccccucagucucaaaucucaauuguuuuacuguaaugcuguccuuacugacuuaaucaucucuagguuuuacguguucaguucacuuaaggaauauuaagguuucuuccuuauuagaaauugagcccggcuggguaugguagcgcuugcaaacuuccagcaguuuggaaggcugaggugggaggaucacugaagaccacaagcucgagacuaccuugagcaacauagugagacccugucucuacaaaaaaauuuuuuaaaaauuagccagguaugguggugcaugccuguaguaccagcuauucaagagacugcggugggaggauugcuugagcccagaaguucgacaugauugcaccacugcacuccagccuggucaaaaggccuuuuuuuuuuuuuaaagacucuuuuaagaaaaaaaaaaguccaugcugcaccaaaccuaccugucuaacuuuacugcuuagcagagaguguagucaggcuagucacgccaugguccuugacaucuccuuacuaagugauaguuguaacagcucaucagccugacaaggaguuguaauuaauuuagguggaugcaacaacuuggaccugggaaagagauaaaauaaguaaugggcaacucggcccauuauuccacugaguugaacaggagaaugagucugguauugguuucagaugugagcauuucaccaagcugagagcauauucuagagaucaaagauagguauuuugguacagcaagauuucauauucaaauuaacuaguucauuugaugguuaggcuaaaaaaaacccagcaaauuaucaaugcuguagggaaaauugagcuggacuuacgagaaagaauuugugucuucagggugucugugugagggauuugaauuuaaagauaaucuugacucuguauguuuguauuauuauuugauuuuagagccuaacccucagauuugauucaauauuuuuugucugcuacucuuugcuccuacuuaacuccccaguuguacucuaaugugcuuuaagugcagggacuuuguauauuuuuaauccuuuauucgcuguagaagucaguaguauaguacagaacuccuaaucaaaugacuucucaguacuuacugguguuuggcuuuauguacuagcccaguauauucaguuuuacgccuuuuauguuacuuagguaagcaguuacucagguaaccaccgugguguagccagggguuuuuuaaccuggcguugaguuguuguccaaacagucugagauaauaugcacauuuuuaugagcacuuaaauaugugcaguuuugugggagagcauuuguaacuuuugguagauucugaaagaguucaaaaagauuaaaugccuuggaccuagacaacggaggaagaaaagaaaccuucucaaaaucugggcuuuaaaaaauugcuaaaagaaaauuaugaaaugcagugcuggauagauuauuggugaaauacaugucaguaaauuuaaaauuuuaaaguauguauaucaucagauucuuaaauucuuaacagugagcuucuguagaccagaggaugucuguucuuuuauaaagcugauuuauuuuaaaugcacaugauaggggcuuuucuaauucagcuuaaugcuuuauagugaagaacuucuuaaugacacagugaugaauuuuaccauguuacugcucuaucuuaugcccauuucuguaauuuagacuuuuuuucuuaggaaaagggcucuagugugaaaaaccaagaaaaaaaacuugacaguuuucuuugaucaugacugugaagucagcacugagcugguagaauccaugugacgugacugauucuagugguccugcaguguaggggagcuggaggagccgugcacauugaaggcacauagcacgaagcauuucugcuauaaaaaagcgggaucuauuugcaaacacuuguuugaagccaugauuuugaauuuaugacuuaaaauuccaucuaaaaguauuuuuacauuuaaaauucccucuccuuauuaguaauaugugccuuuauuauagaugauuauuugcauuugcauaaacaagcuuaucaaauguauauaagaaaauuagcaagauaauguuuaagggugcuaucagaaugauucacaaauuguugauuucuuugcauucacaaauuuagugaaauguuaauaaauuaguauuuguuguauucucuguuaaaauaguuucauacugguuuauucugaggagaauuuuuauuaguggaucaaaauauuuaugaaagaacuuuagauucauguuauuucugaugggugguugauguacuucaaagauauacuucauagacuuggaauguuugggaaaacacgcuaaguucugaaacuagugagucgggaaagaaaaacuaauaucuuuuuuuguuuugucucaauuauacagcagauauaauuucuacaguagaauuuaaucauucuggagaauuacuagcaacaggagauaaaggugguagaguugucaucuuucaacaggagcaggagguaaguguuuaaaguuuauugucuaaauuucaguuugaucuuaggacuagagcuuguguugcacuggagaaucucaucagaggauguuggaauuuuaaaagaaguguguguuuauugaauacaauguccaauauauagacagcucugguucucuuagcuuuguaugugugcauguguguacaugagcguauguuguuuugguuuaaaaacauaacacuaauuguaaaaauacuugauuagagaaggggguggaaagugauggaauaauccaagauuuuaacgguuuugaagccuuggcccuucauuauaauuuuuccuuugaaacuccguaaagcaaaguugcuuugacuucuucucaaugcuugguuuacuuuguacaauugaggggugagaggcuaguuuaaagaaaaagcagcucaauuauuuugaugucaguucauaauaauacuguuacaaugauuuaaauguaaagguuuaaaugacaguugcauguacaugcauguaaaguaacuuaaaagugcagugcuagcuuuuugaagaaagaaaauugcagaaucgguaauuaaagugggcuuuuguuuuguuuuucuuacaacuuaggcacacuucuaaauuuaauugaccagauuucucacuaaaaauuuuuugcuaaacaaaauuugucacacuugguuuuuucuuauucauucucuccuuccauuuguagaucagaguuuaaccauuaaaaucaguuguuuuggaacauucugccccuauuuauaauauauuuaaaaaguuuaaaguaauguggauaaauugcaggguuuuacaaauacaugucuaaaucauaacacagaguuagguuuuaaaggauugugaaauuccuuaaauaagcaaagaaucuaguaauaauacuacuacuuugcacuucuauagcgccuuugaccugaggaucucaaagugcuuuacaaacacuaaugaauuaauccucacaacaccccagugagguagguaauuuaauuuuaaaagaaaugauuaauagugucugauuagaagaugcacaaacacuaaauaugucuuuuauuauuuuuuucguuuggaagaaaauaugaaaauaagacucaagcuuugcuugacaaagaauggucucgugggaaguggggggcuaaaucaguuuucuguuuuuaaguagccaaaaacucgaccauaagaaucuugacauacuuagaguugacauggaaccuuacauuauaauuucauuauaauuucccuuuauuuacuaacaggaaagucaagauauaaauagauuacuuuauuacuuaguggcagaacuaacaagcagaaccugaacuuuugacaugucguuuuucaguauucuuugcuguuuuucaugcuagauaaccaaaaugugaaaguuuuuaucuagaguuuagagcagaccuucccauagguguucucugcccuugaauguauuuuuuacugaaaguuauugacucucuacacuuuacuuuuauuuuaaagaaaaguguuugagaaaaacucguaaaaauugauuuugcccuaggcuuaacauucugaggguuucagaaagucuucauuuuuaaugaaggcauugugucauugucaauucuaaaauacaaguuugucaauuaaaagcuaauuuggaacuauuuugccugagaaugaagucauuuucaucuccuguggucguuuguuguccaagucaaaaucaaguguggaaaaaauggcugaaaauuuuuuuaauugggggaaauguuuguuuuaauauggguuuaguaauguagucagaauauuaguauuuaguauuuuccuaaaggcuguuaguaauacauuaauuuguaauuaaauuccaaauuuaauaguuacugaaauuacucauuuacuuguauuagaaaauaagacaaaauuauuuuaaagauaaucauuucccgugauucuuuucugaaaccccacugaagauucuaaagugcuaauauuuuaacuacauuuucuuguaagaagaauugagcagaauaacuuuuugggaagggccauugauaggaaaaauaggaccuccuuuucaugugucucauucuucuuaacuauauuuaagaauucuagauggagaguuuuguagaaacucaguaacaugucuuuugagaauuacuuagugguguaaauaucagcauguuuuuaagugauagauuaaguaaagaugaugauggugauugacucuucacuucugaaacuugaucuugacuauuaauuugguguguuuugccuauuuaauuuucuacauuuuaaagcccugucuuagaguuucuaauacaguauugucuucagaaucuaugucauuggucauaaauauguauacuugacacuuagaggcaccuuuguuucaauaccuaauguaauuggaugagauuuuaugaauucacaucuagaggcaccuuuguuucaauaccuaauguaauugaaugagauuuuaugaauucacauguauauaucuguaagauaguguuacaguuugaaaagugaaagaaauaguccuuuccuaauuuguagauaaaauccaaauuauuuaacaagguuauauugcuucauuuaguagcaaaaaucagguuaggauuugggucuccgauuuucaauccaacuauuauauguucauuccagaguacacuggugccuaauguuucuuagacucugaugagggugcuagccuuguuugcagaauacacuggcauuugaucuauuguggcuuuauucucuuaccuaguggcaggguuccuucuuaaacuugacuuuacuggagaccaaaauaucuccacccacucauuuuuauugucuuuacuuggaagaagaagagaucauauaacagcaacagagaacuuggcacaucagacuuugacaucuguaaccccucauugucugccucauuuauuuuacccuucagaaguagcuagucuccuuccugugauccaggcggguaucuguguccucuugcugccuguccguuuauuccccaaucguaauauaaagaaacugaguagccaauucagagggucuucauuugguuugaguauguuucagacugauaauuguuuaauauuuuuagcugucauuuaauagcauuguuauaacuaauauauuuguauagguauucugcuacacggaaucucuguuguagaaucagggcaccuaaagaaauugaggcacacaaguaaagugauuucccugauguaaucacagccaucaugugaucagugagaguccaaaauucugauaacaaauccaguguucuuuauagcaugacccgauauaagugacccauguuauuuuuauagcuucuaauagcuuuugacagcaaaguaaaugauaggguauauucuuuuuguuaaugaaaauauuaauacaggguuuugaggagaagaguccaaacagcuauuaaaguggauaaugauguucucuagguuuuagggauuuuuguuguuuccaugggugcucaaauuagguaauuagcaguugucaaaguagcugguuuccuacugaguuggguugcucagaccuucaguuucucugagacuuugugauguacccuguaagguagugugggugugugggugcuggguuaaagggacagcuaagacagaaggugaggagggagguuguaccucuuuccacuucuuuuuauaauuuuucuagguugguauggggccuuugauuuuuguuuucuagggcugcugguaacuuucuuggauuucauacccucuggcuuuuuuuauucuuaaugugguauucccaaaauuccuuaacaggauacagaagaaaccuuaaaaagcaugcuuuucacaaaagguggauaguauuguuaauaugauaguauuaccuuucuaaauuauauauggcucaaaauguuugcauguauuuaaaaugcagauuucuggguugggggccguggcugaugccugcagucccaacacuuugggaggcugaggcagguggaucacuugagggcaggcuggccaacauagugaaacccuguaucuaauaaaaauacaaaaauuagcugauccugguggcacauaccuguaaucccagcuaugugacugaaauaugaggaucacuugaaccuaggaggcggagguugcagugagcugagauggugccuuugcacuccagccugggcaacagagugagacugucucaaaaacuaauaauaaaaaauaaauaaauaaaauacagauuucuauccugcuccucaagauuacuaaaucagaauauguauguauauggugcauucauagaauguaagagcuaacauuuauagggcuuucuagggauucuuaacuuuuuuguugucaucccauggauuccuuugauagccuaguaaauccuguagacuucucagauuuuuuuuuuuuuugagauggagucucacucuguugcccaggcuggagugcaguggcgugaucucagcucacugcagccuccaccaccaggguuaaagcaguucuccugccucagccuccugaguagcugggacuacaggugcacaccaccacaccuggcuaauuuuugcauuuuugguagagauggguuuucaccauauuggccaggauggucucgaucuccugaccucaugauccacccgucucgugauccacccaccuuggccucccaaaguguugagcgugagccaccgugccuggccagaauguuuaaauugcauaaaauauuuaagauuauaaagguugaaauaauuuaccaaaauauucauaauugaguaauauauguuuuaaguggauaacagcuggauuacgauauuaaaaugucauuucuguuugacagagucacaagaauugcuaauacuauaugcaguuuguuaccuaugcccauaaucaaaagaaaugcugaaauuuagcuggagguuagugaaaauaaauguguacauuuuccccccauccaggcuuauaaaaucccuggguucugucauuggacccuuguguccaugagcccucaauuuuuaaccccugguagugcagucuccuuuugccagcugggggcccagguaccagauuacccauccaaagucauacaguuaauaaggaagugauucuucacugcagaagccacacauccugauuucuacugcauggcuuugcccacucuaaccuggauguaguagcagcaguuuaugugcuaggaccucugccaagaucccuaaaucuuacuuaaucaucacagcaaaauaacaaagauguauguauguuuacuauaucuugauguauuacaaauuuauaaauaaaaugagauuuagagaggauaaguaacauuuccaagagcacccugcuagguaaguggguaaaagcuaauucuguguaaauuuggaugaguauucacaaugcuggcuauugauauuaaaauaaaaaaaacuuuaauccuguuuggugugaugagccuaauuguuagaaaucacacaggaaaaucagucucauuacuuuauaccuaaugaggaaaguacgugauccuuagacuuuuuaauaugagcuauugagugaucuguuuucugucauagguguuagaggggaaaauggacuaagaguugaacagccuugguucuaguccugguauucauuuaugcauuugcccagccaucucuucuuguucagccuuuuagcguccagauuucuguccagacugccaucagauucuugucagcuaccuguuaaucuuuuggggcuccuuaggguauuacauuucccaaaagcaaaauaucauguauuuuaaauauuuaaaauaucggcucaauggguaccuaauuuuacccguugagcagaaauuugaauuaaccauauuucuuauacagggugaguaucccuuaucugaaaugcuuggaaccagaaguguuucaaauuucagauguuuucggauuuuggaauaugcgcauguguacauaaugagauauauuggggaugggacccaaguccuaaacacaaauuaaauuguuucauauacaccuuauacauaugaccugaagauaauuauacaacauuuuaaaucauuugugcaugaaacacaguuuugacugugacccaucacaugaggccaggugugaaauuuuccacuugugucauguugacaguaaaaaguuucaaauuguggagcauuuuggguuucagauuuucagauuagguaugcucaaccuauccccaagaaauucuccaccaaaaacaacuccaaaucuaugaaauuaauaaugcccaguaauuuuggaauuaauuauuuaauuaauaaacuuggaauuuauuuaccuuuccuucuuccugugcucucccuagccucacacauauaaaacauuucauuguauucuuauuauuaauaauuuuucccucuuaauuauaaauucauuaugcucgauguagauaauucaguaaauauggauaaguggcaaagaaugcauguauaaccccaccaaacaaaaauaagaacuuuugguauauaccaaaggccugucuuucugaauaucugauuauaaauuuaggguuguaugauuuuuuuucucacauacuguauagugaauaccuuuucaugucauucaguuuucuguaucaccaucucuguaaugacaugacaugacauaauuauguuuauuugaucuagucucuauuguuagauuccuagauuguuuauuucugccucuuuuuucaggguugggaggugagcgacugccccuuugcaguuacuguguuuuucccucuuucuaaaaaaagaaaaguagcaacuuggugauugaaaauacauuauuucauuggauuuugguuuuacuuuacgccuuaauacucccaauaauuaaagcaucuuguucuaugcccucuuuuucuagugguguauuuauugaauuuggaugggccacauauugugagagacggcaucagcucuuuuucucacgaggcauuauguuuuucagcuuuguugauuggcugccuuuaaauuuuauuuuacuuuuuguuuuucugcccacagauuauuuaaacauucuuuuguucccuuuuaaauuuauuauuuaguuagacuuuauuacccuacauuaugugaugaagugauuuuuuucucuuccaccuuccccacccauucacagauuaccagucggguuauuauuauuauuauuauuauuauuauuauuuauuuuaguuuuacagagucucacucugucacccuggcuggaguacaguggcaugaucucagcucacugcaacuuccaccacccagguucaagucauccuuaugccucagccucccgaguagcugggauuacagacgugcaccaccaugccugguuaauuuuuguguuuuuaguagaggcaggguuuugccaugcugaccgggcuggucucaaacuucuggccucaaguuaucugcccacuuaggccucccaaagugcugggauuauaggcaugagccaccacacccagcugguuauuacauuauuuauugaaauuuuuucacauggauuuaaaaugcacauuagaucagucaucugcagaguugugucuagacuucacuauauuuuagcuuuucaaagucuuauucaaggaugaugaacucugcuagucuuucuacuuuauucguuccuucuuacaguugaguuguguagauagguuuugaaauguauugaaauuggguucuuucucaaauaucucucuauagccuuucagaguaaauacuugaucagaauaguuguuguugcauauuucuuagugucuaguuauuaagaaggauuugacuugugccuuuacaaaggggaauuuucuagcgaacuucaucuguagucaauuuaucagggguauggaggacuuucuuauuagaauguuaccaguggaaaggacauugaagacuaucugauccgaucuuauuuguuauuucuccaauuugaggcacagagaagagucugaaaucaggcgccucaaaugucggggugucaugcauuuaccugcaucauguuguuucuaaaugauagaauuugcacuugauccuuaucuggaagagaaacuaauauuugaacuuuacuugcuuuugcauuaaauucccaaaguuauccuguccugagagaauaaauuguauuuaacacaugaagaaaacgugauccaggggauuguuauauuuuaugaacuucaaagggaaagagacacaaguaguaaaaugaaucuuuuuuuuuuuuuuuaaucuaacaccagguaggguucaucugaaucuucucucagagagaaaccaacuccuuaaggguccagguuagauugaaauuccauuuugagagaaacaagguuggagagccuugagaucugccuccauuccuugguuguugauagaacuggggaagagcgcuagcaucugagcaaggcacaguuuucgugugggguguuuguguguguccacgcgcaugugcauggaggguuuuuuuuuuuuuuccauuccuuucaguaauguguaaaauguagaauaaauaagcauuccuccuauguaacuuuaucacuuaaucuguagcauaguuuagaacagauauucuagcuaguuugauaaucugagugaaagcacuuuaacaacuuuagguuuuaaagcauuauauuaauuguauuuuaugcauuuccuuuaaauuuuauuugacuaucuuauagacaaauaauaaugcuacuugauuugacuuucuaauuguuucaaccagguauccuucauucagauaucucucccacuauauuauuguuuuuuugauaggauauugugacugauacgcuuccaaauugcacuuagaauaguacauaauaggcacucagugaaugaguauuaacuuacugaacauaauuuaauaaggccuugcaaaaucuugaagugcuccaugacuaucguuaucauuaguuuagagaaaguuuugagauuucucuuguguuuauuucaucgaaugacuuguauuuugcuuuauucuagaaaguuccccauauuuucugaauguguugagaguaguuaucagauaucauuuaauuuuguuuuguaccauuucugccacugucccugaaugcccauuucacaagacacugacucuuuuaaaauacuuuuauacugcuauaaaauauaaaacaaaugacugcuuacacuauauagaagaugaacauuaauaaacaguaaguuuuaguaggguucuauuuggaggcuuaaaaauauucauuuauuuucugcuauaugagaucaaaguaaaauacauuuauuauuuucuuaaauuuuuaaauuuuuuccacggagcaaaguaaauauuuccuacauuuuugcagaguuucauuuaaggaaggagaaaguuaguacagguugagcauuccuaacccaaaauccaaaguauuccagaauuggagacuuauugaaugcugaugugauaccacaaguggaaaauuccccuggccucaugugaugggucacagucaaaacuuuguuucaugcacaaaauuaauuaaaaugcuguauaaaauuacuuucaggcuauauguauaagguauauacaaaaccacugaauuuuguauuuagacuuggguccccucccuaagauaauaucaugaauauguaaauauuccaaaauauggaaaaaaaugugaaaucugaaacacuucugguccuaagcaucuuggauaagggauacucagccuguaaaagcacaauggaguuacuuauauuuagaaguagcuguugaaaaauguuaagugaaauucuuucagaaguuugccuuuaagucuugacuauucuuaguauguuuauugcagaaaauaggaaaaauguguaucauuuccacaaagaauaaaaucaaaaccaucccauaacaggaaugaaaaaugaagaccuguguguguguauguaugugugguuuucucagggauuuuuguuuuguuuuacagaaugagacucauguuguacauaucacuuuguaauguuuaguuuuauuuacugucaauguuuucucagguugaaauauugccucccagucagggagaugaagagacuguuggaaccauugaguagaaaggggcacuugaauaguugggaagaacauacuccaucuuauaacuuaggugacaagguucaauaaacuuguggcuugugggaacagcuuauacuucuaccaguaguaugugacuuugccuuucugucacuaaaacaauggucauuaucacauuuuuaauuuuuuguucauuuaagggaaaauaauauugcuuaguuuugguggguggguagauguguguguguuuuguuggggauuuuuguuuuguuuuacagaaugagacucauguuguacauaucacuuuguaauguuuaguuuuauguacugucaauguuuucucagguugaaauacugccuuccaguuagggagacgaagagacuguuggaaccauugauuggguuacuuccaccuuuuggcucuugagaauaaagcuguaaugggcauggcuguccaaacaccucucugaggucccauuuucaguucuuugggauaaaauccagaagugggauugcuggauuauaugguaguucuauuuuuagcuuuuuugaggaaucuccacguuguuuuccauaguggcugcaacauaugugugguauauauuuuaaaaucuuuauuuaaauauacacugaaaaguacauaaaauacuagcagauuauuacauagcaaacauuuaggucaagaaauagaacuuccuacgcuuccacaaacccuucucuuuucccuuccucuccuuuaugagccugucuuauuaaugauuauuuuggccugcaguuuuagaacuuugaauagauggaauccacaguuuauccauuaugaguaauguugcugugaacauucuuacucauguuuuuugcuguacaaucaugaguagaaauauuaugcccauaggguaggcauucacuguuagcagacaucacaguaaaaaguucugcuaauuuuauucuugugaacaguauauaaauuuuauggcuguucuacaucuuugccagugcuauguguuguauuaucagucuuuuaaaauuuaacacuuuguggguaugaauuaaguuuguauuuacuguuuguuuguuuuuuuuugagacgaagucuucuugcuuugucacccaggcuggaaugcaguuggugugaucuucgcucacugcaaccuccuccucccaucaagugauucuccugacucagccucccaaguagcugggauuacaggcaugcaccaccaugcccagcuaaauuuuuguauuuuugguagagagagaguuucacuguguuagccaggcuggucucgaacucgaccucaggugaucugcccgccucagucucccaaagugcugggauuacaggcaugagacaucacguccggccuuguacuuacucuugugauucacauugagauugaguaguuguuguguuguuuugagacaggguguuucuuuguugcccagguuggagugugcaguggugcgcuuacagcucacuguagccucaaacuucuggacucaagugauccuucccacuucagccuccccaguagcugagacuacaggcgugcacugcaacacuugacuaauuuuuuuuuucucucucucuuuuuuugguagggauggucucacuguguugcugaucuugaacuccugaccucaagcaauccucugucuuggccucccaaaguguuggauuacaggcaugagcugcgacuccuagccagagcugcuuuuuauauguuuauuggcuauuuggauguuaucuuuuggaagugacuaucgaaaucucuuauaauuuucuguguugugugucauuuuucuuacugauuuguagacuuucuuuacacuuuuuguagaugaacucuuuuucaguuacauuuguuggaggauccaggggcaguggcucacgccuguaauccuagcacuuugggaggcugaauugguuggaucacuugagcccaggaaauugagaccaggcugggcaauauagcaagaccucaucuuuuuuaaaaaacaaaacaaaacaaaacaagaaaacccacacauuuguuagaaguauuuuucauucugugacuugccuuuucauuuuuuugaauaguauauuuuuauaaauagagauuauuaauauaauacaguugaucaguauuuuucuuaggguuacugguuuuucuguccuguauaagaaauacuuuucaaccccaaaauccagggaagacauuuccguuaucuuuuagaacuguaugacugguacuguagcuacuagauccauguggcuauucagauuaauggggaguugagucuguucucucuccccuaaugcaagacccuguugcaguggucccugucuccauggcccucuuuaaagucagccuuacuaccuuauaaauaaguaaauaaauaaauuuaaauuauuaaaaauaaauuguagaauuaacuuccuuaguugcaguagccacauuuuagguguucagugugugccuagugcucaacaugacuaguggcaaccauacuggacaacacagauacagacuauuuccaucauugcagaaaaguucucuuggguccuguuauccuaaaacuuaauuauuguaccuucacauuuauaucucuuauucaucuguaaucacuuuacgagugguuuugggaaggggucgagcuucauuuuauuuccuaugaauagucaaccuaacaccauuuagugaaaagaccauccuuuccccauugcccagcaaggcaaccuuugucaucauuuaggccuguuucugggccaucuguucuguuucauuggcacauugguguauccucaugccaguacacagucuuuaugacuuugcuuuaaaacuugguuaugauguccuuuagugaauucuguuagcaucuguguugaaaaugugugauuuugguuuuguguccuguguuuguaauguauguaaaguaugugacauagcucauucuaaauccugcuuugaaagucuuuauugaaugccuguuauaugugccaaguacuguuauaggugcuggggaauaaagcacaucuaaacuuacuguagaaacuuucaugcaaauagauuguaugguuaggaagaugauucucauagugaucauaaaggcaagcaagaaaagagagggaggugaaaaugcugugcagguaaagccaguaugaauuguugaaggaugugucacaauucuguaugacuguaggagagguuuuuaaaacaaaaacauuguguuugauuuugaugcauucucauuugaguggcucaguguugaguaugcgguuaugugucuucuuauucaggcuugcucacuguacuuuguuugugcagggaacaaugcuaucaugaucauuauaauguaaacauccccucccaaaguguuaggaaaagucugcugcagcucccuguggucuacugucaguuaccacuuguacccaucuguuuuauagccucuucaguuuuguuacugcugcugucauuucugccauuacucuuuguccuguggacuuguuuuuaaaaguucuguuaugaucacuuuaauaaaguuucaggagagaggggaggcuaaugcaugugcucagccuggcaucuugagcuuuuuagacagaauuuucuccuuuugugauacauuaauuuauuuccuguugcaaagagauggagcuucuugcaguccacgaaacugccauauaccucuaugauuuuguuuuuggauucuguaagauaccauguuuaguagaccuguguuguuguccacgagucuacaggaagauguucauguuuuguuucagaaaauauuucuguuguuuugugcuuuucuuaacucaucaaauacaauguguggcucgcccuuggcccuucauauugcuuaccuuaauuguguagaccauaaccaguuucuacuuugacuaaaguuugacguacacaaguuacuugaauguggggauucugucuaucccucuacgcccuaguguacauaguacuauauauuauagucucuuuaaguguuaaaugaaaaaccagucuaaaaugcaggauuuauauuaaaaaucgaguugccugcuuaaugguauugugguuuccuuguagacuauaaugauaaauuuugugagacugggugagucauuuuagguaaaagauuuguggagcuuuaaagugauacuggaguauuuauauauguuaauggaauaggcugucuaauuuuguguauggguauggugaugagaccaaggcucugagucugauuuuuaccccuuguguauccccgauauguggaucguuuugugggacauguauucuuaacauuggcagacuugcccucuaauaacugauaacugcuguccaaggguucaaauacaaccauccaugaaugaacaacccagaucaucaggcugcuggaaaaaacaacccaaaacauagacuuucaagaugauucagugaaguuuccuuuugauauggagaauaguaauaggcuguuuuuauuaucaagaaguucuaaacauuucacuggguaacucacuuuuacuuaaaauaguugacugucaauaauaucucauucuauuuuuuacuuaaacuuuuuccauaggugguucuuugaacuagacuuucaaauuuuuuuaugaaaauguuuuuaaucgugugauaauaggucaaaagaugaaauucugaacaugauuauaauucucacuuuugcugagauauuaaugcuaaccagaguaguucaaaaguagucccuuuaugagauagcuuaaauuacauuuuuucaaagugauacuaaaugaaauuagucaucagugugugccagguucauaagaugagaaagcaaauuuaaggcgaguaagcaguuguugaugggggugcauggggccauugcuggguagugcugaauauggacuugauugguagcaaagcugucuggaacaguggucuuggggugggagguaggggucaaaugguaucccuucuuuuauaagagcucuuuuuuuaagcuuucagcagcgaaauaaccaaaaggcgggcagcagaaaggaaaaggacaauacaucauauuaaauaacagaucggggaguugacccuaaagugggcauaggaagaaggugugccucaccuagcucuuucugggcaagacuuuaucauuauuuuuagaugaacuuccuuauuaugggugcucaguuuuuuuucaucaguuuuuuucauagacuauaccaucaaauacauaagaguaaauuagcaaucaaauugauccauauuuaacgucauuauuucccuaaugaauugagcuuauuuauucagcuuuauuuagccuuuucccccguuaaguuuucucauuuaauccuugaaggccuuuagaaauauaaaaaacagaauguaauuguauaaagacacaacuaaugggguauugagaaugugcaggguccuuuggaauugauuacauauuugauuauuuugaaauauuuuucaacaaugguccauauauuuuuguuuucauuuuagaacaaaauccagucucauagcagaggagaauauaauguuuacagcaccuuccagagccaugaaccagaguuugacuacuugaaaaguuuagaaauagaagaaaagaucaacaaaauuaggugguuaccccagaaaaaugcugcucaguuuuuauugucuaccaaugguaaguauacauauuuucuuuccaugugcccacuguguguaccuguugcacauauccuguagccuaggagaggaaucauuuaacagagauacuuguaaaaaggacuuuuguuuuucuauacagaauguaaacucuacuuuuuuacugucacuugcaguuuuuagauucucugaaagauucucugauagcaauuuuuuguuuacuacaccuccaauuuguagugaaaagaaugggcugcuauaccauuggauuuaggucagguaauauuucugucauuucucagucucguaaucuugggcagguuacuaacacugaauugaauuuuccucagcagcaaacuagagauagcaauuuuuuauuauaguauuauuaugaauauuaaauaacuucacauacaucaugagugcaagugcucaauaaauguuaauuuauuccuccuuuuuaaguguuuguaaacuacacagaguaucucaaacugcagauacaaaauacucaaaggauggucuccauuccaggauacgcuauaggagagcacuuucuuacuugaucaccauuagcauauugccuucuucccagcaauccacauggcuggaaggagauuccucuccuacuguuuacuugccaagggaacauuuuuuguuguuuuuugagacaaugucugucgcccaggcugaagugcauugguguaaucacagcucacugcagccucgaccucccuaccucagucuccugaguagcugggaccacaggugagugccaccacacccggcuaauuuuuuaaaaacauuuuuguagagacugggucucccuauguugcucaggcuggucuugaauuccugggcucaagcagucugccccgcucagucucccaaagugcugggauuacacgugugagccacuaugccuggcccaggaaaaguugagugaggauuaaaaguuaguaaugacaggccgggcgugguggcucacgccuguaaucccagcacuuuaggaggcugaggcggguggaucacgaggucaggagauugagaccauccuggcuaacauggugaaaccgugucucuacuaaaaauacaaaaaaauuauccgggugugguggcgggugccuguaguuccagcuacuggggcgggggugcugaggcaggagaauggggugaaccugggaggcagagcuugcagugagccgagaucgcgccauugcacuccagccugggcaacagagcgagacucgucucaaaaaaaaaaaaaaaaaguuaguaaugacucuaccagaauuugaaauccuuuaugaugaguugggugcuuucucuuuguucuuaugaaaaacuuuuuccugugaauuguuuggacuuuguuggggucuugagucuaaagggaaucauuagagugacugaggagauacuuuaguuucuggguagccguagucuauaaaaauuugugauuaaaacuuuuuugagguuggugcuagggugaggggaaccucuuauuuucucauccccucacuauuaauuuaaaaagcaaauucuaacaccuagaccauaaacauuugcagaauauauacuuaaaugacuucaggaugaaaugggggaagaaauucagcacuuccuccaucuaauugaugccccucguccacaguauuaguucuuagaaaugcuguucacaaaugccugauggccaucagcguuggccgccuccugggugcccguuuuucugaucaugaaagcuuuccccagccaguccauugagaugcguacccucugccuucucuguuuucacaauagacugcauuccccucucuuguccuuauuagaagaaaaauaaagagaaguaacuauuuaaagccuguaaaucacagcacuauggguggagggaacaguuuauuccugucauaugcuagcuucuagucuugggucaguuuuaauuuauaugguaaacuaaguuauuucaaauagcuucaaauauuuuagacacuguucuuuggcaucagaugauacauaauuaaaccauuuauauaauuucuacuuuuagaaguaaauguuccuagggaaauguguuguuaacauuuuauauauuggaauauuuuuaugucaguuuauuucuuauagggcuacaucagcuuucuuauaaagagaacuuuuuaaauguaggcugaguucaagagaauaguauagugaagcccugcaugcucaucauccacuucugacacuccucaguucauggcuaauuugugucucggauccuuccccuuccccuccuccucaguguuauuucgaagcaaauccgauuacaacgucuauggauuaaaucuuguuuaaagacauuagagaaugcauuguagauuuuugucuuuuguuucuuaauacuaaguaaaauacagcuaacugggggcugcauuuuuuaaugcuaaaauaagugcuuaauaauagaguccaauguggaaggauaaagcagauuaugagaaucauaugaacuguugugucuggguagaugggaaaaggaugggaggaguaggacuugaacuauaucugaaaaacuauuuggaaagaaggagacuuagagaaaaaugucaacaucuguugauucugagugauaucuuuuauauuauuuuguguauuuuucucugugaguuuuuucugugagcauaguaacaccccccccccccaauauaaugggucuauauaaaaacuauaucugugggagaaugauggaaaauaguaccaaacuuuccagguuugauuaaccaaaauuaaucuuauaaaaauauuugcauuggcuuuccaugaucauuauaugaacuggguuucccagaucauuuuuacuuaaaggacgucauagucaccuuauaacuugaguuaauuuaauguuccuucaagcauuuuaauucucuuucucuuuaaucuucuuuugcuccucugaauucucauuaauuccucuacauugcagaaaacaugaaacugaccugucaaccaugaguguuacauauaugaauaauguaaaguucacucauaaauagggugugucuuaacaacuucuugauaaguuuuuuagggucuuacauaaagcugcauucccacaaaggaaacggcagcgugguuuucccugcucauaccucucauaccuucugcuuguggugagaggaacucuguucuucugcaguuucuccaaugcuuuaguuauuaguguugauaauucaggggaacaccacaguguggucguuuuggaaggaacagaucuugagaaucuaauaacgucuccacugaaaacuguguuuuuacauaaucucacauacaguuuuauggaguuugauuauucucacauacuuugucuuaugggccaaaaacuccagguaauaaaauaucacugcuguagaacauaaggauucugauuuuuuaaaaauuuaugucauauuuauuaacauacugauuuauuuccugccugccuuguccccaccuuacugaaaaauguauccuaauucauauguguccuguguuuguguuaaggaaaaaacauuuuuuaaagagcuuucuuccuguaaacacuauuaggcaccacaaacuaauuuuaucucaucugaaaguuucauaaauacauugugguuucuuuauuuggaucuuuaauaaggaggauggauuuaaacaggccacaagacaacuggaccagggggcggggguguugucauccucaucacaaauacuuugcaaguauuuagaacaaauacuucucagaauacagauuuaggcuaggcucauaucuaucuauaaaucauauacauauauaaacuaaauaacacauagaaaaucuguaugacugaacuacaagaaaauuauaagcaaggucacauagggcuuagaagaaauaauagauuacagaugauuaaaguuagcaguuuuucucuguuuacacuucaucauugggaagggcauccuuaggggcaacuaucauucuucuguacgauacagagacugccaggcuagagucacuggcaucucucugaguuguuucuguuuuuauaaaauggcuuuauauacuguuauaaacaauuuuguuacaccauuuugcuuaugaaagaucguuaggaauguaugcuuuucuauaagaaaaacuguuauacaauuguaacaguuuuaaaucaacaugcaugagccuauagugauacaaauaaacaauugaauggauacauggagagcagggaugcuuccugcaggagaauucuaaauaagacguggauacauacucuucccuacagggaguauaacuuauuucucccuuuaaguacaggcuggauuuagugacucacuuccaaagaacagaauauggcaagggugaaagagucauuguauaguggagaagccuggcaaacauugucuuaaccaaaugacccaaguuaacgccaccagcuguaagucauguugauaccauguaucccuuugaacaaugcugugagaagucacuucaucucucuguucuguuccuaaaaacccauggucccagucugaucaugaggaaagagcaagcaaauccaguugagggauauucuacaaaguaccucaccaccacuacucaaaacugucaagaucaagaaaaauaaggagagccugagaaacuuaaaggcagagagacuaaggaaacuugaugacuaaaugcaguguuguuugaauucuggagcagaaaaggaauguuaguggaaaaccugguuaaaucuccaaaugcagucuguaguuaauaguaauauacaaagucgacgucuuaguuuugacacacguaccaugguugcguaagauguugacagaagaaacuggguaaaggauauauggaacacugcaauucuuguaacuuucuguaaaucuaaacuuaauuguaaaacaaaaguuuguuuuuaaacagaugccauuuuauauauccuugauaccuaggaauuugguuucuucuugaaggacuuggggauguaugcuuuuaaucaguuuucuucaggcccuguuuccuacuugugaacccugauacaagaaggggaaagguuuuaaaaaggaggcauccaguccuauggaggccucuguggaaucuuugauaggcucugcuaagaagugggagcaagggagagcagcuuuacuauuuugauucuacauaauaggcagucuuaaucaacuucauuguucccuuuaaauuuuuuaaaauucaguacugaacauguauauguuuacauguagguacagacauauauguguuugcauacaccacacaugcauaucaaguuuuucccucuagcuuuaauuacuuuuaagggacagggauagagaccugucugugacuugauuugacuaucacauggaauuuaugagugccaccaaucuuugcacuuuauuuccauguguguauguuauucagcugauaauaggaaauuuuuuaguaaguucagauuaggguuuuuuuuuuuuucguggaauccuuuuacgugaaaugugaaauagcauauuuuaaaugccuuaaaauguuuuucuucuucaguauuuuaaggacuuuucuuuauuuucuucccagauaaaacaauaaaauuauggaaaaucagugaaagggacaaaagaccagaaggguauaacuugaaagaggaggauggaagguauagagauccuacuacaguuacuacacuacgaguaaguacauaagaaaaaaaugucacagauagugcuuguauucauauuauauagcccaaauccugagcagagcuugaauaggaauaauuacagucuaucuccccuuucccaguaauucuguaaucagguaggacauugaguaacucauuuaaacauagaaacugaccuacauagaggucucacuuuggccagggacagaagcaggacucaagcacaagacaguauuucacgccaucagacuucaucucugguuugucauguuagcuaucacaaggucaaguuucaagauaaauuuucuuuggaaaucaaaaaaguagauacagaucaaaucuucuaguuguagcuaaaaaauaccaagaauuagauguuauggguuaauuuucuuuuuagccucuuuaaucugaaccauaaacauuuauuagcuuggcaugucuuucaagcaaaauauugaaacuaagaacugcaaauucuaauaguauugcaaccaguaaaagaagauauauuauccacauuguucauuuuuucuucagcacucgaaaggaucaacaucaguugcuuuuuaaaacuaaaucuauguaauauuguucuauuuuauguucucaaaaacugaaauaaugaaguuuucugaaucuuaauugcuauuugaaacugagccuuuuguaauuucuguuuuucaugugucuuauugacaggugccagucuuuaggccuauggaucuaaugguugaggccaguccacgaagaauauuugccaaugcucauacauaucacaucaacucaauuucuauuaauagugauuaugaaacauauuuaucugcagaugauuugcggauuaaucuuuggcaucuggaaauuacagacaggaguuuuaguauccauuugguuuucuuugguguuuggugaagaaggcauguugugcccauauuagauuuauuucaucucuccuaaugaauuugguugcuuuuuauagucuguguacauauauguauggcaccuuauuuuuuucuuuguagaugaguaaugaaauacuggaaaaaguuauuugcuaaacauaaagggcauaauguauugauuuaaaauuggauucauggaauuuuaaggaauuugucuauuguaucuauguaaauaggauuauuuuuuauaauuuagguuuuuguuuuaaaaaucacauuugugaggucuguguaugguagcuuaugccuguaaucccagcgguuugggaggcugaggugggaagaucacuugaggccaggaguucaagguuuacagugagcuugauugugccucugcacuccagcuuggaugacagagcaacacccugucucuaaaaaaauuuuuuuucuucuaaucaaauguaugaacuacuguauuugaauuuuuuauuguaaaaauagucucaccuggcugcggugacucagccuguaaucccagcacuuugggaggucaagguggguggaucaccuaaggucaguaguucaaaaccagccuggccaacauagugaaaccccgucucuccuaaaaauacaaaacauuagccgggcaugguggcgcaugccuguaaucuaagcuacaugggaggcugaguuaggagaauugcuugaaccugggagauagagguugcagugagcugagauugugccauugcacuccagccugggcaacaagagugaaacucugucucaaaaaauauauauauauagauuuauauauauuauauuaauugauauuaagauuagauuaagauuagauuaagauuaaucuuaagauuagauuaagauuaauuuuaagauuagaaaaagauuaauaauuagauuagauuagaaaaagauuagaaaaagaaagauuaaagauuacgauuagauuaagauuagaaaaagaaauucacgcaagucaugaugcaugauuggguaaauaaaaauauucuauugaggccgggcacagugacucaugccuguaaucccagcacuuugggaggcugaggcgaggcggauggaucaugaggucaggaggucgagaccagccuggccaacauagugaaaccccgucucuacuaaaaauacaaaaaaaaaaaaaaauuagucaguuguaguggugugcgccuguaaucccagcuuuucuggagacugaugcaguagaaucgcuugaaccugggagucggaggcugcagugagccgagauugcgccacugcacuccagccugggugacagagugaaacuccgucuaaauaaaaauuaaaaaaaaaaguuuuaaucccuuuggaauuuauacucauaaaaacaguggagugcaauucagaauuaauauuuuugcuuagguccaugaauggguuuuagguuugagaaauguagaauuauauuugcccuuuuuucuaaguggaaauuccuuaauaaaauguuaucuagacauuguggauaucaagccugccaauauggaagagcuaacagaggugauuacagcagcagaauuucauccaaacagcuguaacacauuuguauacagcagcaguaaaggaacuauucggcuaugugacaugagggcaucugcccucugugauagacauucuaaauguaaguuuauuguaucuuuccuuaaaaugauuacauauucuguuugucugaaauaagccucagacaugauaaguacaauuacagagguucaaagucuuaaacccguguguccagagccacuuguacccuugguaaucugccuaccuccucaugaggcauuccagguuauuccuggaagcucucuuggggggcaugucuauugauugccaaggaauauaucucucauggaaugcuguuguucuuugguaacuugcgguugggcucuguaaccuuguauugaaguagagcuguuccuuucuuucccauccucccuuccuacuuugagcuuccuaggaagauuucuucugagguuuccuuggcuuaaaaaaaaaaaaaaaaaaacaacuuugguuuaaaaacuucaggauacaauauucuugucuuguugaauauuaacucaugaaaauugauacaugccuguuaccaaaauaauuuuaccuggcuacuagaaaauaagauccugguaugaauuugggaugggcgaggaugguguguuucucauggugaugauacaggcagucagugaggcauauugcaggaauaauaccaauaaaccuggugcacugaagucagaagucccaggugagucugguucuaaauuagucauaugacuggaaguauacugcauacuuaugcaucuucaacuucaauauucaauuaaacuaagaagcuuucaggagaauucuagccagagagauguuuuucaguucuuuauuagccuggcauuuuaccucacuuguagggaguuugugaaugguuguuuaggaaaugcuuuguccaagccagaauauuguacaccuugcccuuuuuguguuguuuuguuuuguuuuuaguguuugaagaaccugaagaucccaguaacaggucauuuuuuuccgaaaucaucuccucuauuucggauguaaaauucagccauaguggucgauauaugaugacuagagacuauuugucagucaaaauuugggacuuaaauauggaaaacaggccuguggaaacauaccagguauuugaguuuuuucuuucaaugagcauauacccuguuuacuuugaaguguuuauagagaaggauuuuguuacuagguuuuaaucccuguaugguguuuguucaccauuaggccuuuucccucagagaucuaugaguauguugcucuuccuuauguuaaauguauauauacuuacauagguuguguugucucuugaguuuugcaguuaaagugugauuuugcuacccauuugguucaguauugacauuguuuuuuuuucugccacuauguacauuuaaagugaggauggaagagcacccuucauugaggucugggcaggaagaggauuggagaaaguggccaguccuuaguagaggugcaccugcucagguugugggaguaguugaacuagagauuaaauuuggugugccaagucaaauggacugguguucugccuuuuggcagauaacuguugucuucagcuaaaagaaagggcuugaaagccuuagcagauggcuuuaggaguugccuauccguuguuggaugucaguucuugauucucuuaucagccagccacuacuguuuauccguguccacuacaucaaacagaagagaaugaaguacacagccuggaacagggugagggacagcacaaaccugugcuaggcccuagacugcaguguugaaaucacuuaacucuaauuuauacauauacuuucuuuauguuauauauucucaauagacugggaaguauguuucucaaacuuuaaauccucugacaaacauaaacgaagauuguuuuugauacgugaaauuucaaaauaaauacugcacugaaacaaaagacaaaauacugcuuugcuuuucaaaguauaguucacuauugagcaacauggauuugaacugcauggguucacucauacacagauuuuuuguuuuguuuuguucaaccaaugcacauuugaaaauacaauauuugagggaugcaaaccccucaaauauauggagggccaaaacuucacguguggguuccgcagggcuaacugcagauuuggguauaccugggguucuuggaacccaucccucguguauacugaaaaaagacuucuauuuguguaacugccaagauugauauaucuccuaguuacccucaccaucauuucauucccauugagaagaauugauuugaagcuuagcuucauacugauguauagugagaaacucuauaaugugcauucuaaaauguugcuaaauuaugauaaucuaccuaauuuuaccugauuugcuacuuuucuacuuauaaacaguuggaguagugauuaaaaguagucacauuauaggcaaauguaucauauauagauaaaacuauuuuuauugaauuuguaccagcaucuugccaaguuuugugugauugaaggguauuuuuuucuuacugauuuuuuuguguuacaugcucacuuuugauccuaaccccacaugaguugcuauuccucuguauuacagauuuucacuuaaugucacagagacauggccugaaucauuccacuauauuuaaaguuaaaauagacacugaaaauaaguuuagauuguuucauauagaauagagaauucuaagcauuuagaagguaccuucucauuucugucauuucuccuuaaguagcuccuuaaaaagagauggugaaauauagacacuuccuuuuuuccuuugaguuacaacaaauacuuuggaacuuuuguuuguaauuaauauuaauguugaaauaugucauauuucucagacuuuuuaaauaugagauuucuaguuuauccuuuuuugacauauuaguaaauacagaauuauauaauucaaaaaacaggcacagcuuuguuagcuuuugacauuguauaauaugauacuaucaaauuuuuaauaauauaugcccagaauaaccauauaauuuaucaccaaaccaaggcaugguuacgcuaugcauacaugugcauuuauaauggaaaauauaggcuucaguuaaauuuaugcccagaaaaugguauuuaagaaagaaauaggcacaguuucaguguuguuaucaguaguuaauggacugaaagccaagaauagugauauucagauauugcuauaauguucuuuuauuagucucuuaacugugccauuuucaaguguuuuuggccugaauguuuuauucaggcuuauaaaggcuaugugugccaugcccagaauggaguuuuccuuugucauaccaguaggaaaauguaccucccugaagggcuuguguguuuuguaaaaggacaaaaugccuuuauuguuacugagaagauugagauuaauagguuuaaaagguguguguaugugucuguauaugcccuuuuuuucuuuuuaaagauauggacuuguuaaaucauuuuccuaauuucagugcaguauauuuguauuuuucccccaggugcaugaauaccucagaaguaaacucuguucacuguaugaaaaugacugcauauuugacaaauuugaauguuguuggaauggaucugacagguaauuaagucaaaccucucaaauaugaauuuuauuaaagaaaagaaacaacuauuucauuccagguccuaacuucgucucuagggauuccuugaaauaaauuuaguaauuuuagauauagcacagcaguacugguagauaaaaaauuaaagcauuguauuucacuaguaaauauaaaaguacacaaauucuagguaaucuaaauuauuuaaaugucuagaauuuuuuuucuuuuaugaaccagaucacauuucugacaugcuaaccauuaaaacggugaagcuucagcuugguuguuauucuuccauuaaacuguugcagaaacauucaggcggcagauaacucauuuggauuguuagaaacaccagguuuuccagaugcuacauuaacaccucauagaaguggucuuucauauguauguuauguaugauguuaaccauaauauauaugguuaaaauuuuaguaguaguuauccuuugcuuuuuauaauuuccaguuuugccguaguguaauuccuuuuucguauucauuuuuaguaaaauguuacccauuauuuaaagauaaaauaagucuuacuuugagucuuuuaguugucuauuugccacuauguuccaguagaacagaaaguaguaaaacauaauuuuggaauuaaacugacauuuaaaguaaucagagauacuucaacaacaguuuuaucacagagcuuaauaugauuccgauuucaugguguuguguguuacagaggauaauagaacuuauagaauguuuucuuucaucuggcuuuuaaaauuaucugauuuuugacauaaggacuaguaaaccuagaguucuguuaauagcaaacauugccuuugagugcuacuacuaaaccugaggcaucaagaagaaagaaggaaagggaagaagaaaaaaaagauuaacaaauuugaagaguaaagagauacugaaauaagguguggcgcacagcuacaaccaguuuuucauuguauuuaagcagauaauuagcaguuuuauguucuauuaucagaaaaaaacgauuuguuuuccuuaauauuaaaaauuuuuuuuuaacuauuucaaacuuagagaaaauuuguuagaauaacacaaagaacucuuggcuggccuugacccagguuccccugucgcuguuugcuguaucacguguucuauucucuguuuauuuauagcuauauuuguccacauagguacgugcgcaugugcucacaugcaacuugugugccacaugggaauuuauuccauuuacgccagaugugaugcccauaacccuaaauucuugaaugaguauuuccugacaaaaacacuuuccaacauagugacagugcagcauccaaagcaacauucacagcgaugcaguacugccaucuaauccggagacccacugaaacugaccaguuacuguaacuauguccuuuauggcacagaacaaagucagucugguucaguauccagcauuuaguugucaucucuuguuagucuccuuuauucugaaacaguuccucagucucuccuugucuuucaugaccuuggcauuuugaagaacacaggccaguuauuuuauagaauguuuccucaugauuagauucaggcuauacauuuuuggcaggaauaccacagaaaugcuggccuaaugauaccuuuuuaaaguuucaaguagccacagccuagguguccuaauacauuaaaaccacgcaaacucagaugauauggggaugucaaucuaaauuacacaagccauuuuuaaagaaauacaguuuugucaucuucaggggcacgcauuaccuugaguuugauuaaaguuguugccaaguguccuuugggaauugacauuacuaaauagauaauaauuuguacucaguaggugaccuuuguauguaaguauuacuuugaacaauuccccaguauccuguaauccuuauuuacaauaauaauuugaaccauugguaagcagcgguagcagacccuuuccaaauuaagagcuucaaacuuacgaaguuuuguuugugaggauacuuaauaaaugucgagcaguaauggguggcaaauagaacugacaaggaagugucuugggcaguuuaaaaauuuugccaccccuuuaaacugauacuuuuauaaauauuugcuuaaaauguucuaagugguaaaaguaaaaugauguucuguuaagaaaauauuacagccugggcaacauagcaagacccugucucuacaaaauauuuaaaaauuaucuggacauggcagcauaugccuguagucacagcuacucaggagacugaagugcaaggacugcuugaacccaggagguugagguugugguugcagugagcugugauugugccaccacauuucaacccgggugacagagugaaacccugucuugaaaaauacauauauauaggccgggcacgguggcucacgccuguaaucccagcacuuugggaggccaaggccggcggaucaugaggucaggagauugagaccauccuggcuaacguggugaaacccugucucuacugaaaauacaaaaaaaacuagccgggcgugguggcggacgccuguagucccagcuacucaggaggcugaggcagaagaauggcaugaacccaggaggcagagcuugcagugagccgagaucgcaccacugcacuccagccugggcaacagagcgagacuccgucucaaaaaaaaaaaaauuauacacacacacacacacacauuauguaccacuuaauauucucaggagcagauuauaacauaagcauuuauuaaaugugauuaucugaaccagacaauacccugagaagauuauuuauuuaugagacagagucucacucugucacccaggcuggagugcaguggcacaaucuuggcucagugcaaccuccgccucccggguucaagggauucuccugccucagccuccugaguagcugggacuacaggcacgugccacuacacccagcuaauuuuuuuuuuuuuccgagacggagucuugcucaguugcccaggcuggagugcaguggcacgaccuuggcucacugcaagcuccaccucccggguucacaccauucuccugccucagccucccgaguaguugggacuacgggugccugccaccacgccaggcuaauuuuuuuuguauuuuuaguagagaccggguuucaccauguuagccagaauggucucgaucuccugacgucgugaucugcccaccuuggccucccaaagugcugggauuacaggcgugagccacugcgcccggcccaaaaaauguaaaucauaagauaaagcauugguuucuugugaacagcuacagcuacuucaugcgggguucuuuuguuuuagaaccugugaguuccacagauaguugcuccuuugagaagcuggcuggccugguugaucacauagccuguaguugcaaaaauacuuaacaacgauaauucugcacuccuaagaaguuuuacuugaggaugcugucaacuuugcugauaguuuugguagccauaaaaagaauaagcagaaaacccaguuaauuaguaccguauuucugguuuauucuagugauugaguugaugucaacagccccugucccuuaguuuaaaucugcuuuugaaguagcuuccuaugguuuaauugccgaaucauuuuacuugaaaacaauuucuuguucugcuuguuugacugaguguacugucuauuuucacaguguugucaugacuggaucuuacaauaauuucuucagaauguuugacagaaacacaaagcgagacauaacccuagaagcaucgcgggaaaacaauaagccucgcacaguucugaagccucgcaaagucugugcaaguggcaagcgaaagaaagaugaaauaaguguugacagccuagacuucaauaagaaaauccuucacacagccuggcaccccaaggaaaauaucauugccguagcuacuacaaacaaucuguauauauuucaagacaaagugaauuaggguuggcauuccuagcagaagaacccacuuccugcuuaguugagauaguugaaucuagcauucguuccuauaaaagagagagguccauuguggcgccccuuuccaguguuugacagugugccauucgacaacacauuguuauagcuacauggagaaagcucuguggauucaucacugugguguucuccaugucugcuagccauuuagguaaggguagggcacuuuuaauuuaaaugacuucuugcaccaucuugccuaauggacuagauuggacuguaucaacauugauuuacuccacuuuuuaugccuuccauugugaugacgucaaacacagugaaagccuucagucaugcuaugggauuuaauuguguauccucauuacuguaucauuugugggguacaccccuucccccuuuuuuuaaauuaaauacagcucauucuuacuguggcuuguagcauuccuccucuucuggccuccuggacugcuccccuucaucucuuacccuugcccccuccacccggucuugguggugguauauuaaaaaaagaaagaaugaaagcacacaaaaugagucaguuuggggucagugguauaaaggggguauauguugcaaacaaauguuuuaguaacaguuggcuguaaucacuccucgccgugucuggcacugaaaauaaggaaaaaaaaccuacuacugaauaaaagugacaaagaauggagaaucugguuuucuuuuucuuuuuaaccuaccucuuguagccaauauuuugugucauaccuuugggcacagugaaacaaaauggguuuucauuguuuauugguauuuuuguuaauuauuuuuaacaaguguucuuuuacaugcaggaggagagguauugguucucuaugaacauauuuugaauauagguuuuauuaaggauuucacaaucuauaaaugcuacuaguuuuuuuuuuuuuuuuuaccaucaugaggguauuggauacauugugucucuauuuaacucauuauguguuaaugaaauuguuguaaaugggaaccaaauuuguagaacuuaauuucuacuuuuuagagugcuuaauuucauuuuugccuuacuaaauagucaaagacuuauaaaacauuuuuaacaaguuagaacuuuuuuguuauucagucauauaaaauagcagaaaacuaacaucaagugacacugcacuaaauacuuuuuuuguauuuuacugcuaucaaaucagaaugaaauauacuuuaccauagauauuuuucuucuauuuuugguuuuccaaagcuauaugaaagacaaauuuuuaaagguacagcguucaaaaagugcuuaaugaacuccaacagcugccucaaauaaaaaucuguauaugaauacauuuucccuaagcggugauacauuauccaaagaugaagagugcuccuauuuuuaauagguagaauguaccuuugucagucuugcagaaacuuuaauggagaagaaauggacuuuauuuuugaaaggugaaaugaacaggcauuuauauuauuagagaaugguagucuuauuuugguggaacauaauguaacaaccuugaauuucagaggacucugagugcuucuauguccacuaccuauuguucuauucuucaauaaugaaaaagaauucaacgagccgaccgugauucccucuacuacaaauauuaugucuuguaaguuagcauuuuuagcacacaggagaaauuuuauguaauaaaauuacuguaucuuuuggauuuaacaaauuuguauuugaaacacauucuaugucugauaauucuuaauggcacuuuuacuaauuuauuuggggaucuuggguacauucuuaauuuguguuuauucuucacgcuugacuugcaagugggauauuccccugccacaagugucaaacagugauauucuuccuguguugugacuggacaguuuuccagaucuuuuuugggagauuuuccuacagcuugguuguaugucuugagauaacaccaccaaacagcucucagaaauucuuuuuugauugaucaguagcuaugaugauucuccuccaugacacuaaggauuaguuuauauauuuaagagaaauaauugcuaaaauuaaaaugccucuaucaaggaaugcuauuauaaauuauuguuaacauucucaaguauuaauuuuuuaauuucauugguguagcaaacucuaagcccagccacucauuuuacauggccaugguuaaucuuuuuauuaauaaaaauuauacuuagaauaa

SEQ ID NO: 192511 - RNA, 24661 nt, Homo sapiens
uagggacccaaugcaaccuuuuaauuccaagcagagucccccucccccagcauggucacacacacaguggaaagggaugucagggucugggcaggagcaauacccagaccugggcaaaaauauagauaucauuauauacacacguggacuggaaagaagucaagcuggggguguaagguagggcaggggcaggugaggaaagcagcugggggggccccaauaaauuacauucuugagagagcauagugugugggggggugcguggguguaggugagagcugguagccaggacacuccaaaaugugccaggccuggccucuugaccccauccaagggaggcggaaggcccagcuucugcccggugccuggcuuagugcuggaauucccauuucguggccuggaggcagguggagggccaggaucguguguaggcggcaucuccacccuaagcccaggcuucuggggaagccgcagggcuggagcaaaaggcuuggaagcucgggguuugcgagcggaggucagggcaagcugaaguggaggggugaccucccugccggaggcugagcuggggccuguucccacuagagucagaggagcaggaggcugcagugcaggaaagcugucaggagugaguaugggagggcugggugggcgacacaagagccuggagcucuuucugccuggccgcuucccaccccugcaucuucccuccagcuguucaagacagccaaccggccuaaccaccaaugccccucauuccuccucacccucuggggugaggggcagggagagggcgcaaacaugaacucugugugccagagcccagacuggcuuugcccugugcagggagggccagggacgagagcaggaggcccccagccuugugagggggaagaaaguccauagcucacugccggggacugcagagguuuuggccccccacucuaccugaggaaaggagcccacccuauuuccaccccaccuccugccccucccaacccgccggggaaaaacccugaagcagcagggguaagggggccgucccggagcaggugggggccaucagaagagagaggccuucuucuugagcucauuccgcuuccacagagccagcuugccaaacucuucaggggacauggcaaauacccuugagaaguccucggcagacagaugccucuacaugggggaaucggggcagcucagcauggagggggagggggcugugcccagugaccuaggggacacucacucauagaggccccagaucuucccccaggcaggagagugcccguggacagccccgcacccauccagggcaucuuccuugccuaccucaagccgcauccgauccacccccgguggcagcuugguucgccccuuguuggucaccacuagcauuucauagggauagaucuggggguggggggaggggcaaucuuaggcucacagaauauccuguccuucgacucccuaggccucccacaucaaccugcagaggccacugggguucaugccaucuugcccucugucucccccaacuucccugccaucccucccaucuucaacaccaggaagaccccgcagcacauuccacuugccuggcaucuccccagccucccgccccgcuacaggcgcuuguguccccugccccucaccuucugcuccagcacacagggcagggaguucccccgguccauccucccccucuggcccucuccguucuggggagaccaaagccgcagugagccagagcggggcagggagaccuucccagccuuaccccggcuucuucuucuucaccaggcaacucuguggccccacaccccccuuccccugacacuuucgggugccaggacccagcuucugcugcucugccuguuccccuccaggaggcacucaccugcaggccugcgggagagaaggggcaugggucagaugcagcucugaggucagcaggccaacacgccugaccucaccagaccccugcccacagcccagaccccggcugcccagggaccuguguaagccccuucuccagaccccggcaccaggccccacuucucaccugggcuuccagucucacucccugaugggcugaacucuguggacuguagcuagaaaggacacaaaggaaucagaggcagucggggauauucaccuuugguccccuucacuuugggggucuccccgcucccugagggugcccaaguggcucagucccucagcaccccacaugcacguuccucccacguagucuauaucucugguccugagaccuuacccggcucagggugguccugccauaggcggggagagaggaagauuuagacguucccuggugcaaggcuggaagacagcaaaagguccugaguucagucccuuuggcccugacagcccuuccugagacagcaaccucacuggccuuccacagcuggggcagggcaggaagggaucacgcuggggggaaccuggugggcuucugcuagcucccagcuccuacuggucaccuucagcaagcaauacagugcuggugguucucagcugucucuaccaccaucccucuucucuccagcuagaaguggcccaaauauacaacugggcccaaugccugaugugaaaauugagucagccagagccaaggcucacaucauaaaaugaaccucugggauacacaaagaaaacuaaaaucgaaucacaauaauuacauuauuauaauuuuauuaacaauguuaguaaucaaaucuaaaaaaaaaaaauuuuuuuuuuggccaggagugguggcucaugccuguaaucccagcacuuugggaggccaagguggacagaucaccugagguugggaguucaagaccagccuaaccaacauggagaaacccugucucuauuaaaaaauacaccgugcccggccaaaaauuuuuaauagagauagggucucacuauguugcccaggcugaaccugaacuccuggacuuaagugauccuccugccuuugccucccaaguacuggagcuacaggcaugggccaccugcucagcuaguauucauauuuguuuguuuguuuauuuauuuauuuuugagauggggucuccgugugucauccaggcugaagugcaguggugugauuauagcuuucuguagccucaaccucccaggcucaagugauucuccccaucucagccuccucaguagcugggacuaggggcaugcgccaucaaacccagcuaauauauauauauauauauauauauuuauuuauuuauuuauuuauuuuuauuuuuuguagaaaccaggccucacuaugguacccaggcuggucuugaacuccugggcucaagcaauccucccaccuuggcuucccaaagugcugagauuauaggugugagccacuaugcuuggccuaguaaucaaauuuuaaaagucugacauuaggcugggcacaguggcucacaccugugaucccagcauucugggaggccgagguggguggaucacgaggucaagaaaucaagaccauccuggcuaacauggugaaaccccgucucgacuaaaaauacaaaacaaauuagccgggcgugguagcaggcaccuguagucccagcuacuugggaggcugaggcaggagaauggcgugaaccugggaggcggaccuugcagugagcggagaucacgccacugcacuccagccugggugauagagcgagacuccaucucaaaaaaaaaaaaaaaacagucugacauuauacuacagaaagagucauguucuaagcacugucacuggggauuguaccagcagucaacaacuucacaucagcauuacuggaccucagucucaacuugcacauuuaauaggaucucuaaauucugaaguacuacagauuauaauucaggaaaauuuguuuccaguaauauguuuuccuggaaauaacuuuguaccuaagauccuuagcuugaggugaucucaaaaugccuucaccuccaauugcuggaaauggcuggcauuuauaccaacuguuuccacaagcauuuuuguauaaauaguuaaccuccauagauucaaaacuaugaggaacuaucuuaauauauacauauauauguauauauucacauauauacauauauaugaauauauguauauauguauauauauauuuuuuguuuuuugauacagagucucacucuguugccuaggcuggagugcagugguacagucuuggcucaccacaaccucugccucccaggcucaggugauucuccugccucagccuccugaguagcugggauuacaggcacgcgccaccaugcccagcuaauuuuuguauuuuuguuagagacaggguuucaccauguuggccaugcuggucuugagcuccugacuucaggugauccaccugccucagccucccaaauugcugggauuacgggugugagccacugcacccagccucuucuuaaaauacucuuaugaaaucuguugcuuggaagcauucgauuauugagaacaaaaccucauuuuuaccccuaacacuuauuuuuauuuagaaaauagcuuucacaaucaccauucacuauugaagcauuucacucuuagaauaauaaguacacauuuauucaaccaacugauagaauuucaaccuucaaacccugcacgaagauuuuccccuccaaauuacuucuauuauaaaaugcuuacguguguuccagagcgacuauuccagugucaccauuuaaucagaaugacaugccuguucaugauucuagaauucagguuguuuaaauaugacaguaaccuaugcagucaugugaucauuaaucacccacaaguucagggacgccaaagaugauccagagguaggcaucuggcuauuucaacuucacgaggccaaaauggaaguuaaagagcuaaucugggcugaacagaagauucuggcagaacacugacacugaauccaaccuucacgcauccucucuccacaucauucuuuaggccuuaacucuuuauuccacauucucuaauaaaccucuguagcucuucccacccacagagacagcauccugagagcucuggggaacacucagauguccuaaccacauguuaaccuugaauuccccaguuccagugguuuucaccucugcuccacaugagauaacccuuucaaagagccaugcccaggaucuugucaucagcugcaccacgcugccuagaaacugugagcuuggaccauucacuuuguggcuuuggcucagcuccauccccaccacccagcccagcaaccucauggagaacuccaguuucuucauuccccuccuaccucccccaccucccaccuucugucacuaccuucucaguuucggcucuguggcugggcacagcaacuacuuuuaucagcuccuccauggugcagccuggccccucagcaccuauccuuaaaaacgcuaacccagggucaacccaacagcucccauccugcccccagcuguggacauacagcccacacaauguagaugagcaucacuacaaaggccaagccucgcacguuucuccuccccuccacggcaguuccaaacccucgccauucucaccaagucucacccucuaacgcucagcagacaaccucggcuucucaucuggccugccccuggauccaaguucccaucccacaggggaggccuuugaaggccagccucccacacauucuggggcucgaucucaaccaguccucaaaccagcccucuaauauauauauauguauauguguguguguguguauauauaugucacccaaaaaagaaaaaauaggacacccaggugucacccaaaauaguguguauauauaugucacuauauauauaugucacuguauauauguguauauaugucacuauauauaucguguauauauauauauagugacauauauauauacacacacacauauauacauauauauauacaauuagagacaggaucccacucugucacccagguuagacugcaguggcgcaaucauagcucccaucuuagccacccaacuagcugagacuacaggcacaugccaccacucccaacuaauuuuucuauuuuuuauagagacagugucucacuacguugcccagacugaucuugaacuccugacuugaagcaguccucucaccucagccuuccaaagugcugggauuacaggcaugagccccgacuggaccuuuaauggaagcccuaggcacccuucccuccucucucuguacaaucuuacuuucuccucaccauuuuccugccacauaugagcaagcugaagacccucaagcucccaacucugccagaugcaccuuccacccacagugcuguacauggggcacuucaaaccccacauguccaaaaccagucucucaucuuucccugaaaauccgccucucuuauuaucucaguuccaaguuggucaucacccagcacccaagacaaaaaccucagcuucucucucuugcaccucccacguccaaucagccacuggauucgauccagcggauucaauugucuauauguucucaaauccauucccucuucucuggacccacaucguuuuuuagcccuuauccagucuauuggagagugugguagauuauuuccaaagauggccugcacuguugccucccaucuuucaugcuuucugcaaugagaccuugugguaccugucaucaagaaguggagucuuggcugggcgcagcggcucacgccugcaaucccagcacuuugggaggccaaggcagguggaucaccugaggucaggaauuugagagcagccuggccaacauggcgaaaccccgucucuaauaaaaauacaaaaauuagcugggcaugguggugugugccuguagucccagguacucgggaggcugaggcaggagaauugcuugaaccugggaggcagugguugcagugagccaagaucacaccauugcacuccagccugggugacagugagacucugucuaaaaaaaaaaaaaaaaaaaaaaauuuagcugggcaugguggcaugcaccuguaaucccagcuacucaggaggccgaggcaggaggaucauucaagcccagaagauagagguugcagucagccaaaauggugccacugcacuccagccugggcaacagagcaagacccugccagaagaagaagaagaaagaagaaagaaaaaagaagaaagaagaagaagaagggggagggggaggaggagggucuagcuccccuccccuugagucuagguggccagugacuggcucuggcagcuacaaugaagaagugacacuaugugguuuccucuuaggcuuuuuucuuuuuuuuuuuuuugagacagagucucacgcuguucccuaggcuggagugcaguggcuccaucucgacucacugcaaccuccaccuccuggguucaagcaauucuccugccucggccuccugaguagcugggauuacagacaugcgccaccaugccuggcuaauuuuuguauuuuuaggagagacgggguuuuaccauauuggucaggcuggucuugaacuccugaccuugugauccgcccgccucggccucccaaagugcuaggacaacaggugugagccaccaugccgggaccccucuuaggcuuuaagaggcuuugcagcuuucauugcuggguuuucaggucuuccucuccucuccagccgccaagcucugaggaagcccaggguagugcgcuggauagugggccacgccauucaaagccugccccgcuccccaucucuuggucucacugcccacugccccacaguguacccuguacucuguaauuccagacuccuggaggcucagccagccagauguuucauguucccaauuucgcucccacaccauucccaaugucugcaaugcgcucucccacucacuuuuucuggcuugcuuggucucagccuucaagacucaguuuaagcuggacgcggugauucacaccuauaaucccaacaguuugggaggccaaggcgggaugauugcuugaguccaggaguucgagcccagucugggcaacauugugagaccuugucacuacagaaaauuuuaaaaauuggccaggcauggugacgcacaccuuuaaucccagcuacucagaaggcugagguaggaggauugcuugagccugagagguggaguuugcagugagcugagagugcaccacuguauuccagccugggcaacagagcaaggcccugucucaauaaaacaaacaaacaaacaacaaacaaccacaacaaaaccccucaguuuggccucccaggcccuguugcugugcucccaaagcaccccgcgcaccuugaucacaauaccggccacacugcaucgaaaucccacguuccaugacaguuuccccgccaacagcaagcuaccagaggacaagacuagauuuuuucccugcuuauaugcccagugccuagcacaugguaaacgcucaauaaaugguuguuaaauuaaaccaaacuugcugaauucuauuuuagccgauucucucauuuaucaucugacauuguuccaugacugggauucuugcucccaagagagcagccgugcuuugggucagggauugcauccuguaugugucacaagucaacagaugcacagagucaggccuccaucucuggccaggugacucugagcccccuccacagcacucacagguauggaaggguguccggucaggcagagagcggguuuuccuucggaucggcaaugacuuuuccaucucuucuuucaagaucaucuuucccaaguuggaaguaaccugaggagggagaaaggaagauggagccaagacuuagacacuugaauguuucuuuuuucucuuuuuuuuuuucuuucuuuuuuuuuuuuuuuuuuuuuugagacagggucucacucugucacccaggcuggaguucaguggcacaaacauggcucacugcaaccuugaccuccugggcucaagcaauccaaccuccucagccuccugaggagcugggaccacaggcaugcaccaccacacccagcuagcuaauuguuuuuuuuuuauauacagaugggguuucaccauguugccuagccuugucucaaaauccugggcucaagugauccuccugccucggccucccuaaguguugggauuacaggugugagccacugugcugggccaauacucauuucuuaucucuaaaaggucuagaguugggccaugcugcaggcaggacugcggacauuucccaaguggcugguuugugcccuggagcucacagagccucuuguucguggcugacacauggccacaauggguuuggccacccuugaaagccaggagucagcgcugcuugguagaacucuaccacggcggccucccuguccuugucccaggucacccugcucagagccuaggcccaugucacugucaauggucuuuccaugguucucccuccuccccuggaggccuguagcccaugcucuccuuuucucuccucccauggaucacucaggcugcuagcucccagcucugaugggaccacccuuuucugugcuuuugacccuuauaucaaguagugucccccagaaagcagcauaaaguccaggugucccuucaaaagcaaaauccuggggucuuggcaagaagcggcuccccaacauguuccaaaaagcaugcuuuucggguaggaaccccuucgacuagcuacagagccagaacuucuguccccagaaagacacacagggugggcugggcauaguggcucacgccuguaauucaagcacuuugggaggccgaggugggcggaucgcuugaggucaggaguucgagaccagccuggccaacacggcaaaaccuuaucucuauuaaaaauacaaaaaaaaaaaaaaauuagcugggcgaggugguggcgugccuguaaucccagcuaugcaagagguugaggcaggagaaucacuugaaccugggagcggagguugcagugaucugagaucaugccacugcaugccagccugggcaacagagcgagacuccugcacagggguggaggguggggguggugagaugcuaccuuacugaguuccucucucugacgcucccugagagccuucaucuccucuccagagucgucaucuuccuccuccuccucuuccucugcuccccuccgagacgccuuccgcuuccuccauucugucucuaggagacacaagcaaagguggggagggagucacucgccauggggucaguguguguuuacauggcacagccucugugcacugcucugggcuggaccuugauaaggccacuacaaaauuuuuuuaaaaaauaaaguagggucgguagaugacucaugccuguaaucucaacacauugggaggcugaggugggaggaucgcuugagcccaggaauuugagaacagccugggguaauauagucucuauagaaaauuauuuuaaaaaauuagcccggggugguagggcaugccuguagucccagcugcuggggacacugaacuagguggauugcuugagcccaguaauucgaggcuacagugaacugugauggagucacugcacuccauccugggcaacagagugagauccugucuuaauaaacaaauaaauauuuaaaaauaaaaauaggccgggcgcggggacucacgccuguaaucccagcacuuugggaggccaaggcaggcggaucacgaggucaggagaucgagacaauccuggcgaacauggugaaaccccaucucuauuaaaaauacaaaaaaauuagcugggcgugguggcgggcgccuguagucccagcuacucaggaggcugaggcaggagaauagcgugagcccgggaggcggagcuugcagugaaccaagauuaggccucugcacuccagccugggugacagagcgagacucugucuccaaauaaauaaauaaauauaaauauaaauauaaaaauuagccaggugugguggugggcaccuguaauccuagcuacuugcgaggcugaaacaggaaaaucgcuugaacucaggugguagaaguugcagugagccgagaucucgccacugcacuccagccugggcaauagagcaagacuuccugucucaacauuuaaaaagagagucaggcaugguggcucacgccuguaaucccagcaguuugggagacaggcggguggaucacuggaggucaggaguuugagaucagccuggccaacauaaugaaaacccauaucuacuaaaaauacaaaaaauuagccaggugugguggugcaugccuguaaucccagcuacucaggaggcugaggcaggagaaaugcuugaacucgggauguggcgguuguggugagcuaagauugugccacugcacuacagccuggggcaacagagugagacuccaucucaaauaaauaaauaaauaaauaaauaaauaaaauaaaaauacaauaaaauaagaguaacauuuucucaccuugccaugaagcuggguaggcaacacacacauacacacacucaugacugaaauucagugggugcagcaacaugaauggaacuggaggccauugucuuaagucaaacaagacacagaaagacaaagacugcauguucucacucaugagugggagcuuaauaguguguacgcauggauguagagagugggaugauggaccauggcaacucagaagggugugggggguggugaugggaaauugcuuaauggauacaacgugcaguauucagauaacaauaucauaaaaacccugacuucaccacugugcaaucuaugcagguaaccaauuacaccuguaccccauaaauggauaaaaauaaaaauuaaaauaaaauucgcuggggaccaaaccaucuaucauuuaucuuucucuuucccagugcuccccucacagagccugggaugcagaaguuugauacaugucuguugagucaggaaauaaaugaauggaaagcaaaugaaugaccaauaaaagggccacuuacaccaagcgcuaugggaacacagagagugagugagcaaggagccugggggcuccugaagguaggaaaaagcccacgaggacaccauagggcaggggugggaguggguucacggacugcagcaagagccaaggggagggagugcaggaguuucccagaccacccauuccacucuccccaucucuccuacccacaacagccagagacggggggcauggccaguagucgguuucgauuuuggcuggcugguuggggucugggggcugggcugcaggaaacuuggaugacucgaugaugagauccucgaugaggugcuuggucugagggcugccucccacggacucugcagacaaaggccagggucagccaggugugcccugcccgaggccaacuuggcuaccuucaccccuccccccucacaccugugagguccugcagguaaaagcaguguacacgcugagcacggggcacacgugcugcugugacaugcuauccucccgacccccuccagccagcccgcagccccagggcacggccucccagcaugcagccggaagcaggcucuggugagccaggggcgcccucaccucucugcuuauagaugggaggcuucuuguagauguuggaaucugggcgggaggucucugugggaggaagaacagaugaggaggaggacaugcugauggcagggaggcuggggccaggagaauggagaugauggaacgggacaagguggggaacucacuggccccugucaagagccaagacagggcuggcauuccuggcacugccccucagggguuugggacauuuuacacuuuuccggcugggggagagagaaaaagugacaggucucccaucucugggagggguccuggccuccuggggccuacuuagcccugaggcgagcauauaccccagagagugggggacugagcguaaggggauugggguuccugauggagaaagucuuaggaaacaaugaggucgugccgagaagaccuaccagggugguggaaauggggcaggcugguccgggggguuccagugguucugggggccgaggccugagagaugauuccaggcgaccggcuguccgcccacaccugcagagcagaagcguguggcuccagggccccuaacccccuccaacccacacaugcaccccaucagcucacaccacccucucuguccucccauccuggccggcugcaucccuccaaacccagggcaauguuguggcacaguuccaaggaccuacugauggugccuggcccagggagaaaggguugagguccuggguccgacagaaugauggacacagagcuggccagugacagccagggggccgcugauucgggcacucccugggcucugcagagcuuggucugaugugugaggggagggaguuaggauccccuucagggcagggcagggcaaguugcagguguggggcagacucaccucuggggauggugggggggauguggauuugggugacagcgagcgcugugaauggagagggggcuggucagagcuacaggggcagauucagccucuucccuagaauuccagagaggccaccucaucccccacccaaagccgcacacuuuccuggccagcuucugggccaccucugcuuucuuggauccuucccacaguucccugcacaaaguccucagccuucccacaggaggcacagagaagcacgcgagccuugcucaguacuccuggggcuccaagggcacucuuuucuuccuuccuuccuuccuuccucucuccuccccuuuucuccucucucccgcucucaucuuucuuuuaauuuuuuccuacuuccuuuguccuuuuucuuucuuucccugccuuccucccuuccuucccucuuuccuuccucucucucuccacuuucuucucucuugucucuuauucuuucuccucuaucccucucucaucuuucuuucuuauagucucacucuguugcccagccuaaaugcaguagcucuaucacagcucacugcagccuccccuucccagccucaagggauucucccaccucagccuccugagcagcugaaacuacaggugcacagcaccacaucuugcuaauuuuuguagagaugggggucucccuguguugccuggacuggucucaaacuccuggccucaagugacccucccaccuuggccuccaaaagugcugggauuauaggugugagccaccgugccuagccugggaaccaguuggggaauaguuuguccuguccucagagccucaaaacaaauagaagagacaagaccaagaagcauccaaggaugaggucgggguuuaucacgcagguacugaagucaccccaugaucuagcccccugucacuggucagccacgacgcuacccugucuuggaggcaguugaugaguaccugccuugcacugucuccugcaccuucacuaccuugcgcguggaugggcagaaaggucaccucuauuuuacacgaggguaagcugaggccacaacaucacaugggucccuccgcuagacuuucagcccccgcucucaaugcuucugaacuguuuccacaaaucuugcucuuugugccucuuguguguugcugccauccaaagguguccaccccucuacaucugagccacaugccagcccagagaccguucugccugcucucuugaacaccggauggacugacugguugguuccugcgcacaguucccucucuuguuuugccgaggcagaccuccaggaaaggaagcacgggagggaucgguccccacccaguguggcuggggggggccucccccggaguccugcccaagaggagcccccucaccucgcggcugcgaggcagcuccacguguuccaggagggaauaagugaagugaggcucguagaucaugaggucgggccgcucgauguccaggauggccuuguccuuggggauggcagccagguccuuguagcccagcaccugauuguccaucuuggccugaagggaaaggugcgcgugaaacugcugugccgaaagccccgccuaggacacuggcccugcuagcuagacuuacgucaauuaccaagaaaauggaccgccauugcagacguuaacaauucuauuauuuuaagaaauuagucaccuuaaaacaugauaguccuuugccuagcacuucggauuaacgaggccagaccaguggaagggggauaugggagcuucucuggguuucuggguucucucugcccgccagcaccggagggaccaccacuggggaggcucugcgggaaggcacgcuagcagccaggggucccccacccuccccccucccagccagggguugcugguggccgagagggguacucaccacgaugcuggagggagagccaggcacacuggaaucucgggaggggcucacgcucccgggggagguaagugguugcuggggagagcgagaaggcgggcgggugggcacgugcgugugugcgggagcggggcgggggcggcccuaggccugggggacccggggcgcugcgcggcgcugcgcggcggguggccaccagguggcgcccuggacucccaagcggcccccacccgcccucggcggccccggcccggggcggcgccgcgcaccuucugcagccguuccaugcagcacggagcucgcccgccgggucacucgcagagcccugugcgcgaggggagaggacagcgugucaggcucggcgcggcugcugggcgcugcgcgcuuggggccgcgaaagcagcuggcgcguucccccgggcuggcgcguccucaucccucggcggugacucuccaggcugcggggagaagggagggaggccgcgccggggcggcguuaggcugcggggccuccgcgggcggccgcucuccaggcagccgggccccuugcggcugaggcuucccauccgcucagccccggagaacgcgcgcguggacgggaggcgaccgaaggacgggcugcgcuuguuuuugagccauuguucucuggcuucaaaggaaaugacggcaggggucagccggcugcccgggcggaggccuccacggccuggccccgccgcaccugcccuccccgccccggcccggccugcggcccuggcugaggcccuccccucccggccgcuggucccacucccgcucggggcacuguccccgccgccaccuccccgcgcucgcccaggaaggguuaacacagaggguucccugagcagcccggcuucugcaucccucauccaaaaccugacauccgcacuccgaaacuuugugagugccuaccaugacgcacagguggaaauuccacacgucagaacuucacacaaacuuuguuucauggaaaaaauuauuuuuaaaacacugcauaggucgggcauaaguggcucacgccagcaaucccagcacuuugcgaggcugaggcaggaggauugcuugaacccaggcguucgagacuaggauggacaacauagcgaaaccuugucuuuacagaaaaaauuuuaaaaauuagccaggcguggugcuggaugccuguagucccagcuacucgggaggcugaggugagaggaucacuugagcccaggagaucgaggcugcagugagccgagaucgcaccacugcacuccagccugggugacagaguaagacccugccucguuaaaaaaaaaaaaaaaaaaaaaaaaaaaaggucuugcucugucgcccaggccggagcgcaggggugccaucucgguucacugcaaccuccgccucccagguucaagcgauucuccugucucagccucccgaguagcuggaauuacaggcgugugccuggcuaauuuuuguauuuucaguagcgaugggguuucaccauaucggccaggcugguccugaacuccugaccucaagugauccgccugccucggccucccaaagugcugggauuacagacgugagccaccgcgcccagcccuaccuuccugcuuuugacaccuuccacugcucuguccaccucucugccucucaggugccuccagccuuccagggcuaucccaaagccgcuccucugggaggccuccuguacuagucuaguccucauggaucaacccuucucugaauuccagugguacuuaaaaacagaccaauguagcuaagcacuugauuacagggaacauguuuucucccuaacuagacagacugcuaaucgcaggagggugaaaacaacaauaagagcuaugugggaggccaaggagagaggauggcuugaggucaggaguucgaggccagcccgggcaacauagggagaccucgucucuagcaaaaauguaaaaauuagccagauguagugauaugcagcuguagucaucucagcuacucuggagacugaggugggagcauuacuugagcccaugauaucgaggcugcagugagcugugaucacaccacuguauuccagcguggguggcaaagagcuaucauuuuuugaaugcucauuaugugcuagguacuuugagaagcccuuuaaaaggauuauuuuguuucauugccccaacaacccuauaagguagacccauuuacagauaaggaaacgggcucagagagguuaaaaauuuguccagagucguggagcugaaaaugacugugucuucagcacgauucacagugccuaccuaguacucaguaucaggugagagugaggaaagcuagaaccugccagauucucaagucuguuuggaauucuagaaccauggcaucuccaaaagaagacucuggcaggccgggcgcgguggcucacaccuguaaucccagcacuuugggaggccaaggcgggcagaucacaaggucaggagacugagaccauccuggcuaacacagugaaacccugucucuacuaaaaauacaaaaaauuagcuaggcgugguggcgggcgccuguagucccagcuacucaggaggcugagguaggagaauggcaugaacccaggaggcggagcuugcagugagccgagauugucccacugcacuccagccugggcgacagagcgagacuccgucucaaaaaaaaaaaaccucuggccaucagagucacacaagguguuggugcccauggaaagacuccauucuggaacuuuauacuccucucgccuucucaguacuugcuuuguaaugcuuuuaauuaagcgaaaagaagaauaaauucugguacauacuugaagagcuauuagcucccucuccucucuuaucuuuacuuuguuuauagcuaauaccaaacuagcuauacacuuggcuuaggccuaggggcaaaugcuuauccaugcaugcauguaucuguucauccaucuauccaucccugcauucaucuauccauccauccauccauccuucuauccauccauccauuccugcaucuauccauccauccaucucuccauccauccauccgucccugcaucccugcauccauccaucucuccauccauccauccaucccugaauccauacauccaucuacuuagucauguauuguuuuauucauccauucaacaaauacuuucugagcaccuauucugcaaugaacacagagcaggacucugugguaagucuuauggagaacagaaagaugagucagaggagcuaagcugcuccuccagaaauaaggcaugcaucuagauaacucccaugcaaagcagaaaauuaccuguaccauauaagaaaguauaaagcacuaugaaaagucacaggagagauuccuccugcuggggugucaagagaggggaaaggguuuauuggaggaagagguaucugaggucggccuugaaagaugcccaguuugagaucaugcaaaaauggaaaaaggggcuccugauagagaaagcagcauaagguggggacauggggaugcacugggccugccuggggaacagcaaauauggcuggauuggagaggucaugagguugagaugcauuugggacaggagguugaggccaaaucauggaggccagaucauggaggcccugaacccagccuaggguuaggucguaaucuguuggcaacaguggggcacagaaggcucaaaaacuuuuuauaagcaaagaaguuacaugauucaagcaguguuuugggaaaaugaaucugguggcagccugagagccagacuggacaggcagaggcgauccaggucugccgggagaccagcccggaagcugcagcaguaguucagcagggcacuguaaagaucuagacuugggcaggaaggagagagggcaaaugggagaaacccuagaggcagaaugugcaaagcaggacuggaucuggggugcccaugaaggaggcugcaagucugagagacugggagaaggggaaaggaggaagucacuuugacagguggagguuguagugggugcaucaggggaacagguaggaauguccaggaggaaaggaaccuacggaagaggccaggcuggaaccagagaugugggugccauuugccuagaggugguaguucaaacaugagauugccaagggagaaagaagguuaaaaacagcauccugggaaccuggggaacugaaaagaaauagccagagauggcacagucagagagaggaaaacuagauggcagcucgcaggggccaggaagucucuagugagucuuuguguuuucagcaaagggucugauacacaguaaaugugcaaaacauauugagagaaagaaugggagggagggagggauagagggaggggcugagagaguagaacaucauggaagccaagugucaccauggagaaggugaggagaagugcuuuuccuccagcucgaaugucaggccauaguggccucgugguuagggauugggggggugaugggggugcuggccaggugguacagccagggggaauggcccuuccaagaagugugauagaaaggcagggucguuuuggaggagauaagauuggccuaaggccuuuaauguguuugcagacagcagagagagaacgguagacaggaaagacugaggcugcagggggcagugggcacuagguggguggagcaagacggcagcaggagggaagggaucaaguucacagccaaguacaagacuggcuuugggaagaaaggcuccccggaaacaaagaugagcugggcaguggcuuaugccuauaaccccaacacuuugggacgcagaggugggagaaucacuugagcccaggaauucgacaccagccugggcaacauagagagacccuaucucuacaaaggaauuuuuuuuuuuuuaauuagcugggugucgugaaguacgccuauagucccagcuacuuggaggcugaggcaggaggauggguugauccuaggaggucaaggcugcagugagcuaugaucaugucacugcugcacucccuggaaaggagaggacagggaaagaaguuggguaacaaccauacagggcuuccauuuucccagcaaaagugagagaugguggccagguacagaggcuuaugccuguaaucccaacacuucgggggccaaggcaggaggaucacuugaggccaggaguuugaggucugccugggaaauauagugagcccugucuuuacuuuuuaaaaaaugaagaauuauccgggcaugguggugcacaucuguggucccagcuacuugggaggcugaggcaggaggaucacuugagcccagggauuugaggcuguagugggcuaugauuacaccacugcacuccagccugggcaacagagugagauucugucuccaaaaaaaaaaaaaaaaaaaaaugagaauuaagguucucugcagaucuuacaggugagucagagguuuggaggggucacucugaggagcaugugcagcugcacacagagaggggcaggagggagacuggauaacuucaguguguucuggagccucggggaggcccuggaaucuuccugaaacaccaccggggggaggggcacagagugugaaaguggcuaucugucagagugguggcuacucagagaggugaaaggugaguggcccaggguaagccaugucucaggaguauguggucauauauccccauacucacacgugcacaaauaccgugccagaggcacaggcacucagaaacaugauucaaaauccugauggucacagucauaugaacagcugccauuuauagaacgucuguguuacagcuggcacugugcugggcaguucacauuuuuucuuucuuucuuucuuucuuuuuuuuuuuuuuuuugagacagggucucacucuguuaccaaggcuggagcacuguggcaugaucauagcucacugcagccuugaccucccaggcccaacccauucuccugccucagucucccgaguagcugggacuacaggaguacuccacaacacccggcuaauucaaaacaaauuuuuuuuuuuuuuguaaagauggggucucccuauguugcccaaccuggugucgaauuccugggcucaagugauccucccaccucugccucccaaaauguugggaucauaggugugagccccugcccagcccaucuuuguuucaauuuaacccuuacauuccaaucuuguggguuggcuuggauuggcgaguaccucguuugcacaugaagaaguugagacuugaacaaguuaaguaguuggucaaggacacaguauuguguggaaucuaagcucaggucugucugauuucuaaaaccauucaccaggauacuacccaggcaaagcuggugugagucacuaagccucuggccucucaccucugcucugucuccagucccuuccugcccacaaccccacugcugggucuugcgcuuuagcaucugggucugcuuccuggggucagccagggcccugcacccuggugccacccccugccauuuguuagagagcauguugguugauaaauuauuuccacagaggcagaaauuuugucuuaccccuuguggggcauuugcacguaaacgugggccuagccuuaaggcauaauguuuguacugguuaaauuuuaagcugucagaaggccagccgggaaaauggggguggagaagaguguguguauaugugugugugcgugcgcaugugugagggggagagagagagagagagagcgagacagaaagagagaaagagagagagaguuuccuuggcuucucucaaaucacacccugccuacuccacccacaaguagcccuuuccaucaaagcucauuucucgcaggucaagugccagcucacuccaccuccucccauccagaccccucucccauccaugcaccccgccugucugugccugcauccccaaggucccagcgaccuccgugcacaaagagauagaaagggcgagcugcagcaggaagaggggagggagggaggaagagagagcaccacagaggaaggcagguccaggugacggaagggacagcucagcugccccuggcccuggucggacgccagccagccgcucgcccuccaucucagccccacccucccccagcugugugucccugccuuaucugagccaccagcccagccccaccucacccaccacccucuccucuccacagcuccccaggaugugggugauaagacccgcccacugggcccuccgaguuugugcccacucauccuggcgcgcucuucuuccaggcagaaacugauccagacuguggcuccccuggacuuuuagaaaugaagccuccgcaggcagaauggcaacuucgggguggagggccccuggucuagcugugcuccuguuuccagccaaccacuaccugcuugguggcagccccuguauacuugggacuuucauacaucgucucuaaaccucacacaaaacgacauucuccucauuuagagaugagcaaaaaugaagcugagaggugaacuugccgaaggccccccaaauagaagccaagccagaaucccuaccccggccugccugaggccaaagccaagugcucuuuucaaugaguaccaaagaucccaguucaaucaaaaugugggacuugggggucccacgugcuaaccuuagacaguggagccacccagaguccugcucguugauggcaucuguagaagagcagcugggagugugggggccucuggcuccgggccacacaggcagcaggguccagccaggcuggaggccggcuggugcagacaguaagugaauuaugaaacgaggcaagucauccaagcaggcuggcgucggugggcagggaacuuugccccgcuucgccuucuccuguucuguucacagugcgacugccuggcccucucucccuuucuuccuccugucuuucugcuuucucuucuggucccuuuucuuggcuuucuucaucuuuucucccucccucccucuuucccuuucacccucuccccuacccagccccacccccgcaguuacuguggcaacaauucaaugccagaaauaaaggcagaauccagcuaggucaccaguucccaaaacagcauccuggguggggaggggcagggaggguggagcagugcggcgcugcagggcaggggccaggcgcucccaugggugcugugcaugcgugugaugugggugggguagggcaccuugcuccccgcacccccccgccacuggaaaaggacaccaggaggcugaggccugcucugggccaguggcucaucagaggugucccuuacuuaggcgaagccugaacuccaagucuguccuaaggcuggcagagccuggggacucccuccucuucucccacuuucucccucuccccuacuccaauguuuuuuaccguugugucugcugggaugaggguuccccuaacccagcacuacagggcacccucucauacucggauaaaggaccaggccuggguggguggggagcccagagucccccugcucaaggccugcccucccuuguucucucaauaacaacaaaaccgggcccaggugcccccuccugccucucuagcccacccagagacgcaucugugcagccaucuucuccuaggucucucucugguuugguuucuaugugcccucuccacccacccucugaagagaccccgcuuucugcuuucugcauccugcagcccccucaggcggacugcuuccccuccauuuauagcugguccuguuguacaagugggacuggcagagcugggggagaugcagccucaauucagcuuucuggaucccagggccucccuguuccagucccacaacacccaggagcucuaggagagggauucugcagacauccacccacggguggacaaccucacccaggagucuaacgccugaccacagagaggccggcagcacggacacaagauggacaggugggcacaggcagaagcgcccgcgcugaaaccguugcaggacgcaugcacgcggggagacuccgaagcccugugugccagcucaugcccccacucucccaucgaggcccccucacugugacacauggugcugccaacacccgcucacacccacccaccgguccucucccuggcauccaucccagaguagugcacguguacagcaacauacacagagcccuccacuuacccagcucuggaggccuucccugggcuccccauucccacagcccaacugccuuccuugucuuggaccugucccugcuccccugacucucacaaccaggcaac

SEQ ID NO: 192512 - RNA, 24661 nt, Homo sapiens
guugccugguugugagagucaggggagcagggacagguccaagacaaggaaggcaguugggcugugggaauggggagcccagggaaggccuccagagcuggguaaguggagggcucuguguauguugcuguacacgugcacuacucugggauggaugccagggagaggaccggugggugggugugagcggguguuggcagcaccaugugucacagugagggggccucgaugggagagugggggcaugagcuggcacacagggcuucggagucuccccgcgugcaugcguccugcaacgguuucagcgcgggcgcuucugccugugcccaccuguccaucuuguguccgugcugccggccucucuguggucaggcguuagacuccugggugagguuguccacccguggguggaugucugcagaaucccucuccuagagcuccuggguguugugggacuggaacagggaggcccugggauccagaaagcugaauugaggcugcaucucccccagcucugccagucccacuuguacaacaggaccagcuauaaauggaggggaagcaguccgccugagggggcugcaggaugcagaaagcagaaagcggggucucuucagaggguggguggagagggcacauagaaaccaaaccagagagagaccuaggagaagauggcugcacagaugcgucucugggugggcuagagaggcaggagggggcaccugggcccgguuuuguuguuauugagagaacaagggagggcaggccuugagcagggggacucugggcuccccacccacccaggccugguccuuuauccgaguaugagagggugcccuguagugcuggguuaggggaacccucaucccagcagacacaacgguaaaaaacauuggaguaggggagagggagaaagugggagaagaggagggaguccccaggcucugccagccuuaggacagacuuggaguucaggcuucgccuaaguaagggacaccucugaugagccacuggcccagagcaggccucagccuccugguguccuuuuccaguggcgggggggugcggggagcaaggugcccuaccccacccacaucacacgcaugcacagcacccaugggagcgccuggccccugcccugcagcgccgcacugcuccacccucccugccccuccccacccaggaugcuguuuugggaacuggugaccuagcuggauucugccuuuauuucuggcauugaauuguugccacaguaacugcggggguggggcuggguaggggagagggugaaagggaaagagggagggagggagaaaagaugaagaaagccaagaaaagggaccagaagagaaagcagaaagacaggaggaagaaagggagagagggccaggcagucgcacugugaacagaacaggagaaggcgaagcggggcaaaguucccugcccaccgacgccagccugcuuggaugacuugccucguuucauaauucacuuacugucugcaccagccggccuccagccuggcuggacccugcugccuguguggcccggagccagaggcccccacacucccagcugcucuucuacagaugccaucaacgagcaggacucuggguggcuccacugucuaagguuagcacgugggacccccaagucccacauuuugauugaacugggaucuuugguacucauugaaaagagcacuuggcuuuggccucaggcaggccgggguagggauucuggcuuggcuucuauuuggggggccuucggcaaguucaccucucagcuucauuuuugcucaucucuaaaugaggagaaugucguuuugugugagguuuagagacgauguaugaaagucccaaguauacaggggcugccaccaagcagguagugguuggcuggaaacaggagcacagcuagaccaggggcccuccaccccgaaguugccauucugccugcggaggcuucauuucuaaaaguccaggggagccacagucuggaucaguuucugccuggaagaagagcgcgccaggaugagugggcacaaacucggagggcccagugggcgggucuuaucacccacauccuggggagcuguggagaggagaggguggugggugagguggggcugggcugguggcucagauaaggcagggacacacagcugggggaggguggggcugagauggagggcgagcggcuggcuggcguccgaccagggccaggggcagcugagcugucccuuccgucaccuggaccugccuuccucuguggugcucucucuuccucccucccuccccucuuccugcugcagcucgcccuuucuaucucuuugugcacggaggucgcugggaccuuggggaugcaggcacagacaggcggggugcauggaugggagaggggucuggaugggaggagguggagugagcuggcacuugaccugcgagaaaugagcuuugauggaaagggcuacuuguggguggaguaggcagggugugauuugagagaagccaaggaaacucucucucucuuucucucuuucugucucgcucucucucucucucucucccccucacacaugcgcacgcacacacacauauacacacacucuucuccacccccauuuucccggcuggccuucugacagcuuaaaauuuaaccaguacaaacauuaugccuuaaggcuaggcccacguuuacgugcaaaugccccacaagggguaagacaaaauuucugccucuguggaaauaauuuaucaaccaacaugcucucuaacaaauggcaggggguggcaccagggugcagggcccuggcugaccccaggaagcagacccagaugcuaaagcgcaagacccagcagugggguugugggcaggaagggacuggagacagagcagaggugagaggccagaggcuuagugacucacaccagcuuugccuggguaguauccuggugaaugguuuuagaaaucagacagaccugagcuuagauuccacacaauacuguguccuugaccaacuacuuaacuuguucaagucucaacuucuucaugugcaaacgagguacucgccaauccaagccaacccacaagauuggaauguaaggguuaaauugaaacaaagaugggcugggcaggggcucacaccuaugaucccaacauuuugggaggcagaggugggaggaucacuugagcccaggaauucgacaccagguugggcaacauagggagaccccaucuuuacaaaaaaaaaaaaaauuuguuuugaauuagccggguguuguggaguacuccuguagucccagcuacucgggagacugaggcaggagaauggguugggccugggaggucaaggcugcagugagcuaugaucaugccacagugcuccagccuugguaacagagugagacccugucucaaaaaaaaaaaaaaaaagaaagaaagaaagaaagaaaaaaugugaacugcccagcacagugccagcuguaacacagacguucuauaaauggcagcuguucauaugacugugaccaucaggauuuugaaucauguuucugagugccugugccucuggcacgguauuugugcacgugugaguauggggauauaugaccacauacuccugagacauggcuuacccugggccacucaccuuucaccucucugaguagccaccacucugacagauagccacuuucacacucugugccccuccccccggugguguuucaggaagauuccagggccuccccgaggcuccagaacacacugaaguuauccagucucccuccugccccucucugugugcagcugcacaugcuccucagagugaccccuccaaaccucugacucaccuguaagaucugcagagaaccuuaauucucauuuuuuuuuuuuuuuuuuuuuggagacagaaucucacucuguugcccaggcuggagugcagugguguaaucauagcccacuacagccucaaaucccugggcucaagugauccuccugccucagccucccaaguagcugggaccacagaugugcaccaccaugcccggauaauucuucauuuuuuaaaaaguaaagacagggcucacuauauuucccaggcagaccucaaacuccuggccucaagugauccuccugccuuggcccccgaaguguugggauuacaggcauaagccucuguaccuggccaccaucucucacuuuugcugggaaaauggaagcccuguaugguuguuacccaacuucuuucccuguccucuccuuuccagggagugcagcagugacaugaucauagcucacugcagccuugaccuccuaggaucaacccauccuccugccucagccuccaaguagcugggacuauaggcguacuucacgacacccagcuaauuaaaaaaaaaaaaauuccuuuguagagauagggucucucuauguugcccaggcuggugucgaauuccugggcucaagugauucucccaccucugcgucccaaaguguugggguuauaggcauaagccacugcccagcucaucuuuguuuccggggagccuuucuucccaaagccagucuuguacuuggcugugaacuugaucccuucccuccugcugccgucuugcuccacccaccuagugcccacugcccccugcagccucagucuuuccugucuaccguucucucucugcugucugcaaacacauuaaaggccuuaggccaaucuuaucuccuccaaaacgacccugccuuucuaucacacuucuuggaagggccauucccccuggcuguaccaccuggccagcacccccaucacccccccaaucccuaaccacgaggccacuauggccugacauucgagcuggaggaaaagcacuucuccucaccuucuccauggugacacuuggcuuccaugauguucuacucucucagccccucccucuaucccucccucccucccauucuuucucucaauauguuuugcacauuuacuguguaucagacccuuugcugaaaacacaaagacucacuagagacuuccuggccccugcgagcugccaucuaguuuuccucucucugacugugccaucucuggcuauuucuuuucaguuccccagguucccaggaugcuguuuuuaaccuucuuucucccuuggcaaucucauguuugaacuaccaccucuaggcaaauggcacccacaucucugguuccagccuggccucuuccguagguuccuuuccuccuggacauuccuaccuguuccccugaugcacccacuacaaccuccaccugucaaagugacuuccuccuuuccccuucucccagucucucagacuugcagccuccuucaugggcaccccagauccaguccugcuuugcacauucugccucuaggguuucucccauuugcccucucuccuuccugcccaagucuagaucuuuacagugcccugcugaacuacugcugcagcuuccgggcuggucucccggcagaccuggaucgccucugccuguccagucuggcucucaggcugccaccagauucauuuucccaaaacacugcuugaaucauguaacuucuuugcuuauaaaaaguuuuugagccuucugugccccacuguugccaacagauuacgaccuaacccuaggcuggguucagggccuccaugaucuggccuccaugauuuggccucaaccuccugucccaaaugcaucucaaccucaugaccucuccaauccagccauauuugcuguuccccaggcaggcccagugcauccccauguccccaccuuaugcugcuuucucuaucaggagccccuuuuuccauuuuugcaugaucucaaacugggcaucuuucaaggccgaccucagauaccucuuccuccaauaaacccuuuccccucucuugacaccccagcaggaggaaucucuccugugacuuuucauagugcuuuauacuuucuuauaugguacagguaauuuucugcuuugcaugggaguuaucuagaugcaugccuuauuucuggaggagcagcuuagcuccucugacucaucuuucuguucuccauaagacuuaccacagaguccugcucuguguucauugcagaauaggugcucagaaaguauuuguugaauggaugaauaaaacaauacaugacuaaguagauggauguauggauucagggauggauggauggauggagagauggauggaugcagggaugcagggacggauggauggauggagagauggauggauggauagaugcaggaauggauggauggauagaaggauggauggauggauggauagaugaaugcagggauggauagauggaugaacagauacaugcaugcauggauaagcauuugccccuaggccuaagccaaguguauagcuaguuugguauuagcuauaaacaaaguaaagauaagagaggagagggagcuaauagcucuucaaguauguaccagaauuuauucuucuuuucgcuuaauuaaaagcauuacaaagcaaguacugagaaggcgagaggaguauaaaguuccagaauggagucuuuccaugggcaccaacaccuugugugacucugauggccagagguuuuuuuuuuuugagacggagucucgcucugucgcccaggcuggagugcagugggacaaucucggcucacugcaagcuccgccuccuggguucaugccauucuccuaccucagccuccugaguagcugggacuacaggcgcccgccaccacgccuagcuaauuuuuuguauuuuuaguagagacaggguuucacuguguuagccaggauggucucagucuccugaccuugugaucugcccgccuuggccucccaaagugcugggauuacaggugugagccaccgcgcccggccugccagagucuucuuuuggagaugccaugguucuagaauuccaaacagacuugagaaucuggcagguucuagcuuuccucacucucaccugauacugaguacuagguaggcacugugaaucgugcugaagacacagucauuuucagcuccacgacucuggacaaauuuuuaaccucucugagcccguuuccuuaucuguaaaugggucuaccuuauaggguuguuggggcaaugaaacaaaauaauccuuuuaaagggcuucucaaaguaccuagcacauaaugagcauucaaaaaaugauagcucuuugccacccacgcuggaauacaguggugugaucacagcucacugcagccucgauaucaugggcucaaguaaugcucccaccucagucuccagaguagcugagaugacuacagcugcauaucacuacaucuggcuaauuuuuacauuuuugcuagagacgaggucucccuauguugcccgggcuggccucgaacuccugaccucaagccauccucucuccuuggccucccacauagcucuuauuguuguuuucacccuccugcgauuagcagucugucuaguuagggagaaaacauguucccuguaaucaagugcuuagcuacauuggucuguuuuuaaguaccacuggaauucagagaaggguugauccaugaggacuagacuaguacaggaggccucccagaggagcggcuuugggauagcccuggaaggcuggaggcaccugagaggcagagagguggacagagcaguggaaggugucaaaagcaggaagguagggcugggcgcgguggcucacgucuguaaucccagcacuuugggaggccgaggcaggcggaucacuugaggucaggaguucaggaccagccuggccgauauggugaaaccccaucgcuacugaaaauacaaaaauuagccaggcacacgccuguaauuccagcuacucgggaggcugagacaggagaaucgcuugaaccugggaggcggagguugcagugaaccgagauggcaccccugcgcuccggccugggcgacagagcaagaccuuuuuuuuuuuuuuuuuuuuuuuuuuuuaacgaggcagggucuuacucugucacccaggcuggagugcaguggugcgaucucggcucacugcagccucgaucuccugggcucaagugauccucucaccucagccucccgaguagcugggacuacaggcauccagcaccacgccuggcuaauuuuuaaaauuuuuucuguaaagacaagguuucgcuauguuguccauccuagucucgaacgccuggguucaagcaauccuccugccucagccucgcaaagugcugggauugcuggcgugagccacuuaugcccgaccuaugcaguguuuuaaaaauaauuuuuuccaugaaacaaaguuugugugaaguucugacguguggaauuuccaccugugcgucaugguaggcacucacaaaguuucggagugcggaugucagguuuuggaugagggaugcagaagccgggcugcucagggaacccucuguguuaacccuuccugggcgagcgcggggagguggcggcggggacagugccccgagcgggagugggaccagcggccgggaggggagggccucagccagggccgcaggccgggccggggcggggagggcaggugcggcggggccaggccguggaggccuccgcccgggcagccggcugaccccugccgucauuuccuuugaagccagagaacaauggcucaaaaacaagcgcagcccguccuucggucgccucccguccacgcgcgcguucuccggggcugagcggaugggaagccucagccgcaaggggcccggcugccuggagagcggccgcccgcggaggccccgcagccuaacgccgccccggcgcggccucccucccuucuccccgcagccuggagagucaccgccgagggaugaggacgcgccagcccgggggaacgcgccagcugcuuucgcggccccaagcgcgcagcgcccagcagccgcgccgagccugacacgcuguccucuccccucgcgcacagggcucugcgagugacccggcgggcgagcuccgugcugcauggaacggcugcagaaggugcgcggcgccgccccgggccggggccgccgagggcgggugggggccgcuugggaguccagggcgccaccugguggccacccgccgcgcagcgccgcgcagcgccccgggucccccaggccuagggccgcccccgccccgcucccgcacacacgcacgugcccacccgcccgccuucucgcucuccccagcaaccacuuaccucccccgggagcgugagccccucccgagauuccagugugccuggcucucccuccagcaucguggugaguaccccucucggccaccagcaaccccuggcugggaggggggagggugggggaccccuggcugcuagcgugccuucccgcagagccuccccagugguggucccuccggugcuggcgggcagagagaacccagaaacccagagaagcucccauaucccccuuccacuggucuggccucguuaauccgaagugcuaggcaaaggacuaucauguuuuaaggugacuaauuucuuaaaauaauagaauuguuaacgucugcaauggcgguccauuuucuugguaauugacguaagucuagcuagcagggccaguguccuaggcggggcuuucggcacagcaguuucacgcgcaccuuucccuucaggccaagauggacaaucaggugcugggcuacaaggaccuggcugccauccccaaggacaaggccauccuggacaucgagcggcccgaccucaugaucuacgagccucacuucacuuauucccuccuggaacacguggagcugccucgcagccgcgaggugagggggcuccucuugggcaggacuccgggggaggccccccccagccacacuggguggggaccgaucccucccgugcuuccuuuccuggaggucugccucggcaaaacaagagagggaacugugcgcaggaaccaaccagucaguccauccgguguucaagagagcaggcagaacggucucugggcuggcauguggcucagauguagagggguggacaccuuuggauggcagcaacacacaagaggcacaaagagcaagauuuguggaaacaguucagaagcauugagagcgggggcugaaagucuagcggagggacccaugugauguuguggccucagcuuacccucguguaaaauagaggugaccuuucugcccauccacgcgcaagguagugaaggugcaggagacagugcaaggcagguacucaucaacugccuccaagacaggguagcgucguggcugaccagugacagggggcuagaucauggggugacuucaguaccugcgugauaaaccccgaccucauccuuggaugcuucuuggucuugucucuucuauuuguuuugaggcucugaggacaggacaaacuauuccccaacugguucccaggcuaggcacgguggcucacaccuauaaucccagcacuuuuggaggccaaggugggagggucacuugaggccaggaguuugagaccaguccaggcaacacagggagacccccaucucuacaaaaauuagcaagauguggugcugugcaccuguaguuucagcugcucaggaggcugaggugggagaaucccuugaggcugggaaggggaggcugcagugagcugugauagagcuacugcauuuaggcugggcaacagagugagacuauaagaaagaaagaugagagagggauagaggagaaagaauaagagacaagagagaagaaaguggagagagagaggaaggaaagagggaaggaagggaggaaggcagggaaagaaagaaaaaggacaaaggaaguaggaaaaaauuaaaagaaagaugagagcgggagagaggagaaaaggggaggagagaggaaggaaggaaggaaggaagaaaagagugcccuuggagccccaggaguacugagcaaggcucgcgugcuucucugugccuccugugggaaggcugaggacuuugugcagggaacugugggaaggauccaagaaagcagagguggcccagaagcuggccaggaaagugugcggcuuugggugggggaugagguggccucucuggaauucuagggaagaggcugaaucugccccuguagcucugaccagcccccucuccauucacagcgcucgcugucacccaaauccacaucccccccaccauccccagaggugagucugccccacaccugcaacuugcccugcccugcccugaaggggauccuaacucccuccccucacacaucagaccaagcucugcagagcccagggagugcccgaaucagcggcccccuggcugucacuggccagcucuguguccaucauucugucggacccaggaccucaacccuuucucccugggccaggcaccaucaguagguccuuggaacugugccacaacauugcccuggguuuggagggaugcagccggccaggaugggaggacagagaggguggugugagcugauggggugcauguguggguuggaggggguuaggggcccuggagccacacgcuucugcucugcaggugugggcggacagccggucgccuggaaucaucucucaggccucggcccccagaaccacuggaaccccccggaccagccugccccauuuccaccacccugguaggucuucucggcacgaccucauuguuuccuaagacuuucuccaucaggaaccccaauccccuuacgcucagucccccacucucugggguauaugcucgccucagggcuaaguaggccccaggaggccaggaccccucccagagaugggagaccugucacuuuuucucucucccccagccggaaaaguguaaaaugucccaaaccccugaggggcagugccaggaaugccagcccugucuuggcucuugacaggggccagugaguuccccaccuugucccguuccaucaucuccauucuccuggccccagccucccugccaucagcauguccuccuccucaucuguucuuccucccacagagaccucccgcccagauuccaacaucuacaagaagccucccaucuauaagcagagaggugagggcgccccuggcucaccagagccugcuuccggcugcaugcugggaggccgugcccuggggcugcgggcuggcuggagggggucgggaggauagcaugucacagcagcacgugugccccgugcucagcguguacacugcuuuuaccugcaggaccucacaggugugaggggggaggggugaagguagccaaguuggccucgggcagggcacaccuggcugacccuggccuuugucugcagaguccgugggaggcagcccucagaccaagcaccucaucgaggaucucaucaucgagucauccaaguuuccugcagcccagcccccagaccccaaccagccagccaaaaucgaaaccgacuacuggccaugccccccgucucuggcuguuguggguaggagagauggggagaguggaauggguggucugggaaacuccugcacucccuccccuuggcucuugcugcaguccgugaacccacucccaccccugcccuaugguguccucgugggcuuuuuccuaccuucaggagcccccaggcuccuugcucacucacucucuguguucccauagcgcuugguguaaguggcccuuuuauuggucauucauuugcuuuccauucauuuauuuccugacucaacagacauguaucaaacuucugcaucccaggcucugugaggggagcacugggaaagagaaagauaaaugauagaugguuugguccccagcgaauuuuauuuuaauuuuuauuuuuauccauuuaugggguacagguguaauugguuaccugcauagauugcacaguggugaagucaggguuuuuaugauauuguuaucugaauacugcacguuguauccauuaagcaauuucccaucaccaccccccacacccuucugaguugccaugguccaucaucccacucucuacauccaugcguacacacuauuaagcucccacucaugagugagaacaugcagucuuugucuuucugugucuuguuugacuuaagacaauggccuccaguuccauucauguugcugcacccacugaauuucagucaugaguguguguauguguguguugccuacccagcuucauggcaaggugagaaaauguuacucuuauuuuauuguauuuuuauuuuauuuauuuauuuauuuauuuauuuauuugagauggagucucacucuguugccccaggcuguagugcaguggcacaaucuuagcucaccacaaccgccacaucccgaguucaagcauuucuccugccucagccuccugaguagcugggauuacaggcaugcaccaccacaccuggcuaauuuuuuguauuuuuaguagauauggguuuucauuauguuggccaggcugaucucaaacuccugaccuccagugauccacccgccugucucccaaacugcugggauuacaggcgugagccaccaugccugacucucuuuuuaaauguugagacaggaagucuugcucuauugcccaggcuggagugcaguggcgagaucucggcucacugcaacuucuaccaccugaguucaagcgauuuuccuguuucagccucgcaaguagcuaggauuacaggugcccaccaccacaccuggcuaauuuuuauauuuauauuuauauuuauuuauuuauuuggagacagagucucgcucugucacccaggcuggagugcagaggccuaaucuugguucacugcaagcuccgccucccgggcucacgcuauucuccugccucagccuccugaguagcugggacuacaggcgcccgccaccacgcccagcuaauuuuuuuguauuuuuaauagagaugggguuucaccauguucgccaggauugucucgaucuccugaccucgugauccgccugccuuggccucccaaagugcugggauuacaggcgugaguccccgcgcccggccuauuuuuauuuuuaaauauuuauuuguuuauuaagacaggaucucacucuguugcccaggauggagugcagugacuccaucacaguucacuguagccucgaauuacugggcucaagcaauccaccuaguucaguguccccagcagcugggacuacaggcaugcccuaccaccccgggcuaauuuuuuaaaauaauuuucuauagagacuauauuaccccaggcuguucucaaauuccugggcucaagcgauccucccaccucagccucccaauguguugagauuacaggcaugagucaucuaccgacccuacuuuauuuuuuaaaaaaauuuuguaguggccuuaucaagguccagcccagagcagugcacagaggcugugccauguaaacacacacugaccccauggcgagugacucccuccccaccuuugcuugugucuccuagagacagaauggaggaagcggaaggcgucucggaggggagcagaggaagaggaggaggaggaagaugacgacucuggagaggagaugaaggcucucagggagcgucagagagaggaacucaguaagguagcaucucaccacccccacccuccaccccugugcaggagucucgcucuguugcccaggcuggcaugcaguggcaugaucucagaucacugcaaccuccgcucccagguucaagugauucuccugccucaaccucuugcauagcugggauuacaggcacgccaccaccucgcccagcuaauuuuuuuuuuuuuuuguauuuuuaauagagauaagguuuugccguguuggccaggcuggucucgaacuccugaccucaagcgauccgcccaccucggccucccaaagugcuugaauuacaggcgugagccacuaugcccagcccacccugugugucuuucuggggacagaaguucuggcucuguagcuagucgaagggguuccuacccgaaaagcaugcuuuuuggaacauguuggggagccgcuucuugccaagaccccaggauuuugcuuuugaagggacaccuggacuuuaugcugcuuucugggggacacuacuugauauaagggucaaaagcacagaaaaggguggucccaucagagcugggagcuagcagccugagugauccaugggaggagagaaaaggagagcaugggcuacaggccuccaggggaggagggagaaccauggaaagaccauugacagugacaugggccuaggcucugagcagggugaccugggacaaggacagggaggccgccgugguagaguucuaccaagcagcgcugacuccuggcuuucaaggguggccaaacccauuguggccaugugucagccacgaacaagaggcucugugagcuccagggcacaaaccagccacuugggaaauguccgcaguccugccugcagcauggcccaacucuagaccuuuuagagauaagaaaugaguauuggcccagcacaguggcucacaccuguaaucccaacacuuagggaggccgaggcaggaggaucacuugagcccaggauuuugagacaaggcuaggcaacauggugaaaccccaucuguauauaaaaaaaaaacaauuagcuagcugggugugguggugcaugccuguggucccagcuccucaggaggcugaggagguuggauugcuugagcccaggaggucaagguugcagugagccauguuugugccacugaacuccagccugggugacagagugagacccugucucaaaaaaaaaaaaaaaaaaaaaagaaagaaaaaaaaaaagagaaaaaagaaacauucaagugucuaagucuuggcuccaucuuccuuucucccuccucagguuacuuccaacuugggaaagaugaucuugaaagaagagauggaaaagucauugccgauccgaaggaaaacccgcucucugccugaccggacacccuuccauaccugugagugcuguggagggggcucagagucaccuggccagagauggaggccugacucugugcaucuguugacuugugacacauacaggaugcaaucccugacccaaagcacggcugcucucuugggagcaagaaucccagucauggaacaaugucagaugauaaaugagagaaucggcuaaaauagaauucagcaaguuugguuuaauuuaacaaccauuuauugagcguuuaccaugugcuaggcacugggcauauaagcagggaaaaaaucuagucuuguccucugguagcuugcuguuggcggggaaacugucauggaacgugggauuucgaugcaguguggccgguauugugaucaaggugcgcggggugcuuugggagcacagcaacagggccugggaggccaaacugagggguuuuguugugguuguuuguuguuuguuuguuuguuuuauugagacagggccuugcucuguugcccaggcuggaauacaguggugcacucucagcucacugcaaacuccaccucucaggcucaagcaauccuccuaccucagccuucugaguagcugggauuaaaggugugcgucaccaugccuggccaauuuuuaaaauuuucuguagugacaaggucucacaauguugcccagacugggcucgaacuccuggacucaagcaaucaucccgccuuggccucccaaacuguugggauuauaggugugaaucaccgcguccagcuuaaacugagucuugaaggcugagaccaagcaagccagaaaaagugagugggagagcgcauugcagacauugggaauggugugggagcgaaauugggaacaugaaacaucuggcuggcugagccuccaggagucuggaauuacagaguacaggguacacuguggggcagugggcagugagaccaagagauggggagcggggcaggcuuugaauggcguggcccacuauccagcgcacuacccugggcuuccucagagcuuggcggcuggagaggagaggaagaccugaaaacccagcaaugaaagcugcaaagccucuuaaagccuaagaggggucccggcaugguggcucacaccuguuguccuagcacuuugggaggccgaggcgggcggaucacaaggucaggaguucaagaccagccugaccaauaugguaaaaccccgucucuccuaaaaauacaaaaauuagccaggcaugguggcgcaugucuguaaucccagcuacucaggaggccgaggcaggagaauugcuugaacccaggagguggagguugcagugagucgagauggagccacugcacuccagccuagggaacagcgugagacucugucucaaaaaaaaaaaaaagaaaaaagccuaagaggaaaccacauagugucacuucuucauuguagcugccagagccagucacuggccaccuagacucaaggggaggggagcuagacccuccuccucccccucccccuucuucuucuucuuucuucuuuuuucuuucuucuuucuucuucuucuucuggcagggucuugcucuguugcccaggcuggagugcaguggcaccauuuuggcugacugcaaccucuaucuucugggcuugaaugauccuccugccucggccuccugaguagcugggauuacaggugcaugccaccaugcccagcuaaauuuuuuuuuuuuuuuuuuuuuuuagacagagucucacugucacccaggcuggagugcaauggugugaucuuggcucacugcaaccacugccucccagguucaagcaauucuccugccucagccucccgaguaccugggacuacaggcacacaccaccaugcccagcuaauuuuuguauuuuuauuagagacgggguuucgccauguuggccaggcugcucucaaauuccugaccucaggugauccaccugccuuggccucccaaagugcugggauugcaggcgugagccgcugcgcccagccaagacuccacuucuugaugacagguaccacaaggucucauugcagaaagcaugaaagaugggaggcaacagugcaggccaucuuuggaaauaaucuaccacacucuccaauagacuggauaagggcuaaaaaacgauguggguccagagaagagggaauggauuugagaacauauagacaauugaauccgcuggaucgaauccaguggcugauuggacgugggaggugcaagagagagaagcugagguuuuugucuugggugcugggugaugaccaacuuggaacugagauaauaagagaggcggauuuucagggaaagaugagagacugguuuuggacaugugggguuugaagugccccauguacagcacuguggguggaaggugcaucuggcagaguugggagcuugagggucuucagcuugcucauauguggcaggaaaauggugaggagaaaguaagauuguacagagagaggagggaagggugccuagggcuuccauuaaagguccagucggggcucaugccuguaaucccagcacuuuggaaggcugaggugagaggacugcuucaagucaggaguucaagaucagucugggcaacguagugagacacugucucuauaaaaaauagaaaaauuaguugggagugguggcaugugccuguagucucagcuaguuggguggcuaagaugggagcuaugauugcgccacugcagucuaaccugggugacagagugggauccugucucuaauuguauauauauauguauauauguguguguguauauauauaugucacuauauauauauauacacgauauauauagugacauauauacacauauauacagugacauauauauauagugacauauauauacacacuauuuugggugacaccuggguguccuauuuuuucuuuuuugggugacauauauauacacacacacacacauauacauauauauauauuagagggcugguuugaggacugguugagaucgagccccagaaugugugggaggcuggccuucaaaggccuccccugugggaugggaacuuggauccaggggcaggccagaugagaagccgagguugucugcugagcguuagagggugagacuuggugagaauggcgaggguuuggaacugccguggaggggaggagaaacgugcgaggcuuggccuuuguagugaugcucaucuacauugugugggcuguauguccacagcugggggcaggaugggagcuguuggguugacccuggguuagcguuuuuaaggauaggugcugaggggccaggcugcaccauggaggagcugauaaaaguaguugcugugcccagccacagagccgaaacugagaagguagugacagaaggugggaggugggggagguaggaggggaaugaagaaacuggaguucuccaugagguugcugggcugggugguggggauggagcugagccaaagccacaaagugaaugguccaagcucacaguuucuaggcagcguggugcagcugaugacaagauccugggcauggcucuuugaaaggguuaucucauguggagcagaggugaaaaccacuggaacuggggaauucaagguuaacaugugguuaggacaucugaguguuccccagagcucucaggaugcugucucugugggugggaagagcuacagagguuuauuagagaauguggaauaaagaguuaaggccuaaagaaugauguggagagaggaugcgugaagguuggauucagugucaguguucugccagaaucuucuguucagcccagauuagcucuuuaacuuccauuuuggccucgugaaguugaaauagccagaugccuaccucuggaucaucuuuggcgucccugaacuugugggugauuaaugaucacaugacugcauagguuacugucauauuuaaacaaccugaauucuagaaucaugaacaggcaugucauucugauuaaauggugacacuggaauagucgcucuggaacacacguaagcauuuuauaauagaaguaauuuggaggggaaaaucuucgugcaggguuugaagguugaaauucuaucaguugguugaauaaauguguacuuauuauucuaagagugaaaugcuucaauagugaauggugauugugaaagcuauuuucuaaauaaaaauaaguguuagggguaaaaaugagguuuuguucucaauaaucgaaugcuuccaagcaacagauuucauaagaguauuuuaagaagaggcugggugcaguggcucacacccguaaucccagcaauuugggaggcugaggcagguggaucaccugaagucaggagcucaagaccagcauggccaacauggugaaacccugucucuaacaaaaauacaaaaauuagcugggcaugguggcgcgugccuguaaucccagcuacucaggaggcugaggcaggagaaucaccugagccugggaggcagagguuguggugagccaagacuguaccacugcacuccagccuaggcaacagagugagacucuguaucaaaaaacaaaaaauauauauauacauauauacauauauucauauauauguauauaugugaauauauacauauauauguauauauuaagauaguuccucauaguuuugaaucuauggagguuaacuauuuauacaaaaaugcuuguggaaacaguugguauaaaugccagccauuuccagcaauuggaggugaaggcauuuugagaucaccucaagcuaaggaucuuagguacaaaguuauuuccaggaaaacauauuacuggaaacaaauuuuccugaauuauaaucuguaguacuucagaauuuagagauccuauuaaaugugcaaguugagacugagguccaguaaugcugaugugaaguuguugacugcugguacaauccccagugacagugcuuagaacaugacucuuucuguaguauaaugucagacuguuuuuuuuuuuuuuuugagauggagucucgcucuaucacccaggcuggagugcaguggcgugaucuccgcucacugcaagguccgccucccagguucacgccauucuccugccucagccucccaaguagcugggacuacaggugccugcuaccacgcccggcuaauuuguuuuguauuuuuagucgagacgggguuucaccauguuagccaggauggucuugauuucuugaccucgugauccacccaccucggccucccagaaugcugggaucacaggugugagccacugugcccagccuaaugucagacuuuuaaaauuugauuacuaggccaagcauaguggcucacaccuauaaucucagcacuuugggaagccaaggugggaggauugcuugagcccaggaguucaagaccagccuggguaccauagugaggccugguuucuacaaaaaauaaaaauaaauaaauaaauaaauaaauauauauauauauauauauauauuagcuggguuugauggcgcaugccccuagucccagcuacugaggaggcugagauggggagaaucacuugagccugggagguugaggcuacagaaagcuauaaucacaccacugcacuucagccuggaugacacacggagaccccaucucaaaaauaaauaaauaaacaaacaaacaaauaugaauacuagcugagcagguggcccaugccuguagcuccaguacuugggaggcaaaggcaggaggaucacuuaaguccaggaguucagguucagccugggcaacauagugagacccuaucucuauuaaaaauuuuuggccgggcacgguguauuuuuuaauagagacaggguuucuccauguugguuaggcuggucuugaacucccaaccucaggugaucuguccaccuuggccucccaaagugcugggauuacaggcaugagccaccacuccuggccaaaaaaaaaauuuuuuuuuuuuagauuugauuacuaacauuguuaauaaaauuauaauaauguaauuauugugauucgauuuuaguuuucuuuguguaucccagagguucauuuuaugaugugagccuuggcucuggcugacucaauuuucacaucaggcauugggcccaguuguauauuugggccacuucuagcuggagagaagagggauggugguagagacagcugagaaccaccagcacuguauugcuugcugaaggugaccaguaggagcugggagcuagcagaagcccaccagguuccccccagcgugaucccuuccugcccugccccagcuguggaaggccagugagguugcugucucaggaagggcugucagggccaaagggacugaacucaggaccuuuugcugucuuccagccuugcaccagggaacgucuaaaucuuccucucuccccgccuauggcaggaccacccugagccggguaaggucucaggaccagagauauagacuacgugggaggaacgugcauguggggugcugagggacugagccacuugggcacccucagggagcggggagacccccaaagugaaggggaccaaaggugaauauccccgacugccucugauuccuuuguguccuuucuagcuacaguccacagaguucagcccaucagggagugagacuggaagcccaggugagaaguggggccuggugccggggucuggagaaggggcuuacacaggucccugggcagccggggucugggcugugggcaggggucuggugaggucaggcguguuggccugcugaccucagagcugcaucugacccaugccccuucucucccgcaggccugcaggugagugccuccuggaggggaacaggcagagcagcagaagcuggguccuggcacccgaaagugucaggggaagggggguguggggccacagaguugccuggugaagaagaagaagccgggguaaggcugggaaggucucccugccccgcucuggcucacugcggcuuuggucuccccagaacggagagggccagagggggaggauggaccgggggaacucccugcccugugugcuggagcagaaggugaggggcaggggacacaagcgccuguagcggggcgggaggcuggggagaugccaggcaaguggaaugugcugcggggucuuccugguguugaagaugggagggauggcagggaaguugggggagacagagggcaagauggcaugaaccccaguggccucugcagguugaugugggaggccuagggagucgaaggacaggauauucugugagccuaagauugccccuccccccacccccagaucuaucccuaugaaaugcuaguggugaccaacaaggggcgaaccaagcugccaccggggguggaucggaugcggcuugagguaggcaaggaagaugcccuggaugggugcggggcuguccacgggcacucuccugccugggggaagaucuggggccucuaugagugaguguccccuaggucacugggcacagcccccucccccuccaugcugagcugccccgauucccccauguagaggcaucugucugccgaggacuucucaaggguauuugccauguccccugaagaguuuggcaagcuggcucuguggaagcggaaugagcucaagaagaaggccucucucuucugauggcccccaccugcuccgggacggcccccuuaccccugcugcuucaggguuuuuccccggcggguugggaggggcaggaggugggguggaaauagggugggcuccuuuccucagguagaguggggggccaaaaccucugcaguccccggcagugagcuauggacuuucuucccccucacaaggcugggggccuccugcucucgucccuggcccucccugcacagggcaaagccagucugggcucuggcacacagaguucauguuugcgcccucucccugccccucaccccagagggugaggaggaaugaggggcauuggugguuaggccgguuggcugucuugaacagcuggagggaagaugcaggggugggaagcggccaggcagaaagagcuccaggcucuugugucgcccacccagcccucccauacucacuccugacagcuuuccugcacugcagccuccugcuccucugacucuagugggaacaggccccagcucagccuccggcagggaggucaccccuccacuucagcuugcccugaccuccgcucgcaaaccccgagcuuccaagccuuuugcuccagcccugcggcuuccccagaagccugggcuuaggguggagaugccgccuacacacgauccuggcccuccaccugccuccaggccacgaaaugggaauuccagcacuaagccaggcaccgggcagaagcugggccuuccgccucccuuggauggggucaagaggccaggccuggcacauuuuggaguguccuggcuaccagcucucaccuacacccacgcacccccccacacacuaugcucucucaagaauguaauuuauuggggcccccccagcugcuuuccucaccugccccugcccuaccuuacacccccagcuugacuucuuuccaguccacguguguauauaaugauaucuauauuuuugcccaggucuggguauugcuccugcccagacccugacaucccuuuccacugugugugugaccaugcugggggagggggacucugcuuggaauuaaaagguugcauugggucccua

SEQ ID NO: 192513 - RNA, 96817 nt, Homo sapiens
ggagagagagagagaggagagagaaagacacacgcacgcagagacacacggucacuggaauuccauuagaaaaaagugagccgagcaaggguuagcgggagaagauuuuuuugaaucuugucuucgucuuggugcgaaagaagcgacuccagucucucguccucgaagcuccgacuggauuguucuugggcgcugacacccgucuguggauuucuuuucuauuugcauuuuauuccgacccccucccucgccgcuuccuuccagcccuucacucgcaaaucgccucucuccccaccuccccaggccccuccugggaagcgcaggggaauuggacccgcggggacucacgccuucccggacgauuggaggggagggcugaccccaggacugggcuguuggcuuagaaagccgauacacagauacgcguauauuugauuguagcgggcaaggggggcgucgagaggcagcagcccaucgcccgccucucaccccacccccuccagccagaggcgagaaucgcaggacucgggaucuucaucggguggacuagcugggaucuccgcauuggauuuggggcugauuaccacugcuugccuauuauuauuguuguuguuacuacuauuauuuuuuuuuacccaagggagaaagacaaaaaaacggugggauuuauuuaacaugaucuuggcaaacgucuucugccucuucuucuuucuaggugaguaccugcgggcggcgagcucgagggggaggcgagaagccggggaggcggggggcgagcggagcgccgguggggggcuggcgggaggucggcggggagagcgcgccgcggagcuagccgggcccggugcuggcgaaccgagcggggccgggcggcagggacgcggacgagggaccggagccgcggcuggcuggcgacgcagggggaucgggagggagacucaacauccgaaccagccccgcagacacugugcacgcacacacacacccgcgcucgcucacacgccaguauagcgcgcaucucccccgaaauaauggguucgaauugcggcaacuuaagaaaaaaaaauauccaacucuugaucugcaagaagggagggagagagaggcuccuaggcggggagagaacaguccugcgggguccgccuuuccuggucugcuccccgagucggucgugguggagggcgcggguuucuccggcggcucccgcuuggacaucgcgcggggagcgcuggcagucacuccccaccugccagccgcgccuggcaaacggagcccgcguccccacgcccugagccccuaaccggcggcuccacuccccggaacacuuuucaaguuucuccccaccgagccccgagccagaugggugggcgggagcggaggguugugagcagccguucccggccuucccuccuccaccucugggggccgcggacccccguggcuggugggaagaggcgggagggaggccaaaguuugcuuucuccguugaagagggugggaggcgagggaggaaaaacgggucugaacaaagaccacugcuccuucugcaaaccccccccacugccccccccgccgccuccaagacagggaggagaggcugccuggcgccacugagccccacgcaguuucuuuuccacacagaauucccagcuccucucucccuuuaaagcuaggugaaaucgcagcugcuugggaaauggcaaucuccggagggaggugaggaaaggcgguuguuugcaaggcugugcaccaccgggagucccaggcagggcugcugccagggaguagacgcucccauagagggagccggguaacuacuguguaugugugugugugugugaguguguuuguaaggagcacacgucugcuucagugaggguguaguucuaccaccuuggcuugcuguguagccaguguugagccaggcugcccagcggggucaugaucucacccucucccuccugcaguaggggaucugggaaggccacgaguggggagguaggagcugguuacaggaggaugugcguggucuaagaagugcucgccagacuaggauaggggaccggagucauuggguguccacacaggcucuggacucucugccuguccccucugcuucccgccaggugcgaguccccaagggggcaagucccugcucuaggguguggccucagagguccuaccucccucagccagaggcagcuucucucuggggugggaggggcuccucuaggaagcuggaaguugcucugggcccgcugugaucccgaagcccuuccugucaacccuggcaaguggacucucauucugaaggggcuacuauaaaaucugaccuuuuucucccacugcuagcuugaaaacccagccuucuggguccaagcaugaucagggccaaggugaaaaaaaaauuguauuucaggcaaaacagccagauugccuacugcugagcugcauaccccagcaugggcagggcucccaggugugggcaccaucuguggucgggggcuggagaagagcagugugggccccuggucauugcaggcaggcuuucuccagccgggcaggcuaaggaguccaccuuucuccuuuucagaaguggcugggguuccugcucgugguggguguguaugugugugcaugggagaugaccagagaggcccaacccaaugucugcaacccuggaggcugaguguugagaggcgggggugagagcagaagagcagcaggcucagcauccccuugcuccacagcccuucaguuuccuucccucgagaaguccccuucuaaagcugggcugaguggagugaccacagauacugaaaggcuuuggguuaggccaguggaaaggaagggauggguugguguuuaggaaacuucagcccuggggcccuuuuccuggcaggaagcugguugaaaaucccacuggguggguggguggagggucgggggagguuuuucuggggcuugagacuuggugggcaauuucagcugggggcaaaggccuuuggugugccccuacugagauucugagugaggucugggcuggauaacccaugguggagagagaggccuuucuugcccaguaucuugaccuccagugcugacccagggagagaaggagaaggggaaagugacucggguggggguguugggcuggccagagggggccacuuccgacugacuuucuagcacacauucuagcucuggugggauguuggaugcaguagggcaauuguagcccugugucgcuucuccaccccccucuaccccugugucucuagcagcuacucccugugucuugauggaucaaaguuuucuccuaauuuaggauuuggaaacaucaccaggacacccccugcccuucacucucuuaggauucuuagcuaaaggcugcaggcugcagggauuccuuucucuggcugggcuugauugguucugggggucauggaaugaacuagaagagucaaggaugguuuggugaauggaugccccggcccuucgcagagugugucuguugccuggccacacgugccagguggcaggaugggggaagcccucaguucuggcacgggagccucccuaagauuguguaaggaucauccuguggggcucuaggcccaacuguaggacaagcaaaaaaagcguccuuaugcccugaauccccugggcuaaucuucugaccuuuaagcacgcggugaauucugugccuacagaaggcuaaggaagccaggaaguuccauuuccaggcccccaugacagugcagccuucaguucagucaaggugggagggcauuagccuauggggaggcggggugguuaagucaguggagggcccaggguuauauucuuccagaggcucccacgggcuggcugggggccgcagguacaggcggggccgugucaacucagcugcucuuggggggcccggcuguacgcggguccugcucagggagguaggaaucugcugaagccggggaagaaagacgcugccucagcuuguguggaggacagcucuccagccagugccgggccucaaacuccggucugauuucuucucuggucuugucucagccuggccacauccaucagccuuccuguucuguggcagaggucuggucagugggagaagggcacgucuuuugcucugggccccgaagaagccuucuguaccccaggcccaucccugcuguucuucucuguuguccccuagggaugggucuccuggcuggucccaccgggaguggauggauuccuguucucugggggcucucgggagcgaaggcccgcugugcagcgcgcugccuuuaggugucgcugucucccugcgguagcgcuccccugagcagggccucccgggggauggccugagaguggcuguucuggguagggauggggaauucugcgguauugaggaggggacuucuggccuaggauuuuauuauguucugaggcgagauggagucgaggaagccucccaaauuacucuuucgguccaggaaagggcagucauggcucugggccauggugcgggcuuuuccugguggcaggaucucgaguuaggggcuuaucagaggacagggggacugggaagacgaugucugugucuggaggaaaccauuuuaggagcuuggcuuugaaaggaucaggcgagccugucccugccguucaccuaccucucuuuuucccuguccccucccuccugaggcacuguggguguggacaugggggccaggaugggaagguggccugaugggggauugcacauugguggaggagcaagguuccauuugcaaggcugggguccgaggaggggagcuuuucccuuuugcaauuauuuggcuuuuggaaggaagaacaaaauaagagauagaggggaagggaguuucagaggaggguggagaggaaagaaagagaggagcugagagagaaaaaaacaaggccauugaaagacaagagguaaaaggugaugaagaaacacaccucuugggaggccaucagcaagagaagcguaagauauagccaggugcaagcagagcuagaguggggaggagagagcagggggcgcggggggcauggaugcuccccaggcuugccaaaagcauuuucuauuggagggggccggggcggaacuugucucucggaagaggagaguucaggucuccgucuggugugaaguuggacuagaagguguggaggggugaggggggaaagggguagcuccuccuuccugggcucgccuggacgguagaguuaggcucaucucucccugucuugucguaaagucagaaugagagucagagugaguacacugggaaucggaggggguguuuccaccgcuaugugugaccuugaguugucaucacccuucuuugggccucaguuucccuaggguaaaaugugggguugggcucuauggugucuauaagguccuaacaggcaaugacaacgaaaugacuucgcacugcauccaagguuuagugcagcgccauggaugggccucuggcuggagcugggguuuauaggaggccugggugguaugcaagugagauguuccccacucccugcaccccccagcaagccaugcagcccccagcucucugcugaggcugugacauucuccucugggcuccugacgucuuagacugaggucuugagccgggaccuuccuggcuuuauugugcugugcuccuaggcccagggccgcugcugaggaggaauggagugcaaagggagaaaacuugcuccuacauccaggggaggaugaugccugaguucucccugggguaugaggagggcugucccacagagucgccuuggugugcuuuggcgaaaugggugugacguucccagcagggcccaagcccccaggccugcaucuugggugggagauuguggcggccgucauucaugcuugucuucccuccccaccacccagacgagacccuccgcucuuuggccagcccuuccucccugcagggccccgagcuccacggcuggcgccccccaguggacuguguccgggccaaugagcugugugccgccgaauccaacugcagcucucgcuaccgcacucugcggcagugccuggcaggccgcgaccgcaacaccaugcuggccaacaaggagugccaggcggccuuggaggucuugcaggagagcccgcuguacgacugccgcugcaagcggggcaugaagaaggagcugcagugucugcagaucuacuggagcauccaccuggggcugaccgaggguaagccugggcggggcuugcccaaggggaggggguguggcgcaggcagagaggacguguggcgggccagggguucaggagggaggacuaggugguggcgcaaacuggccagcucucuaugucuaccugcuaggggaaccuagaacccagagaagucgccgccccaccuaggaggguggcauuguuuggaaaaggccaggagagacaaagaggaggcagaagcaacagcuggaggaggagagagggagguggugggaggaggagaacaggcgcuggaggaaggggggugaguggggugggggaggugagcagggguuggguaggagcaagaccacgugauucaagcaaggacggugugaagugguuccaagagaaggugaggcaagagugaccaggcagauggagaagugagaaccaggagagagaaggggcaggcugggugcaggcugagaaaccagccacuuccgcugccacggcugcugcccugcuauggcugcugcccugccccagggcugaucccagagcuggcugccccuacucuguccuucuggcuccugccucccugcuuccaggacaccagcccuucauguggcuucuggaccccauggcugaccuaucaccuucuacagggcuuggggcagugugcaggcagcaggccccacaucccuuggcaaaccagccuccgagucacaaaguagaaccuauaaguccccccgccaauaacacaccuucacauccccucccccuccagaccuggguguggaggauuugcaucuguuuaggaggugggccacuguaaccagauguucauuuauuaauugaaugcauguuuauugagagcguacugucugcuacacucuagguguuguaggaacaguugagggcaagcugaugcagccucugcccuccugaagccgagucuggggaggugcggauaaauaagggggcuucugucauuugaugguguaagugcugugagagggaagacacagggugcgaugguagcagcuuggagggggcauccacgucuuugcuguaaaaucuaaagcgucuuccuggaagagacaggcuccaagcuggggcugaagggugagucagagucacgaaauggaacauaggugaagggaggcaggaagagugugggagguggagggaacagcauggaaaggcccacugugagaauggaaccuguuuacagagcugcaaguggcuuagaguggugguggguggcagguggugugucguggguggugguggaaguggggaggagaauuaggggcacagggagggaucccugaaggguuuuaagggcgaugaucagaucugugcuucagcaaaaugcuucugugguuccaguggagagaguagauuagaggacuguccagaagcugcugcugugauacaggccaggaacaguuguggcggaaccaggacaguggcaaggaaggaaaaaugggucuaagagcuauuuauuuguguauuuauuauuuuuauuggggucucacuagguugcgcaggcuggucccaaacuccugggcucaagccaucggcccgccucggccucccuaaguguugggauuacaggagugagcuaccacacccagcuaauuuuuaaauauuuuuuugguagagauggggucucguuauguugcacaggccuaucucaaacucccgggcucaagcaguacucccaccuugguuucccaaaguucugggcuuacagguaugagccacugcccccggcccucugagagcuauuuagaagagagaauccacaggucuuggugacugaugggagaggagaaggggaggggagggaggagucaagaagggcacccaguuuccugucuuaggcagcugagcagaugauggaggccucagaagaaucaggccagucuuagaguggagaggggagggcagggggauggggaaucuguuuuggggcccauggcucucauugaccacacccugcagaugugcaggucuagagucgagggaggaagugggucugagcgagacugaggaagggacaugagccugcagguagaaaccagggccaagggggugugcaugaccgcagugagaggagggcgguaacagaccccggagaccaugguauuuaaggauguggggaagggagccugcagggagcugagaaggugcuggggagaggugggaggaacagcaggaaaacaagguaggguucaucccagaggagaggacccucaacagggucagaugccuuaggguaagcugaggcugaggcucuuagcuucuuagacaccugcugugugccucagagggugacacacuggauuagccaugcuccccgugccggccaucggccaucguauggggcaggagaccuuuccccgggcccuccugcuggagggaggagccuggcuagggaggagccuggcuagggagcagacaggaacagggggauugggagugaugaaugcagaugacucuuuccagaauuuugguguaaagaggagagaacaaaggaugcuuaaaaaaaaaaaaaagaugggagaggaucgagcaguuuaaaaucuaacaucggacaguagugauggcgauguugccaugaagaagacagaagggucuucuguggaauggugccuuugggaaggggaggggcuggguccagggcacaaagugggccaggggaugagccuucgaacaggggagcaaaugcucccuccaggugcugggagggagggaggaaguggcugcaggugcgaagccagauagagggggaucccugaccagucagagauggcucgaauauguucuaaauaugggaauaagaaaugcauauaauuacuaccaucauuaauagcaaaguauuccucaugaaucaggcggugccuucucccuagcaaccuggauuccuagaacuagcaugagcaaagggaggaauacuguccugaggguacugcacucuauucuucaggagauaaggcgcugucuucacccagagccggacucuguagcguacaaauaauuaaagcgcucaaugccugagcugaguaguuguguuucuugucuucuuucuggcagccuucaguuuccacccaagggagacugggcagcggguucgggugggcugcagaguggacaggggagagaacaggacagaaaugucacccagaacagccgggggggcacuugggccuuuuagcaccaacagcccuucccaugucacuggcucccucuguaucacugcaucaggccacgggaggacugugcugaugggaucccagggaaaugagcacgaugcugugugcguuuagcugcaugcugcugugugguuuucaaggccccuugaucgggagugccugacugcagauggcuucucugguuccaaaucucguuuuuugagacagggucucacucuguugccuaggcuagagggcaguggcaugaucacagcucacugcagccucuaccuccugggcucaaaugauucucccaccucagccucccguguagcugggaccacuggagccugcuacuaugacuggcuuuuuuuuuuuuuuaaguagagaugaggucuuacuauguugcucaggcugaucuugaacucuggagcucaagcaauccuugugucucggccuaccaaaguggugggaugauaggcgugggccgcuugugccuggccuugagucuuuuuauuuauuuauuuuuuaaugagauggagucuugcucuguuaucgcaggcuggagugcaguggcaagaucauagcucacugcagccucaaguuucugggcugaagugacccuucugccucagccucccgagaagcuaggacuacaggcacgugccacuacgcuuggcuaauuuauuuuuuauggagguggggucuugcuauauugcccaggcuguccucaaacuucuggccucaagcaaucucuucccacuuuggccuccaaaaguguuggaauuauaggcauaagccgcugcguccugccugguucuaagucuugagaugguuuauucauucauuuauucaacaaccauuuguuaagcaccuacugugugccucagaagguaacagcacuguaggaacuguguucccugugcuggccagcagacaggucgggagaccuuuccucugggcccugccuagaaaauacacccuuacuuuuuuccuuccauagaagacugcaucuuuucucuguaggggaauucuaccuucuccugggucuugggagcccagagguaguuucugcccagggcugaccaggggaagccaggaggccuccagguaguguucuugugaguggcggggucuaccugagagguaagcguccauggccuguugagcagucucccugagggaggcugcgaguccuuccucccuguuccuugauaacauuuaauaaccugaugcaggccuggggcugcggagagggcaagaaucgcugagaggagcgauguguguaggauuggauuuuccuuccgauucucagccucuccuuggccccugcuggugggcgugauuuaccauggggcugugcuccgccuuccugggacuuagcucucaguaugcagucaaggcgcacagcaggugcaaagagcccguggcggcaguggggaggauggagagagggcuggggugggaaugugaccgcaagacauggcugcugagcuucuagagucugaacugcagaggaucuggcaaucauucgggcucaccccuaccaucuggcagggaaacugaggcauagaugggugagauggccucccagggcacacagcaagcucguggcaggacccagagugggucccagggccccgacuccuuauccaggucccuuuucacugucuugggggcgaucccacggccugggccccguuuuccucacugccauuaccaccaccaguuuuuacacagggggcugccacucuuggcugcaugggggcuuugagaccagguuucuugccuucugcaaaggugacacugaaauucaggguucuuugguccgaaggugaagagcaaagccuucuuccauucccagaaucucacauucuggcucugguuucaguggcucacaccucgggauuucucacuggugaauucuguggcagaaacaggcuacacaaguugacuuaaagaggcugggccccuccaaaucaguuccggaagaggcuguccccacccugccacccccaccccauuaaucagacuggccuagcuauaccuaggcccauggcugcgcuagaugcaguagggaaggacaggcccccacaccaccccggggcaccaucuggcggacagaagacugaucuugggaaaaggggaacaacaguacuuauuuaggaaugacuugguuccgauaacacucugcauuuugggagacaguauucacagcagugaagcacuugggcuuugccugggugugaacccuggcucugucgcuuguuagcugugugaccuuggucaagcuacuuaaugucucugugcuccuuguuccuccuuaucagucaaacagggagaaaaauagugccuaucucauagaguaguuaagaggaugaaaugagcuauaucuaaagcacuuucagugcuggcaccuggaaaacgcagucuaacauuauuuuuauuguaaaagugauuuccuaaguuccuauauuguuuggccucaauaaauagcaauggcugguaaccccaccccaaggaguuucucaagagagucuaaagugccaguaggugggguggaggacauugagaucauccaggcuggacaggggcccaaaggccccaaggagaaggugggaucagauaugggccguaaauaaugcgucuuggcugggcgcgguggcucacuccuguaaucccagcacuuuaggaggcugaggugcacagaucgcuugaggucaggaguuugagaccagccuggccaacauggugaaaccccaucucuacuaaaaauacaaaaauuagcugggcaugguggcacgugccuguaaucccagcuacuugggaggcugaggugggaggaucgcuugaacccaggagauagagguugcagcagugagccaagaucgugccacuguacuccagccugggugagagugagacucugucucaaaaaaaaaaaaaaaaaagagucucgucuggaugaggcuguugucaaauuccagcugggcaccugcuguguguccuggguguugcggggcaugaggguugcuuuuaggaggugacgugaaagguggaggcuguuccuaaugcagggaauaugcuuccuccuuguccucuggggcugccccauuucuugggggucugccggaaauaacaggcagccuccuugcucggugagccugcagggggcuaguugagucuccaguuccagccucugggugaccacaugcagugggguugcaaagccccucuuccaggcccaugauaccuugcugcagguaacccugaagaggcugccccaccugugcucucucuuaggcagagggugccugccugggcaccaggcccugccuggaugggaaaugagucugugaggcugugcccugcuuuucacuacacacacacacacacacacacacacacacacacacacacacacacacacagaggaugaguggugagccaucaauuuccccucaccaauaacgucucaagagacuauuuccuuucccgcugaggccucagcagaggagggugggauuccugacacugugguggggucuuugggggagcccugggccauccaucuccuguuauucacuugcuuuuccauuccugagcccccaaggcacccaaagccucgaggaaagguccaaggagccugcaggugguggggagaacaggagggcccugcaggagagggaccacgcagauggaagcuggggaucagcccacccacugagcagaccuucagccccuccagcaagauucuccuggugacacgauggggggcaaagaggaaauucuguccuccucagugaccugggcggagcuggcguggugugaugggaaagggugcuggugggagggccaggacagcagagucuaacucuggcccuuccaggaguagcugugugaucucaggcagguuucuucaccucuccgggccaccucagagcccucucuugugaaaugaggcaugauuguggagagcauucuggcuucaaauccugcaauugauaccuggccuuacgugggccagcauugcuccacuucccccagaugcaccugcaaguccuuccaagggggcuggccaugcaggguggucacgagagagaagcgucaggcaguucugagcugcugucagggagcuucuccucuaguuggggagacagaccugcccagaugaaaugcuaaacauuucguugcuaaugugcccugguccugcacucuucacuuugggaagggcugcccugucucuuauccuuuggguggcacgagcuuuccccugguagagagcuuuccuccggcagauuugcuaagugccggcagcgcucuggcccggaggagcccgcaucugaugccuguucugucuuccaggugaggaguucuacgaagccucccccuaugagccggugaccucccgccucucggacaucuucaggcuugcuucaaucuucucagguaagugagcucgcacugggacuuggcccguucuccucucgucccuguggcauggcagauggagcucugggcuuggacaggcauccuggcguccgaugauggcccugcugcccaucagcucgucccucaacgguucugagccucaguuccuccucuguaaagaacacgaugcccaccucccugggugcuucuauggagcaaggcguugguggaaauugccuggccagguggcugucauggaguagggcuugaaucuggaaccuggugucacccuucuaucuuacccuuguucccucuuuccaguucccuggcucuccugcuuuggagcucuuccacuuugucaaguugcuuaaccugucugggccucaguuuccucagcugugaugggggaguaccguaccgaccucauuggauugcugcgaggucuaagugggucagugggugguaaagugcucagcacgccgcaucagucagcaucagcuguggcuuguuauuacugguccuauaagaucuguucugcccuggguuuucccucucucuugagggcucuucuugaaccacaugaagggaggugucugcaggagccacucugguccucaggccacccccugugccauccuccuugggaagugauaccgucuccauuggguucuagcuuugucugccaggcuccacauguaggcaccagguaaagcucugggggucuuucuucucggcuuuguucucucuggcaucugggagacacugggcccagggcagcccacccugccugggcacuggggaggggguucuggucuugggagugcucuguggggguggggggugagcuccucuaggggauugcuggagauugaugcuccagggguggccagaguggggcuuguucucagggaucuuugagcacaggaaaucucguuuacaugcaguuuuguggcagucugaaauguucuggaguuucuguggcucuaaagcgggguuuucaacagcagcacuauugacauuuugggcugguuaauucuuucuugugggaggagccguccugugagucugaggauguucagcaauguccccggccccacuggaugccagccgcgcucuugcaagcugugacaacaaagauguccccagacagggccagauguccccuggggggcacagucacugccaguugagaagcacugcuguaaacugugagcugaaagcauuuccagugagaaccuaagcccuuucaaauaaagaacucucuaggaccauguuucucaaccauucuuuuuuuuuccauuauuguuuuccaaggagaaaaaauaauucuuccuaacuagagaaauuaaauaccaaggaauaacauuuugucuugaagguuugaguuuuggaggaccauaaaccauuguaagaucuccuuuuucuuucucuuuuuguccacccaagaaccagcuuuugcucccuugaggugacgcccguccuucccguggagaaagcacgcucuaggagauugaaacagggaugauacacgugucccuagugggagaaaucuuggaugcccaggaagggaggcacuggccaguggguggccaucuggguguggccuugggcacuggcggugguuggggugguggugaauggagcggagaccucaaagucagcuguguugagcaccuugcgcugggcugucagcaucauaacccccaguggggucauacagaggcucugagcucagagcagcucccaugcuggcacugccugugggcaccauggcagcucuacgguaagucuuggccaagggcuggacuggauggggcugagaguccuucccgcacaggcauucugauucucacauuuccugaugaguuuugcauagaaauccacuugggaccauuccuucugagacagugcucuggggcucagaagcagguugaggaugccauuggccuguggaugcuauggugggcacacccugguggccgccagaugcacccacauucuacucugugugaagcucagguaccggcagauuacuacugcgugcacaggugacacugggcugcccuccaguaauaaauagcuuugacuugcuccuggauguugaagcguagagauccucgccuuagcccaagccccuucugcucccuggacucaugcuuaaguaucuuccuagcagaaaaucuuuaccuaauggacuugacacucugugggacaggauguugacaagacaaaugaggaaguuacuaggucugcagcucaccgaaucagcccccuuuuaccugcugcccagagauaacugggccccacgcaaacucuggguuucugugcuccagggaccacucccugccaugagggcugggcuuuggggacugugccggucccuccucauugccucuguugacucugcuccacccagagaagcguuaggguuaggugaguaggcagcugugucuggggagacuugggcacauaguugaguagggaggccccggcccugcuaccaagaaaccaagcuggggcugggcacaguggcucacgcuugccuguaauuucagcacuuuuggaggccaaggugggaggauugcuugagcccaaggguucgaagcugcagugagccauaaugacaccacugcacuccagccuggucgauaagagugagacccugucucaaaaaaaccucccaaaacaaagaaaagaaaccaaacuggccauggugaggagcucagcagaaagaaggugagaacaggagcugggaggcgguuccaaugcaguccccaccacagaucaccuguaggaucuuggguaggcucauuucaugugccagaucuucugucugaaugaggacaugagcuuggagcagugcuucccaaccuuugucccaucaaggcacacagaaaauggugaugcggcagggugagcagaccagcuuaaugcucaggccaucacgagccuccugcuugucaauauccgggcacauguaucccccaccugugugucgcacgcuggcugcaaagucuuguugugaguaucccaagaccugcacuagagcuuuggcauuaaaaggcugccaccccauaggacugcaugaaaucccgugggaagccccuccccacccaacucauauugccugcgugcugcccccuucacuucucuguggggaaagacuguggguagggagggaggcauggagucuugguggcugcuucuggguuguacuaccuccaggugggacaccagggaggaugcuccugugucuuugggacucaguugcuacuaucuguuuaccagcuccugucugagaauucagggcccuguuauaggggccuccuggaacguguauucuucuucaucucuuucuguugggguucucggaaagucguacugggauucuguugcaaagaagcugccaggauuccugcaacacccuccaauguccagaagccuuggggaagggcagcuucuucccuccucucugcccagugcugccugacaggcccugggcucagcagugggucaaugaguccugaguccagggcgaaggagggagcaguguggcuguguccugagucacagcgacagugauguuggacguguccacauauccuucccuccccuucuaugugggaagagauuucauggagaggaagugaguuuuguccuguuucuagcaauucaaacugcccuugaaagugugagacaguauuuagggaggugccuggaagagcacgggccuugagccagaugguccuggguucaaauccugacucggcuuuuuaggggugugugaucuuggggcucacuguggccuuuuugagcuguggugccuauguguguaagauggacaugugaugcccuaagaggguucggugggaauggauguuggcacagugcccacggcgcaucagggacugagccagccuuggcgcagugggucauccucugucugccuggggugcucaguggaggcaggagguuguuuaguuggaugcagggguugaggagcugaaguggagcauccuccucauccccaggcuccaugacccugugaaugccgaaucccagcugguuucaccuggggaggcaggagaggguggaaccaagguggggaagagagauugcggagggaaggaggaccuggaagggugguguggagccagcagggguguggacuuguggggcuagagagaaguggguggacaucaaaguggugaugaagaggacugggcggguugggcagaggcauccucaccgccacugggcccaugccuaaaggacagggaaaaguggugggcagauggccuuggcugucaucaggcacugugucugcauccugggugaggggcaggggcucuggggucuggccaugccgugcaaguguggcuagaggcuugggcauggggcauccuuucugaagcuggaagggaacuuagggaucauggaggcccacuccuucaccugacagaaggggaaacugaggcccagagggaaggcacacauguugaugggauuccaaucccugucccaccucugaagcgcuucuccucuaagccccaauccuguccucucccccagccuggagccaauggcaacaccuaccucugaggauuuuuguuaagacuaaaugagauagugcaggugagugcuuggccugagccuggcaugcugcacuaagccagguuagcuuuuaaaacauucguauggacugauuucuccaagguucgauggcagguuguggcugggccagccuagaacccggcauucuagaaacugugugugccuuugcugauucgaggccaccuuucacgcugggauagugcuugguggugacuggaguagaggugaucaggugauuuccagagagcugugggucccugaagcucagagggagucuuggguggggacggccaucauguacuaugcugugacagggacagauagaggcuggugagcggccuggccucaguggccuuugugaacugaagguagaagagauggcauugucuaccgugguuggccagcaugcaucuggggugggccaucuugcuugguuggagccuggagagggccaaugauguucucauuggaugcuccugugguccuucuuggaggaugggcucaggagaggagggaaauagcacucaaacgcuaccccuugccaagaagccuugcauacggccucugagagguaaccaccaccggccccuggugccacagcacuuuguccuuuaucauggugcucacugccacguauugagggcaugugugcgauuguacguguuggucucuguguccuguguggccaucacccucugcgugugugugugacacugugcuuuguaucuaauacauggcccccgaggauccuggcaucacggcuggaaugugaacuuugaggccggcuaguccucguuuugaauccuggccuuacccuacugugggagcucagggucacuagacccccugaaccucauguuucuuaucuguaagguggagcaguccagcugcccugcaagcacuggcaugcagcgugccagggcacaggagcacccuaggugcuggugaaggguaucaccguucgcugacuggagggagcugauggcuuugcaggaggugcuaagcaauugugaggugucacaugugugugacaucuuaggaguaucuggggcauugagaagggguggauccuggccguggugugcaggaaucgaucauggaaggggcagggcaggggcggggcuggggcggggcuggggccagacuucggaggagcauguuuuguucaguaaauaaugagugcucuguguguuccggagacggucaaccacugcuguaagagaaucagaccuguguccucacuguguggugcaacagguagauacucauuuaggcacucccuaaguggcuuguuuucaguagcaauguagaccaagugcugccccaagaguucaggggaggcagcaaccagcaaugccuggggaaauugaggaagucuuggaagaggaggaagugcgaugugggaaugauguuccugguggcaucauggcugggaggccuggcuaagccuggggugaugaaggaaccucaagucuuuugagccugggggcucaggggacggugaacagggaucauuguggcagacaggacaguggccucucuggggugcuccagcccaggacuucuccaugacagagcucaggaugacugccugauuaggggucucgggucccuagggaggagcuggucuguccuugguguggggagagacuuaucccugggcucaaaagucaguucccaggaagacaccccuguggccuuggugggggcugugggaggauugggcccggcuuugcucggccggugucuagggaagccccuugccuucccugggucggcucccucugugcaccccaggcccggaggcaggagacccagccuuugugcaggcacccccugcucuccuugggcugcugagcaaaagaauagacggugaggcuuuaauguuucagcaggucgggcuggugccucucagggacccccuuccgaggccgcccugugaugaggcgggggcacagggggcugagggcagggaagaacuggaagaacagcagcagcucucccugcccccuucaugguggcucgggcgauaaacugcuuauccucagguugucucccugagccgaaugcagaagcauguuauuuaaauuucaaaaucacauucuucuucuaacagcugucagagacucugagugucaacgaaaauugggcuuuagcugcagcucugucaccuccgacaccuccccuuucagggagaauucagcugauggccaaggagcagguguggggugcaagagagugggggcuauggagacgaggagagguggacugucaggagguggagagaggugacccagugacucucacggcgcuuggggccgccaggaggaaggcagcuucccucuccgcagguggcggagcuggagggaucgacauuuucccucuucuguuuucaucugcucucucucucucucucugucaacgccagugaccucaggcucuugucagucgguagaaggauuugcuggcacuaaggugugagcaggguguuggugacuucaucugugguugccuuuguguccaaggaagaaauugcuaugaaaaagacgaggagggaacaaaauuuagugcccccucccacaaccaaagccucuuucauggugguauuucaggugcugugguugaagugagauuuuuuuggaugaagguauuuucuggguacccuccaaauaacaucuuccagggagccaccugccugcuucuccuuccgugugugaggcaggcucugccaguggcugggguguggggcggcucuuggccggacgccccugcucugugcugcucuugagauggcgcugguggggcuccgggcucccugagcacgcccuggcuucgccaucaacugcaaucacuccggcucagaaaacagguugugagcacgugcccugggcauuccccucccacccaugccugcacgcuccuguaacccccgugcacggugaggaacagcgggagaggggucauugugugacgggaacacgugugugugccugguguguggagaguguaaguacgcauggcauaugcaugguaggaugugugugugugagagaggugggguguguguguggaggcgguagauauguauaggcagugguguguguguaugugguggugguguguguaugugaugugugugaggugguguguguguguguuugggcaugguggauauguguaggcggugauguguggguguuuguggugguguguguauaugugaugcaugugugugguggugugaggugguguguguguaugugauguauggugguguguguggggugugugugagauaguguauggggugccugugaugcguguguggugguuuugugcauggcaguguguguaauauaugugcugguguauguagguugugugugguauguaguaaguguaugagguaauguaugugugucggugguggaguguguguagguguuuguguguguagguauguguuagcguguguguggauguggggugauguacgugugcgggugugugugggacagggugugcauaggugugaugugcaugagguguguggagcgugugggugggcgguuugugugugugggucuuuggcaguggccuucugucugaagggacaggacggaaggagggacagggagggaggggccagagcggcucagaacagucucagcuccgaccaucaggggaaugaccccccaggccccuguucauccucuuaggggagccauggaaagaggggcucaagggggaggggcauuagaaaaagggaggccaucuuugccugaucaguaacaggaauguguggacugcacuugguucguguguuuggggcguccugcgacuggaggcuuccgcgcuaacucggggagcuuaggcucagagggaaggugugugaauuuauccccagauaacucacugagcacccucugcgggccaugccuuguucgaggugcugaggauacaucagcgaacaacaugggcgggugcugcucguauggaguuuauguucuucuauuagcuggagacagagaaaaauagaaaacaagccaacaaacaaauuaacaagacaugugagauagugaugaaugccaagcugagaauuaaaauaggaugaugggacagaggugacugggaaccacaaaaucugacucacaggaaggauccagcagugggaagaugagggaaauggcagauggaacagcuagcgaaaggccugggugggguccugcacguggagggugggacccagggaagcacauguggcuggaaccuuuuauuuuaagagugaugagaaaccacuggaggcauugaggcgguugacuagcacaguaugaucuauguguuugaaaagaugacucuugcacuguggaggauggaucauggggcugggcacagagcagaguggagccagggagaucaguuaggagguugcugcagacggucauaggugagauggagaggaugcaugggcugggaauauauuuuggaggugggguugaaaggaagugggaugaauuuauggacaacucgauauuuuguacuugaacaacagugaagcugcuugugccauuuacuaggaaggagaagaugagaggaggaacagauugggaaguucagugggcagaaauuaagaguucuguauuggccauuuuaggguggaguugccaauuagaucuccccccggaagugccaaggacacaguuagauguaggccuggaauucuggggagaggucaggguugauacauggauugagagugauuagcauauagacaguguuuaaagccacggaaccaugaggucauggagggaggguauauagucaggagagugaggcugggucucaccaaguagaggaggaagagcuagcaaaggcagcugagacuagggccagagagggagagagaaaucagucagcugugucagaaaagccaagucaaguagaagugucaagaaaggggaagugggucagguguaguggcucacaccuauaaucccagcacuuuggaaggcugaggcggguggaucucuugaguccaggaguucgagacuagccugagcaacauagcaaaaccccaccucuacaaaauacacaaaaacuggcaggcaugguggcacaugcgggugguccuggcuacccaggaggcugaggugggaggauugcuugagcccgugaggucaagguggcagugagcugugaucaugccacugcacuccagugugggugacagaguaagacuaugucucaaaaaaaauaaauaaauaaaaaauaaaaagaaagaaaaagaaagaaagaggaagugguuagccuggucagaugcagcccagaagucaagccagugaaguuuagagaagugacuuucugauucagugacauggaggucacccaugaucuugccagaauauucuucuuggagggugagguuggaauguugacgugaggaggauggaggagaaaaugugaagggagaagguaaaaucagcaaccagaaaucuacucuuucaagcuuugcuaggaaggggaguagugaaauagggggcuggguaguggucaagggaaggcuuugcuuuugguuuuguucugucuugagaaaggcaaugaugguggcacauuuguaccuguugggaaaggucccaagagaggguggaauugaaggauguaagcaggaaggggcgauuucaggagugaugucuucaauaagugaggagggaugggguccauguggcgugcaccagcacgcauggcagggcagccuuuggcgaggcuggagcuggguccuucuaacagagagaaggcagagcuggauguccaggugagacagacuggucacuggugggugacaaggcgagggcauuucuguccaaaucuauuuucuuaucaaauaaugaguuaaggugcuauggucucaauauuugguccugcugcccaacaaauuuauagguugaaauccuaagccccaaggcaaggguuuuaggaaguggggccuuugggaggugauuaggacaugagaguggagcccuuaugaaugggauuagugugcuucuaaaggagacccuggagagcucacuugccccuucuaacaagugaggacacagccagaagauggcugucugugaacaagcaagugaguccucaccagacaccaaauccaccagcaccucgauguuggacuuugcagccuugagaaccaugagaaauaaauuucugugauuuauuuauacgccacucagucugugguauuuguuauagcagcccgaacagaccaagacacaagguaaucagcuuaaacaggggaaggugagaaauggcugcuuuaagccauuuggagcuugagauugggaccucaaagugagaccagucagcugguguguguguguguguguguguguguguguguguguguguguguguguguguguguguguuaccuagugaccuuuggcugcucaggagccagcauggaguggggguggcuggguuucacuggguuuauugguuugugacuaugauggaggaagagaggaggagaggggcugaggagcucaggggguuucaugcaggcugggaaguguaggcuggguagggaggaauugaggacaggguagggggacggaugagggagagcaaguguuugggucagggggucagggucugggagagguugaggguuugcuggagugggaauuccagagagggagcuggaaggugaggagaggguggcuugagguugggaugugaugucaaccuuucagcagggauuuggauguugaugaaggucaaggucaaggauaugacuacggcaguggggagcuaaggguaggaggagaucacuggaggcagauagaguguugugcagacagaccgccccuguugaguggaagccucuaggaauggugcccaggaagggaugaaccggagauggugagccaggugugaggucauuccugagagaggggaauggcaggguuggugagugacagccuccaggggaguaggggcagcugaugacaugaacuucccaggaggacagauggggcagaaaugaugaggagaaaggaggcccccagccauccaugagcugcccaauagccacuucuuucaaaauuaggaugcuaaauaacaaagucacugauuuuacaaaaugcauugauuuacccaaacuaagucuuugaauuauuuuucaugguuuuagaaauucacauuuaaugguuuucauggcuuuugaagauuuuugcaaauggucuucauagcuauauuuuaagauauauucaguuuuugggaagcuaagggucaugaguugauguggacuucuuauggugagaaaaguauauuucauaaucaguaaacaaaaguuuagcuuaugaugggugcuucaaauccuguguccauucucuauaccaucaaauaaaaaaugcuguggaaagauuuagguuaaucacaucaauaugaaaugccucaaauuugguuuuuaaugguuacaaauacaaaauuaaacccaacucaucauugugggaauuuuguaugagaaugguaaaaacccuaaauauuaaaaaaccccccaaauaccaaaacuauauuuaaaagaaauaggccacucaaaagcgguugaaaaaauuccuuugaaugagaaagauagaacuuaaauuuuuaauugucagaaccacaaaauuaagacuaaccugaaauuugaggacuuggagaaagaaauuuaagugugguuaaaauuugacaaaauauaaaaugcaauuugaaagguuccaaauugauuuuauuucaaauugauguucaguguauuugccauucgucaaauugauuuuuggcggguuagccugcuuccaaaaaugcagcuucaccuggagacugcugggugguccuggugucaugguagggcugggaaugaggggaaaguucagaaagaaaguugagauuauaaagaagcuuggacuaagacuuccaggacugauuugaggaggguaagcacccugaccuacagagcaguaggggacaaggguucaggucccauuggauccuugggcuuugauugacaacugagaggacugggaggcaaggcucugcuauuggucuugccagcuccuggggacggggacacugauguauugcuuccagcuagaugguaugguguuccuggcccccacuccugguggugagggggcccagaagggaggaagaugccccgagaucuugcuugggauggagcagaggaagcccugaagaucuuuugcuuauggaagggaagacuggggaccauuuuaucuuuugccacauaguguguagaggccggagcacaagggacugacuucuuuuccuagcagggcaguguaaugugaagguagccagagaggugagaugggagggaggaccuuuccagccaggggacacuuuuuuuaauuuuuuuaauuuuuuuagacagagucucgcucugucacacaggcuggaguacaguggugacagcccucagcucacugcaacuuccaccucccugguucaagcaguucucgugccucagccucccgaguagcugggauuacaggugcgcaccaucacgcccagcuaauuuccauaucuuuaguagagaugggguuucaccauguuggccaggcuggucucgaacuccuggccucaagcaauccacccaccuuggccucccaaagugcugggauuacaggugugagcaaccgcacccagccaggugacaccuuuuuaaacaagcauuuauugccuguguacuauggauuggaaacugcaagggguauuuucauccacauugucccuuuuucucuuagcauaguccucuguguaaggcagguagauguucuaucccaguuuugcaggugaggaaagugaggcucaaagagguuacauaaccugugcacacuugcucugauaguggcccagccagguccuccgucuuccccacaagccacugcuggaccagggucucugcuuuuucugggacuccacacccaaaggggaaaguuuccaucuguuuacuugugaucucucaccugagcuagaaugugagccccaggauggcaggugacuuggugguuuuauucgucaauccagccuuacuuuacacacaguggguugucaguaaguguuuguugcaaaaaauaaauggaucuugagggcgggcugggguuggaugcuccaugaggagauccaacgugaaguguggaggugaugcacauccagcaugagguguggagaugacagucauccagcaugagguguggaggugaugguugugguggcuuuaacccugcagggagggcugggauuaggggcaacucccuggagucucugcuccuggacccucccuuucucuacccgcccuugcugucuuccuuccagcccugcugagaguuuauuuauucuacaucucauugugaguugccccuccacucacccuuaugccccuaaguauuugggggggugucaguugaccauccuccuuuucgaaacucuugccuuccgugaaaucagcaucucuugauuuuuccaccagcuaaagguccucuccuuucuggccuccauugaacauaaggcgacccagaguucuguccugacuuguuuccucuucuuuguucucauccccaaccuguggcgccucacugaguuauguggcuuuccacaaccuccuccaguaucaaccaugccaaguuuugugucuuuagcccagaccucuuucuugaacuccaggcuuguggacccuucugccuauucaacaucccugcuucgacaucuaauagacaucucaaacuuaagucaaaaacagaauaguccauuucauucugccucucuucuuuccuuccaagucuuuccuuuuucgugaaaugauaucuccaucuacuuggugcucaggccaaaaauccaagagguuuucuugauuucucucucuccucccacucaaaaugcaagcaauccuuggcuuuaucucuaaauuauaugcagaauggguucacauuuugcccucucugcagucaccaccccaccccagccuccacuagcuuucugcugcuucagcagccugugacuggucuccuuuucugcuucaaacccucagauauacccucaguuccaugugucagugaaugaggucaugugccuuccuccuuaaugcucuccagcgcuuugcauuuuagaauaaaaucugaaguucuuaccugccccgcaaggucuccccugacugucccucugacuucuacuuccucuaacuucugccuccuccaggaagcucuggcaaccuuacccuuccuuuugauuaggaacgugccaagcucauagcugucucaggaccuuugugcuugcuccuccuuugcuuggaauucucuuaccuuguuuuuguuuuugugugugugguccauuccugcccgccauuuuagucauucuaccucaacuugaugucaccuccucggaaaggccccucucuuauuugcuggucauucuuuuuuuuuuuuuuuuuugagacgcaaucuugcucuguugcccaggauggagugcaguggugcgauccugacucacagcaaccucugccucccggcuucaagcgauucuccugcuucagccuccugaguagcugggauuacaggcacaugccaccacacucggcucauuuuuguauuuuuaguagagaugggguuucacucuguuggccaggcuggucuugaacuccuggccuucacugauccaccuaccucagccucccaaaaugcugggguuacaggugugaagcacugcacccagcuggucauucuuuuuuaaauucccuuauuuuccuuucuuuaaauuucuuuccuuccuuccuucccuccuuccuuccuuccuuccuuccuuccuuccuuccuuccuuccuuccuuccuuccuucuuuccuucuuucccucccucccucccucccucucucccucucucccucccucuuucccucuuucccucuuucccucucucucuuccuuucuuucuuuuuugagccagagccucacucugucgcccagguuggagugcaauggugcguucuugccucucugcaaccucugccuccuggguucaagccauucuccugccucagccucccuaguagcugggauuacaggugcacgccaccacucccaacucauuuuuguguuuuuaguagagacgggguuuugccauguuggccaggcuguaacuccuggccuccagugaucugcccgccucagccucucaaagcgcuggggcuacaggugugagccacugcggccgaccuuuuuuauguauuuuuguguuuacucucagucuuucccuuacuagagugaaagcuguaggagagggaagauucuuucuuuccugcacacagcuggauuuuagggccuggcauguaguugguguaugaaaauauuuguugacuggcuacuaaugcagggacuccgguucugcuccuggagagguggguaugguugggugucuucgugugugugugugugugcaccucggugugcacacaugcuguugaguuugcacaguaccagagugggcuccuuuuagccugccacgguggaccuguggcuccggcucaaaggaaugaggugagacagcagggcuuucccuggcccuccaucccugagagucuugcacugguguguuggguggguaagugagagaggcacaaaauauaagggauuaggcaguucaaaacccgucaucauucagguaaagaaaugagaccgagaaaggcacagagauuuaccuggggucuucuucagcuuggagaagcagagacagaauuaggacccacguucuuuaaccccuguuuaaguaguagaacuccacaucuugguucagggacccagggugggcucagggacggacacugcagcugcaaaugggaugaggggcaguuuccugggaggcaggaagggugguuaaaacaccuggguccccauuggcugggaagcuuuacaggauggggaaccucuccuuucugcccacaggcacauuugcgauuggaaagucuaccuugaagauccucucuguugggagguggcagagggggaugaaacaguugaagggcgugccuaggugacaguagcuggccacagaccaccgucugugaagggcaggcuugcuaaauugugugcugggugagguguguguguguguguguguguggggagugggccaagggcagcccugcuccuccccuaagcuuugggucucaguuuuuggaagguggccucagaaucacagggagcuugugaaauccagaugcccaggugccagccgcagagcuccugacucgguggggccugugagucacaaaugcaccagaggucaagugccuuuucucuaaaccggugacuucccccuccgagugcauugcacaccacugcuagaaugggagauggggccgacgaauauguauuuuuaucuuuauugcauucuaauggguuagaaaaauucagaaccaacauagguguuaucauuuaggauaaaucuagauagguauugaaaaacguaaaaggugagucaauaaggaguuaaacagauucauuauuuaagaauuaagggauuuagguccagugugguggcucaugccuguaaucccagcacuuugggaggccaaagcgggcggaucaccagaggccaggaguucgagaccaucuggccaacauggcaaaaccccgucucuacuaaaaaaaauacaaaaaauaauuagcugagugugguggcaggcgccuguaaucccagcuacucugaggaggcugaggcaggagaaucgccugaaccugggaggcaguggcugcagugagccgagaucaugccacugcacuacaacgugcgacagagugaaacuccauucaaaaaaaaggauuaaggaauuuaaagaaaaaaucaauuaaacauuaguagaggugguacuguuaauaugaccaaaacgagauagggaauugaaauuugguaaacccagcucaauauaaaagccaaauaaauauuuaaagaauaugaguuuaaagagcacucauaugccugccugcugggggugggggcuuccagugucuggaaucacagccuaguggugcagaugggcucuuggcucagggcagcacuccaggaauuaacaggagaggcugggcuggguguggcugcggcagggcaguuggggaggcugagcugcagccucugguugugcauuccucagcuguccugccccucugcugcuggcugugcuccccagcuggcugcgcuccccgggucuggcccucacccagggaguaggaggggaggagaugaagaagccagaguguccccuagggccaggagcuggagguugggaggaugacuuaacugcgguuuuggagaaggccaaguguuaaaucccgccucccucucccuugggcagcuguuuaccauuuacuccuuggccaucaaggcugcucucagccagccugggagacccaccagggcuggcgcuggagcacguguugaguucaggcucuccagggccagcccaggacugggaucaauuucuagcuccggaauaucucucaggucuuguguggucucagcucucagugcaggggaucggggcagggagacggagggggcuggguuuccugaauccccauuuccugcccuuuguacauuuuagcucaggggcuguagccccagugccaggcaaggacugugaggggucuugguaggugagguuuguauuuagaaucccccaccuucuucuucccagugggaacucaccuuccugacaggagggacaggagccuuaggguagguggcagggcaguggcugucucagaaggaauguguguccaguuuuucugcugcagauggcaguggcuggccaugugcccagcccugaccccaccaucucccucauaaugaaaacgcagcgcaggcugccuccuuggugaggugcuuggcagagccucagagcccaggcccgcuccuggggucuuuucucccgucauccggcccacucaaacccgguuccugcugggaggaucacgggguaucuuccugguaaccagguaggagcugcauuucuugauuuuuuuuguuuccuaggaaauuuaccaaguuuuggcccaggaguuuacacguucugcccccuagcaaaagcuuucacuauucaagcuccaaauggaagccacggaggcuauaauuacaccagcacuagcucaggaaccugcugagaggagugggaacggagcaccuggggaaccugggggcagccgcagcccuaaauuagcugcuguuccgcuugcaguugcuaaccuccucucuggggucccuccuguugucucuccucaccuuggcccccggccgcuccacuccuccagccagcagccagccagccucugacaggugcguccuacggcuggccugggagagaaccugucccuuagaggcaguguccccacaauagcccuuguguugacaggcauccugggauccuucuguccugggcagaaugguuugguagcagcucaaggaauugccugagaggccacaugccccaacauggcugaaggcccuugucuuggcauuccuugccuugguuuccauguucagucguauugaauugcuugcaguuccucccagcgauugcaccugcuccccucugugccugggauccuuuuucugcugucuuuacuuccucugaguccuccuguagguuucagcagugaugucacugcuuccaggaccccucccccggcccccaccaaggucuggacaggaugcuuuucucuccacaccugacuucccugacacagaacucacauuggcaugggcugcuccuccgucccuagcugugucucuggcaggguugcagccucagugucuggggaagugccuggcacauaguagguccucauuaaagauauauuaauggauugauugggaaaacaaaccuugauucucuuucugccuuaauuucccccagccuccauuuuuguaguaaaaggcuuauuuuuuuaagagugguuuuagguucauagcaaaauugagaggaagguacagagaguucccaucuacccgcuacuccuccccaggcacagccucuucaacuaucagcaucccucuauagagggaugcauuuguuaaaauucuugaaccuacauugacacaucauuaugaggcaaagccuagaguuuacauuagaguucacucuugguguuguacguucuguggguuuggacaaacgucuaauggcaugcauccuccauuacaguaucauacagagugauuucauugcccuaaaaaugcuccaugcucugcgucuuccucccccacuccccacugacuccuggcagccacugaucucacugucucuguuuucccuuuuucagagugucauaccuuuacaaucauagggugugauacaugucuccuuucauguagguuuucuccguguccuuucaugauuugauagcucauuuccuuuuaucacagaauaagauucuuuugucuggauguacccuccccucuuuuauuuuuauaacaagaagagagggcacuuuucucuuucugccuuuaaagggcuauuguuggccaggcacagugacucaugccuguaaucccagcacuuuuggaggccgaggcgggcggaucaccugaggucaugaguuugagaccagccuggcuaacauggugaaacccugucucuucuaaaaauacaaaaauuagccggguauaguggcagguccguguaauccaagcuacucaggaggcugaagcaggagaaucucuugaacccaggaggcagagguugcagugagccgcgaucacaccauugcacucccgccugggcgacaagagcaaaacucugacucaaaaaaaaaaaaaaaaaaaagaaaaaaaaagaccauuguuggucagacaaaguguugggugaauggcuuagucuucguugaucaucccccaaguuucaggucugggcuaggccccacaugguccuguguugaucacuguugccuacucuguaccauuuugcuugcuuaauaauauuagucaacauuuuuugagcacuuacuguaaaauagacacuggccuaaauacauuuauuccaucaccccuuaaauaccuauugcauagcaccugccugucaaacacaggguacuagggacacagcacugagcacagcccugucuuccuggagcuuguauuugaugcaaacaaacaaaugaggaaguaaguacauaccauggcagauagugaugagugcugugggaaaaauaggucggaguagggguacauggaaugugcaugggguguuguuacuaugugugggguggucaggaaggacucacacauuagguaacauuugaacagagucuugaaguagaugaggagagugguuguauggcugugguggggagggagagacuuccaggccaaggggacaguaagugcaaaggcccuguggccacgccgugaugggcguguuccaggaagauccaggaggcugggguggcuggaauggagggaaaugagccuggagaaaggaauaggaggugaggccauauacagccuugcuggcugauggaaauauaauaugcaucacauauauaauucuacauuugcuuguaaucacaaaaaagaaacaggugaaguuauuuuuauuacuacauuuguuuaacaucauagaucaaaaauaccccuucgauguguaaucaaaguaaaaauuuaugagauacuuuacauuauuuuuuucuuuucuuucuuuuuuucuuuuuuuuugagacagagucucccuuuguugcccacucuggugugcaauggugugaucuuggcuuacugcaaccucugccucccggguucaagugauucaagugauucuacugccucagucucccguguagcuggguguaguccaccacaugucaccacgcccagcuaauuuuuauauuuuuaguagagacgggguuuugccauguuggccagucuggccucgaacuccugaccucagaugaucugccugccucggccucccaaagugcugggauuacaggcgugaaccaccguguccagccuacauaauuuuuuucuuauuacauuuucaaaaucugguguguguuucaaggccuugugugaacaugugaaaugacccagccacauuucagguucagcagccguguguggugagcggacagcauuucagaaagcacaaauuguucugucacagcaaaucagacagcacacauauagagguguguaggucaugcugaagcccccgaaugagcuggggaauccaaggggggcuuuggagccuaggagcaauggcugucugcuguagguucuagaagguucucuccagcugcugugaugagagaagauugucauggggugggguaugggggcacagggcaaagcaggaggcugggagaaggaggcucuuaacaggcacagugucgguggcucagauccagguggcagcaguggcgguggugagaagugucuggauucuggcuguauuuugaagguggagcugccaggguuuggcaguguaugaauaagagucaaagaagcgccgagaguuuuggcaugggcuacuggaaggaugcaguuguuuccagcagggugaggaagacugucauaaguggagggaagccccagguuuuggggggaaauacgggguuggguuuggaugugucaagugugagauuuggguauuaggcuugcagcuagagguguugaguuggcagguagacagauaagucuggggcucagggcagaggucucguccggggguauaaaucuggggguuggaagcacagugaugguguuucaggccaugagaugagucccagggagcaggugcauguagagaaaaggagacugagcccuggguauggaagacgggaccagcaaagcaggcugaggaggagacuguggggagguggcagggagcccagcagagaguggaaggaggcaggagggaggaauuggcuguguccagugcugcugaugggcugagggagaugaggccuguggauuccugagcauccaucagacagguggggccaaacaccaggcugaagcaggucuaagagagaaugggaggagagcaagggacaggugguguagacaacucgauugagggguuuugcuuucaaggggagcagaaaaauggagugguagcuuaagagggguguguggucacgaggaggucuuuuuuuaauugaagaugggugauguaauagcugaugggaauggucuagaagacagcaaaaucaugauguaggggagagagaaaaaaaugagcugucucauucaugcuuacaaaggcccuaugugguagauaccaguuugcagacaaggaaacugaggcagagguucagccauuugucccaggucacagagccaguaaguaucagggccaggaguugaacgccgauggcugagcucuagaaugcccagucuuggcuauugugcuguucuccucuugguuuucuggcuggaguugugagcucuuccagagugggcccuccucuugcgcuuuuauaucuaacacggcacccugcagagggcugugcagagguaggaccugaucaaucuuuaaugggcaagugauuagaacaccaggaacugugugcuguaaguggucagucagucaccuggcccacgugagagggacgugugaccucagccuaccuccucaccccaaguccuucccaccaccuugcgggaccuuguguggagagaguggugcucaggaaauacuggaaagcauuuguagggugggugaagaauggaugaggagcuuagaccaacgguucucgcuggcauaacugcacuacugggugugacucggguuccugugcugggcaaccuugggcaggccccuugcccacacagugcuucaguuuccuuaucuguaaaauaacaagguugggugaggugaucucccaucuggcucucaccagaauuccucaggagggcaugugugugcugucugcacccaggcugcugacaaucccaucaugagcauugucugaccccaaaugccaguguccugcuggugggugcacgggggcccccucguuguaugacgcugagccagucacuuuauuucccauauuuguaaacagggccauacacaccugguugcuugccuuuuaggcuugugaugaauuuuaaguccacuauuguccuagauugccaugguacagcucacccugcaccagcugcuuccuaagcgcucccucaaccuguauauuaacuccuuuacuccucaccacagcuuuaggagguagguccugugaagugauccccauuucgcaaagggggaaacugaggcacagagcaggcacauggaagcauaucgaguacugggagacaucuuccagugagggggcagcuguguccuccucaugcuuguguggccucugaccugcucucuuguuccuccuccagggacaggggcagacccgguggucagcgccaagagcaaccauugccuggaugcugccaaggccugcaaccugaaugacaacugcaagaagcugcgcuccuccuacaucuccaucugcaaccgcgagaucucgcccaccgagcgcugcaaccgccgcaagugccacaaggcccugcgccaguucuucgaccgggugcccagcgaguacaccuaccgcaugcucuucugcuccugccaagaccaggcgugcgcugagcgccgccggcaaaccauccugcccagcugcuccuaugaggacaaggagaagcccaacugccuggaccugcguggcgugugccggacugaccaccugugucggugagugccgcggcagccccgguggugcuggcaggagggcgcuugcauugccaggcuguguuuuccuuucucugcauuccuugggugcaucgaauuaugacccugaguccagcagaaagggugucaaaaaggguaaaacugacuuggacaugugcaaaaugaauuuuccauuucauucauccauucauccauccaucuacuucuuuauucauucauuuguucauucauucacucagaacagguuuaucauuugcuuacuuugugcucagcuggggaaaccaaaaugaacaacccaaggagcuuauaauuuaaaaccacagacuccuugagucuuggaaugagagaccuuugggugcaguggcucaugccuguaaucccagcgacucaggaggcugaggcaggaggaucacuugaggccaggaguuugagaccauccugggcaacauagcaaaacucagucucuaccuauauaugugcguguguguguguguguguguguauacacacacacacacauauauacacauauauauacuuacauauauuauauagagcuaaauuucagcucaguauaaccaugcauaccccccaaaacuaccuuccuaauaaugaggcuacuauguugguaagcacuuacuauguucuaggcucugcgcuaagcuuuggaccuacguuaugucaucuaacguucacaauaacccugugacguggguauuuuuacuccuauuuuauaggugaagggauggaaggucaggaaaauuuuguaaacuugcucaagguuacauagcuaaugagugguaaagacaggauucaaagcuaggaccguccgacuccaggacccauuccucacccugaaacuagacuggaucagaccugaauacagagugagcuggcuuuauauauauauaaaagggacuuuagacaauuuagucccacuucugaagaaaguuucugccuaauaucccaacguaggucacguggcuaucaggaaaggugcucucauaaaacgaagagccagcucacucuguauugagauaugauccagucucaaugaucauaugagugaggaaugggucagggugaggaauggguccuggagucggacgguccuagcuuugaauccugucuuuaccacucauuagcuguguaaccuggagcaaguuuacaaaauuuuccugaccuuccgucccuucaccuauaaaauaggaguaaaaauacccacgucacaggguuauugugaacguuagaugacauaacguagguccaaagcuuagcgcagagccuggaauauaguaagugcuuaccaaguguagccucauuauuaggaagguaguuuuuuuuuuuuuuugcagggggaggggcgggugguggugcaugguuauacuaaguugaaguuuggcucuauauaauucucacauuuguccuuuuuguuugcuaaguauuuauugagacucuguugugugcaguucuugguccuaagcccugagaauacaggggaaacagacaaagggagugguaaucccaauucagugggaugaggcugugggcucccagaggagagagcacaggagaggggcaucugccauauccuggguguccaggggaggagggggccuugaccugagccuugggaaacaaggaggagaaagccagggaagaagccuguuggaaaagcauggcacaggguggaagugggagagggccugggcucuggggagcugcagguguugggcacauguagagugggccgugaugggaggcaagucgggggaggcuguuggagaaauggggauuguagugggugcagguguuuauagauagccuguuguguuguggacacuguucuagaggcuuucugucucauuuaauccuugcgacaaaacugagguaggugauauuaucuuuaucugucaaugaggaaacaucuggcaaguuacagagaaaguaacuugcugaaggucacacaaccauacauuucagagucggauuccagcuaaacugcuucuuuccaguauuauugagugcuccagacuaagauagugaguguggguguggagaaaacuggauuauuucagaggagauugggaaguggccuugauggggcuaggugacuggcugaaagucaccuggagauagaacccugguggcgagaacuauuucuguuuuguuuacuccacacccuguccugcauguagagccuggcacuuggugagcauuccauaagguuaguugaauggauaaaugaaugaugucuaccauguuuccuaguugaguaauucuggggagauggagccauucagugggggugguauuggacaugcagcauuugaggggccugggggacuauugccaccuucauggcaacacauagggggcacuuggacuugugggucucgaccucaguaaugaggcuggaaagaagagauggguuuggaaguuauugaguacuuugcuggugauuaaagccacagcaguaaaugaaauggccuaggagggguugcuagagcucaggagggagucugggcuggagaugccugaagauuugggcauccucaguguuuaagugauaaggcuuggagcgaacgguggaggcagaaaucuacuggaaacaccagugcuuaagggaggggcaaaggaaguaggaugugagacuggaagggaaggggguuucagagggaggaggugacugagcuguggugucucacagaguguguauaugugugugcgcaugugugcauguguauguguaugccugugugcaugugcauguuuaugugugugcaugcgugugugugugugugugugugugugugugugugugugugugugugguggaagauggaccgcagugggcccggccuggcagggaggcagaaguagaggcauuggguacaaaccaccuucuucagaaggaaccagggccagggccagggaccgcagagagaugggagauggggaggagagcuggggcccugugcacacugaaggggaagugguacuuuguuugguuugcagaccaagcucuccuggaguucggagaggggccugaucccagagcuagcugcagggcucagggaaagcucugugaagaagguggguuuuucucuuuugcuuacuuaaaaaaauauaucuuauugccuacacaaaccgauugaggcgauugaagaugaaacuaugcauaccacaaugaggaaggccagccuuagagaggaggagggagcagauguggccacgcugccauuugccacagugacugaacuugagcuccgagcuuccuggaugcugggauaaaggggaggcuugauggaccaaauaacucccccaaacaggauagaugggagcaugauuugagacacauucgcuucuucuucugaaugcuaaaaugaccuugggggcugcauccuacacagcugcguggaaugauggagcagaccggaacugggccuugaaggggcuggaaaagaccaggaugaauccaagcccaggacccaagcguaggagugggcugggugcgcucaaaagcuggaggacugcagggggccuggaaucaagcugcucaggugucugaacuaggcaucucagguagaggaguggcugggacagggcacccauuuuauuaguauugcuuuaaggaaggguggauaaugugacaauggaguggacagcuccuaccaggccugcagcccugagaugggggaguuuggagcaggguaacuuguggcuuggagaacgucugugucaguuuaaagaacuagaagcauuuuuucuuuuuccuucucuuuuuuuuuuuugcuuuucuggaggugggggaagcuaggaaacaggagaaucaagugauacacuucacacaguggaaccagaaacggcguugaaacagggcuaaguauugggagggucaggacugaggaauccugggagcugagggcugacaguuucugaggugugcugagccaagcagaugagcuucuugcacugggaaauaaauuuaaacaauggagacuccagggcccacaagcagugcuaugucuggauuauugaauuagguacauggcucacuuuaggaggccugggauccugaguaggaaauucugauugcuccaggauguggcugggugagcuccugaucuugaagcagggcauucuuccaaucccucuuucccuaucucccaccaacacacccaucugcaugcaaauuucaauguggucccgaagagguagggaaggaaugagggcggaaccugcauuaggaagagucuggcacgagcauggagaagugcccuuuagggaaccuugugcaugauggagaguugagguuuggggcggggugcauugagacaugcauccggagccacagagacugagaugcacagacacugcaggugauggauggagguugcugugguggugccccagagucaggggaccuaccuuuacucuucacuugccuggggccuccugcauggucuucagugggcuauuucacuccucaugcccuggggggcucuucaucgaucaaaugaggaugcugaaccaagucaucuguagggaccccgaggucuuacaagucuaugguucugauucuguugaagcaguuuuccugucugcuuucucccucugcuccugcccucuccacuagagguuauuuuacuggagagaugagcucuugguauaaggggaaaugacucagccagccucaucaggguggauggugugggagcagguauuugaagggcccuucucaccaggcucuucccugggccgggccuggaaggagaggaguggcuucuuucuacacucuugcaggccugacuugccaacccaagugucacuguccccagaauccacaaaagugcucaguuguccuauggaugcccguuguuagcaucagaggugacagguggcucaagggggcaccuggagagcaggaagcugggucauggcucucgacugugccugggaaggggugcacuuccuccuuucccugguuugacuuccuccagguuucugaccgcagguggaaaucuucauucugaaaaugggagagcccaaugccaggguguuugcagcaggaauugcagaacccccaaccugccuuugcugguacuuuaaugaaugaagccggccuugauggguguccugggaaagccucucugggcuugugacucuggaaguaaggccccagcccuuggcaucuccuaggagcaugcccaugcugcagugcuacagcacccggcccugauacagccaggccugcuuggccccuguggucccuccuccugcugagggaguuggccuagagaugcccaggccuccugcagggggaaucuugguggaggauucuugggggaagcucuuccagagccgaccucaccuggcaccacaugaaagcaagcacaucgauucgccguguggcacacugcguggcaggccuuguccgucacccgugugagauuuagcaggcucugcaugcugucuuauuaaaugucaccagcgauaaaguguuggaggguuccuuugaucuaggguuuaaagaugccuugguuaaacaaggauaucugcuugcugggccucgggguuuugggaagcacuucugaauccucccaucauccuuugaacucagagcaguuuggggucaguggcugaggauggagccucugggaguggaagcuuugggcucuacugacaguuccaccuggcuuugaaguugcaucucaggaaccuuggcuuaugucuuuggccuuugucugguucauaucgcacgagccuuagggcuguggacuuaagcuaagugagcaucuagggauaggucaggagagacguuuccuuuaaaagccuucugauaaggagccuggaaagccuggagaacuucuuggaaugcauccauggcauuuggcuggauucauuccagcccccacagugggccaagaucuacauuuuaaaaacacagucuuucgguuuuuacccucucagcuuacagccauugcaaagaugggcucagauuguguguguguguguguguguguguguguguguguguugguggugguuggggggucgugggaggaugauucuguuguucucuaaacugugucccuaccaggccucauuuggaagcgguccucugaaaugcccuguuccucuuagucugccaagagaacauaaauaacuccuugcuggcuccgugccaucuccugggcuguaauuuaaccucugggugcugaggauguguauaaauagauuccagccuggagcuacccuggcaaccugggcccuuuccugcaguggacacugcccuugucagagaggcuuguugggaagcagaggaaguugggcucaccucccucaaggcuguccucagggggugggaaggagucccuuccacacacucucuuucuugcccagcaugggggguguucaguaucuucaggcaguguggauggacaggucuggguuugauucuuggcuccuugggacugucccucagcuuaauggcuuuccauaggaucuguuggcugauguuuuuagcagaucaucucuaaauggcagcaagugguuacuugcacgggguuacgugggcuguggugcuuccaagccuucacucccuuuaaaguagagguccuugaauaucuugaaauuauacagaaaguuuuguguguauuuucuagaaagaaauuuguugccuucauuagauuuccuaaggguuccuugaucucucaaagcauaggaaccucuuccuucucuagaugaccaacuuggauuggcucccuagagaaggauuuugagucuggcuccuggcucaguagcaaagagggcugugauugauuagcgaugccugccacaggcauaggaggggcagcauggauguuccacggaacccagccaguccucccuggggccagcagauuaucuauagcgggaggaguggggguccugggacuauuucuuuauuaauuucacuacucuuuauuggucauccacuuugggccaggcauuguguucgauugggggaguuaaugaaguagguagagcuuguccuugcggcacuuagaaccuaaggaggggacucuuugucaaucuugucuguggugggagaggagccccacuaccauuguagcuacaauuguguagaagauagcuuuucacucagguucucuugaaaucccaauucuacuaggucuucccuggguaacccugcuggcauugcagagcagcccuugcuuaggggagaugagucacagaaaaguaaaaucucgcucaggggcccaucuggccuugagcagugcccagaguccaauagccacauccagccccagagcaaagcugugcagaggagugucggggggaaaaggccacccccuuccugaagaaccuaacugcaaggagccgagacccugagauccaguuuccccuuggggaucccauguggcugcuguugcuggucucaguaggggcucugcucacucuuuaacucugggccaaggguccccgagugacccucccuggaauuucccgcgacauguugagacaaggcuggaauacuggauauuacuuuacuaaaggcucuggggaaauaaacacagagagaagcuccaaaucagagcucuaguuuacaagauaggauucaugcuucacccugcuguggcugcuacugcuuggcagggcugcacagagccuucaccuuaacuuuacaggcuucucucaaggcaucugggcuccagaggcucacaccccagguggaugagaugcggauccuguuuggcuaaggcucccacuuguggaguugugcuugaggacccaggcaucucugagugguuggggaggagugacccauucguggcaggucacuuacacagggagaauccgaaugcaagccagcauaguuuguuuguaccagaggccucaccuacaacugggcguguguuuguucacacaggggcagacacacuuucagccacccuggucuugcauuguucacacuggcucccugaguauuucugcuuucacucacuggcauggacugucuccuugccugguaucuuagucaguacaggcugcuguaacggaauaucauagacuggguugcuucaacagcaaacauuuacuucucauaguuccagaggcuggagaucugagauccuggcuggguucuugauggcaccuugauccauaaaggcccugugaugagggccuuuuuccugguuacguccucguauggucuuuguugaugugugcacgcagaggcagaggagagaaagagagagaucaaucuguugucuguuccucuucuuauaaggccacuaaucccgucaugagggccccaccgccaugaccucaucuaacccuaaucaccucccaaaggccccaucuccaaauaccaucacgcuggagauuagggguuuaacauaugaauuuuggggagacacaaacacuacauucauaacaucuagacuuccccuccaucaagccuguuuggcucccauucuguaucuuccccuggucccugcuuuuccagacacucuuuagaacuugucuguauccuuccugugacaucacguggcuuuccuuuaauauuuuucuucccaaucaguccucuguuuuuaaauauucucauuuuauauuacuaccucauuggcaucuuucuuucuuucuuucuuuuuuuuuuuuuuugagauggagucuugcucugucacccaggcugggugcaguggcaugaucuuggcucacuguaacuucugccuccuugguucaagcgauucuccugccucagccuccugaguagcugggacugcagguacgcaccaccacaccuggcuaauuuuuguauuuuuaguacagacgggcuuucaccauguuggccaggcuggucuugaacuccugaccucgugaucugccugccucagccucccaaagugcugggauuacaggugugagccagugggcuuggccagcuuauuucuuuaacagcuguuuguugugugcccacucugugccaggcaccaugcuagacacuggcuacccccuggagaauacagugucaguggucucugcccccuuggagcugacagucugauggaggaggcagauggugagcaagcacacagacaagcaucuagauaaugcugccgaaaugagcaggauguggaaauagagaauaacaggggcagagagggggaaucugcuuggccaggaaaaguuuaucugcaagaugacauuuaaacugagaccugaggaauggggagccuggugucagaccaagggagaaagagcaucacgugcagagggcauagcaugugcagaaguuugcaggagggaaaggggggaaagguguggcuggggcagcggggcucagagagagaugcacagguugagguugggaggcaggcaggggccagaucacucggggccucacaggccacagcaaggaguuuggacuucugaguacaguuggaaaggagcuucugaagccaagcagugcauugugaaaaacugugauaagaaagauuacucuggcugcuguguggagaauuaagggaggaggcgagaacgacugcagagaggccagggaggagguuauuuuagaauaacuggaucagagaugauggccacucagcccagggugguggccagguggagagagauaaguggauaaauuggagauauuucggagguagaagugauauaccuggucuguggccugagggugauggaggagcucaaggaugacucaccggcuucuggcuugagcagcuugguggugaugguguaacauucugagauggcgaaggccuggcgggagauaaaucaggaguuccauuuugggcauguuaauuucgagaugccuuugagacauucauaucuggugcuugacugagguuguaaauucugggggcauuagcguauuuauggcauuuaaagcuagaggaauggguaggauucuccuagggagagucuggguggagaggaggcacugggaaccugccuggcacccugucagugcccaguagugcuggaugcuguuauuaugguauucuaggagucaaaagaauguguucugaaaaagagggaauggauagccgugccguaugcuguagagaggucuggaaggaugaggacaccugggucaccauuggauuuggggacguggagggccuuggugacucuuacacagaaguuuugauggauuggugauuacggaaaccugaucggggcuagagaaauguuggccaguugguugguuagagcuuucugggaaagacauuaguggaaagggaagauguuugcccuuuggguggagacauggcugaggagagcucaauagcaguuuggcuuugauggcugaggagagcucaacagugguuuggcuuugggaaguguggagugaggucgaggaaggcaggagagugagagugacccugccauugcagaggagccagucccagcugcucugucaucacacugggcaagucucagccuugggacagacucuaguguggggagcacaccacuguuggucuuugauacugacucuguccacugcacugugcuuaggacccuagaaugucccacccgccauguccucccugggcuuggaggggccacgauauggcugccaccaacucagcuucuccugcuauggcuaaaagaguccuucaggugugggaagagacucuucuccacaucacugugcucuugugagcaaccuugauggcccagccccuuagagaagccagcucucgggcugcccagaggagccuugcuuuucggcuuucaaucuuccuccucgaggagguguuugaacagugcaggggcuguuggagaggugccccuggcuccugcaguggaaguccugcccaggauguuuugaggauguggccuuucccguggcagccuugggauaugcucugccuuccacgugggcauccccaggggggaggcagcccugcucuccuucuugugaaguggcuuguggcgccuggguguccuggauccagcucucagcuucagggcccuuuuggggucucucauggaagacucagaggccucaugcagguagcccuguuaucucaggguucucuaaauguguuacuuaauaagaggacaaagucaagucagggggaagggguccuggauuaggaguuacacuaaauccucacacuaucccugccgauaacuaacucugugaucuugauggaaauuagggugaguugcuuuguuagguagugaguuccccauccucaggugcagaggcuggagguccucuugccagcauuagaggagugucagggaagggguguuggaggugagugggcacaucagaucacuacuggcauccuccugcuuagagcagaaugaggacauugacuuaugagcaaaggagcagugagcuauuugcucuucauauagagggagagggaaauuuggagaucacugucccuacucucccugguccaagacacauucucugaguccaggaggaacccuucggagcaugugacccuucuucccuccauccaugggggugcacugugaucucugggacgugcccaggagaagaauccugaugagcuggggucaaauagaugcucacucagcagcugcaggagcugggcauguucuucacagcacggagcuccuguuuuccuugucaaaauaaggacaguagcaccuccauggaagcucuggaguccauucaggaggccuuucguggagcucugugucugggagccuugcaccugggaugcuggagugaaccgcagaccuucccuaaggcgcccacaggcuugcccuggcugucacaugcggggccggcccccacaggcuuggugggguuguugagaaggccucuuggaggugaugucuaagcuggguuugaaggaggaguaggccuauacuaggaggaggcccuucucucuguuccuugcagagggcacaugcguguaaaacuagagguaccccagaggaaagagggacccagcucacaaagccguggacucugggccagggagucugauuuuccccagaagacgguggggagccaugaaguauuuuaagcaagagauagacaugauucaacuaguguuuuagaaagaucccuuuggccgcugugugcagaugaguuggaggagagcaaggcuggagacagagacucccuuaaggaagcugaaaugugauggagucugagauaggaccaaggcagagggcagagggcagacgguacgugcucagagaccuucagaggucagcucccagggccucacuggaugcagacagugaacgggggagcuugggauggugcuaaggucuguggccugguggccagcuggcuggugauguugucaccugagaaaaggggguggggaagaggggaggaggaggagggggaggaggaggagggggaggaggaggaacgggggagggggaugaggagggggagggggaugaggagggggagauggugguccuugucuggcauggagggacaauguuuggguuucagacuuauuugaaagccuuuggaacaugcaagaggaaaugucaaauccaaaaaguguuugugugucugcgaguuugggagagaggcaggggcuugggauggagauuaugggauuaagggaaauaaugcaugaaaagcagcgagcauccggcccggcacacaggcacaugguaaacaucauuccuucaaagaguguuucagcucguuuggggagacagggcucacccgugugaaccacuguuaacuaugaagaggaggcccuguuugauuagguguuguaaggauuaaacugcucgauguaggcauucugagaagggaagcugugaggcugggagagccagggagagugguguggagacaggguccugcggcggggaccagagggagggaggcugucuugggcggaggcuucugggagaagaggacaggagggggaggcaggacugagccuccuggacggcgggacuguacugcucagggcugaaggugccggcugagggaggagagucugugcgcguaagguuggagcuuugggauguccuggaagacacugaacaggcaggggcuccccuguuccucccaggcaccacaccuaccaguccucaauuccagccagcucaggguucucuaaagguguugcuugauaagagcaugaaguagagucagguggaggggguccuagauuaggaguuacacuaaauccucacaccaccccuuuuuuuuuuugagacggagucucacucugucguccaggcuggacugcaauggcgugaucuuggcugacugcaaccuccaccucccagguucaagcgauucuccagccucagccucccaaguagcugagacuauaggcacgcgcuaccaaugccugauuaauuuuuguauuuuuaguagagaugggguuucgccauguuggccagauuggucuugaacuaauucuaugaucguguuggaaauuagggugaguugcuuuguuagguaaugaguuccccacucucagaggggcagaggcugcaggcccccuugccagcaucagaggaguauuggggaagggggcucuuuuaggucccuucugagcauguguaacucggaccugcuguuucuugggacaggugaaaggaauagaugaugugcucuuggaggccuccccuccccuccccucuccuccccuccccuccccuccccucauuucuuccuuuccuucuuuucucuuauuuuuucucccuaauucucaaaaugaaauucacuuuacugcuuuguugauuauaaaagcccuaugugcucauuauaaaaauaauuucaggacagagcacaguagcucaugccaguaaugccagcacuuuggcaggaggauugcuugaggccaggagauugagaccagccugggcaacauagugagacacugucucuauuaaaaauacaaaggaaaaaauuagccagauacgguggugccugccucuagucccagccacuugagaggcugagauggaaggaucgcuuggacccaggaguucgaggcugcugugagcuaugaucuugccacugcauugcagcccagcaacagagugagacccugucucugaaaaauuaaaaaaaaaaucggacaagacagaaagguauaccuaaagaaacuagaaauuaucuucaauccuaacaccccaaaauaagccauggcuaacauuuuggagaauguaacuugcagcuauuuuuuuaggugcauauacauauuugaacaaaaaugaugucacacaguauguguuguuuuguaggcuauuuuuuuuucucucuaaauacauuguuaacauuuucccacuggcuuuuuaugagagucuguuuuuuccugaugggugugugucccuguggaugcuugaacagcuuggcuuugcacacuuguccauccacucucauugaagaaaugcgugucuggaccugagccugccagaugguagggaacagccaugugcuaggcuuuccaggggaaggguaugcgcaggcaguaagacccucagagagcucuuggauccccaacgugggacuucccaaggugaagggaggagagggagcccgagugaaccaguggucuucacagcagguggggaguguuucugggcaguuucaguuucuugaaagcaacaagaauguggccaggugcuuuagcuuacaccuggaauccaaacacuuugaagagggaggcaggaguucaagagcagcccuggguaacauagugagagcccaucucuacaauuuuuuuuuuuuuuuaauuaucugggugugguggcaugggcccguagucccggcuacucaggaagcugagaugggaggacggcucgagcccuggaggucaggcaaggcugcagugagcugugaucacgccaugacacuccagccuaggugacagaguacagacccugucucaagaaaaaugaaaacaacacaacaaugagcaccuggcuauauuguuguuucuuucauuugggcuuaugaaaccucgccuuuaaggagguuggcccaguuggggguccucagagagaccacucagcaccagcaguggguggggaaggguucgucuccacacagcggcucucugugcucuggaccaccuugccuacuggcccaagcacucugccucaucuccugugugugugcgaaggagaacugggauagagguggucgcugguauuauggugcauagcaaggggccuggcagggguggauugggggggggcuugguuuccacaucuuucuacaccuucacgaugggauagauguaugcuauauagaaaggcaguggcuguggggccuuggaagacaucguugugccugaaaacaugguugauggacuccaugggaugcaagacuucaccuuugugaacccugaaaauuugagacagaucucagucaauuuagaaaguuuauuuugccaaggcugaggaugugagcccgugacacagccuuaggagguccugaugacaugugcccgagguguucagggcacagcuugguuuuauacauuuuagggagacaugagacaucaaucaguauauguaagaggaacauugguuugguccagaaggcgggacaacuugaagcggggagggggcuuccaaaaggugagagacaaaggguugcauucuuuggagcuucuguucucagugagcagagggaugacucugaauagaaugggaggcagguuugcccugggcaguucccagcuugaauuuucccuuuagcuuagugauuuuggaggccaagauauuuuccuuucacaccuugaaacagaggagauauaaaagaucaucacagcagaauuucaucugauagacgaaagaagcugaaguccagagagguaaaauuauuugcccagugucauccagcuaaggagugacaggacccagacaaaaggucaagucucgccucccugggcaggugcccuguucuucgaggcagcuuccauggcacagggcgaacuggacagugagucaaaaaccugggucccagacuugggagauaucccaucuuugaccuuuaguuucauuaugaaaaagaauggacagaaucaaaucuguccagaacaccucacuaggcuguugcaggaaaaaaaagagaaccacugugaaggcaguuggaaugcugcaaaguuaaaaaaugugauguuucccagugccucugcuggccugcagaccuggucugcuuccagcaggagaaaggucugcauguuggguagacccccagaaggcagcaggggcagaguggcaaggaaggcugggugcuuggauacguguggagcccuggcaguggcuucuggcuucuagcugcggguagaaggucuaacaccagcuggauuucaggcuagcccaaucuuggcaaaagggaaacugccucugcuuccuucccuuuucuuccagcuguuucccagggagcccaacagagugccccaagccccucugcuucuuccagaagccaggccgguccacugcacgcugcaggcuuggaaggaagggguuggggucuuggggagcccuucgguggaggcccccaguucagaaagcacgguccccuuucuccaugaggacucaggccugcaucguuuugguccccugcccucccuccccuguggauccaccucccagaggucaauggcaggaaggaggggaaagaaacagaaaugaugaugacuuugauuuuuuuucuuuugucggagccuggggagggugguuguuuugcuuccuggaccucagcggaggagucucugccagacaaucaucucggcgcuuucauugcuuucugaugcuccucuaacugcgcggggucggcuauuaaauggucaucaaaccucagccucuaucccaucaauagucauaaaguuggggagauaaaagccaucaguuuuccauuauagcugaaaacaauacuguagauagcuauuuucugaaugcugcagagagauguacuuuaacuagagcaggguauccagugggcccgggcucagccacggguccuauucggccugggauaaccugccagguguuuaaaaugcgggaagggcuggggcuuucucucccuucgcccucucucuccucaaagaauggaaugggcagaucaucaggcuuggggugcaggaugacaccuccguggugggacuauggguuucuaccuuucauucuaagccgaugcuggggaagaaugcagugaguugucaucugcucauucucaugagaaaggacccuccucucccugaucuugggcuuccggcaggccagggccugggugugggguaggugucugcucaucagaugaucuucagggagcuugggaaaggcaggggaggucggugccugcagggugggucugcguggaucaggaguggcugcagccggaggaagguggguaccugggaugcggaacauuucaggggguggcaucuccugauauacaguccccuguagcuucucacaaacgagcaggccauuuggaaauggauuuugcaaucaaacagccuggcagccggcagccagcagauaaguccucagaaugaacuuuucaucgcacucacagcccaaggcucuccugacucugucucagaagaaccugggugcaaagaccuccugccuagguuuccacaucugcaguggccuuucuuggcaccccuggccucccugaaugggugacuggccucuggcuuuccugccucuggggucuugcaggaauagguuccccugccuuggaagugcccauuccucagcucuuuguagccuguccaucuuuucccuuucagagcuauucuuauguguugaagugguuaaguguguggauuuagcuccacaauacucuaggggguguuuacauuuccuaauuuuuugaauuccuucaaguuccuucucucuagccuggcuagcaggaaauguagcugcagugaacugagcugccccugucuguggccugcaggaccauugggcugggcucacgggacucagaccaggcugaucugugcucuugcaccuccuccugcuggucucaugggggcucccugguggauccuucagcaucugcugggggcucuucccuggguggacccaugugcccccguggcuguaaacuccaaagacccuggauuugcccagagagauaccccccuccccucuccgcagacucaucccucacugccauggggcucccuguucuguagcugccagugccuugcaucugggccauaggacaguggccuuucccaccugcuggcugcuccacucggcaggcccugggcaucuucagcucuugaccuuccuucuuaaggccucugaaaaugaggccucuucuuagugacagacacaaccagacuuccugaccucaaaguccuguuuguccccuggaagggacacaagaaggcgaagggaaaacacaucucauuuauuuuccaucuccccugcugugucucuaggaauguaagaggcagcuuccuugucuaccauguucuaugcagugacgccaggagcucuuggcccgcuggcauguucacucgccccugcauugggcccagggccuggcccgacucagggcccauaaauacuugugaaguucuuaaaugcucuuugucuccuuaaacagagauaguggaagacaccuucaccuuuucuuggugacacaguguuauucuugacucugggugaacuugcacagaugguguacgccaugccuucaggugcuacugacuuacauagaacuguuggcccccauguuaaugagcgccagauacugugacuuuugagucauuguaguuugcuuuucuaguauuucugucuccuucgcuguuugcugucacuucuugcugcaguuucugucugccucucggagcuuucuuccaucacccuuucuccuucgcggguuuucuguggcacagaaaaccagauaauugaacgcguuggaauuauguaugcacgaggagccguuagacuuuaaugggggcgcacaaaggauuuucuuaggaguucaugaucuguuuugaugaacaaacuuuauacugucuguucaggggacuuccucauuccuggcaggcugccagaugagugaccuacaaaugugcuguuuugccggagcccuuuuagauuaaaaaaaaaauauuuuaagaugacuuuggaaaagagagaaggggcauaugaaggccuuuuggaguuagaguuggccauugagauggcuacggaugauggaccucccaagauuccucuguuucuuugcuaaaugacguggccacauccucaucguucucagcucuccuuggugaccuaacauaguuugacccuguguuuuugucacagacuguggguccugggguuugaugaggaugauuuggucucagugggugggguuauggcaccagcauagaacauugacucagaagacgaggcugucaugcuaaagcugucacuaccucgccacgugacgcugggggaguuggugguggugacaguaacacuuguucuagaugggggugcugggaggaucaggcagaaagaggggaucacaugguggcagggccccuuucaaaugaggggacacgcgagccgaguuaguguccgcaacacgaggaagggaaggagcccggggccagaauucccgggucccagcccugaaucuaccucgucucgcuguggaaaccucgggguacgcauggaacuucucugggccugcuccuuuaucuugauaauuaauacuuaucucaaauucugugcuuccuacacuaugauuuaccuuauuucugaaauguggggaaaggaaggagggaagauacgauuugaggagaaccaugggcucagggcauuaauaaagcacgugcugcccugggaggugggaccuugagggcuguacauucuguggccauucugccagcguugugcuucugcaagucugagugagcuuguguggacuguguguguuucugaguguaguaccugugugcguuuguaugugugagagauacagagggcgauggugcuggagaggcaccuggagaaugaggagccacugggaaaauuaggagagggucucuccuucugcauugccauggaaggcucaaaccuucgcucccucuguggugcagauaggggccgaggagugaccuuagguaacccauguccccaucuggcugcagcuccuucauuucuguugcgagaggauggguaaccuguuuuuuuuuugagacagaguuuugcucuuguugcccaggcuggaaugcaauggcacuaucucggcucgcugcauccuccaccucccggguucaaaugauucuccugcuucagccucccaaguagcugcacuacaggcaugcaccaccaugccuggcuuauuucguauuuuuaguagagaugggguuuuaccauguugcccaggcuggccucaaacuccugaucucagaugauccacccaccucagccucccaaagugcugggauuacaagugcgagccaccgcgccuggccgggugaccugguuucuaaggucccuucucgugccguaacacugagaacccaggaaacaccuuuaugaggcccccccucccaccaagagaggcccucgagguccacccugcagcuccuccuccuccucccugaauuccccagaguguggugggaucucugccucucuaauuccaggcuugcugggucugggagcagaccuuugggcccaccagcuguucgguuuaguauuugggcuucuuaggcccagaaacaggagcuccaggcaggucagggcgggauguggucccuuaauucucauggucuggaagaguggagaggagagucguucucuggugacucugagaagcccuuuggggguggcggugggagggaggggagacucagugugcggauucuuugggcugugaauguggguuuguaccaggcugugugagcgaacaagugugugugggcuugagaaagggauuucccugcgagcuugucugugugugucuguggauuuugacaacauuguaggugcuccuucuguaaggaaacugccgucuucuuuaaugacagugaagcccaguuuucucugcggaugugaagaggggaaaucuguaagugcgaggaagggcaggggggcgucucccaggcccagcuuucacucucugagaccuucuuccccuuggggaucuuuuggagaggaccucagccacucccugugggccuggaggggaggggcagcccugcuccccuguaauacucaggucccagugggaaugccuauccacuuuuaaagaaaauuuauauagagacagggucucacucuguugcccaggcuggagugcaguggugugaucacggcucacugcagccucaagcuccugggcucaagugauccucccaccucagccucccgaguagcugggauuacagcgugacccaacacaccuggcuccugucaacuuucuaaugccccacagcucagccagaaccaggcggagagguuuaugacugcuaaguaaaggcccagggagacagagaugagcagagagucaccugggcugccuuguuuuccaggccuggguuggccccguccugcucuggucuugaacugccccaugugguggacaccacugcggaaucugccacucgggcacaggccuaaaugcccgauucugcuguccagaccccagacagcaaggcugcagaggagaacuacccccuccauccaguaguacuaaggugacccugagugagcucuuguguguuagccacggugucaccauuuuaggaauuuccaugucaaaccgugcauacguacccuuuauaacccuuugagguccccacucuuagaauuucuuuguguucagauaaggacgcaggauuagagauuuuaagggacuugcccaaggucacauggcuuaugauaaggucgagcagaaacuugaagcagggccuauucugagggcugcauuguccaugcauccugcacuuucucuccagaugugguccauggacgccacaucuccauccaucauggugcuuaugaaaaugcuaguucuugccugggugccguggcucauucauauacucgcagcaguuugggaggccaaggcggguggauuaccugaggucaggaguuggagaccagccuggccaacauggugaaaccacaucucuacuaaaaauacaaacaauagccggguguggugguaugugccuguaauuccagcuacuugggaggcuaaggcaggagaauugcuugaacccgggaggcagagguugcagugagcuaagaucacaccacugcacuccagccugggcaacagagugagacuccaucucaaaaaaaaaaaaaaaaaaaaaaaaaaaccugguucccggagucuguggaaacagaauccuuggauguagggcccaggaauccaguguguccugggcucccuggggaauuuuguucauggugaggguugagaaccacagugggcgggcacacccuauggcacuggggcccguaccuggaaucagugcugugugguggccuguggacagggaguccaacaaacuaaauuacuuucuaccaucuauuaacaugugccuaauguaugugaugaggaguuuauuuucugacgucgccccugccugugcauuuucuagaacucuuccuaugguagaaggagugugccugggcugaagggcggcccagacucaucugcacggugcaucuacacacuuuuguuuuaauauccagcuggcauuuuuacuacgaaaauaacccccguuuguuuauccucuggaaaauaaucaaaguauuuuccgugaauccagacagucccuggacaugggcugucauugcggagagaccgcggugguaaggagaggacagaugauuggccuggcccucaaauaccgagggaggcccagcggggaggcugccgucugcgggcagacgaggagcaguagcguccaacccgcuguuuuggcggacuguggccugucuaacccugguccggagcaugccuggccuuggggaaagggcacugggaaucuaggaacccgaaccaugccuuuggucauccagccugucuccuggggggggccgugauggggaggugguguccaggcguggagcgcugaggcucaagccccacagacuucugcccuggcagagcgcuuggaggagaggagcacacugggaucugugccccagugggucacacagggcccaaggccuggggacugcacuugagggacccccaauccucuguucuuacacagaggagccccuagcagaggcaagggaggcccugucccuggcucccaugggagguagggcccagcuccagauggcaacagagccugugacccuggagagcgaaagccuguccuuggaggagugaccucucagucuggacacacagaggguucagccugcaucugaaucaaacuggggugagggaagugagaucaaacaccucgugggaacagaaggggaaugaugaguguaguggguugaauaaugucucccaacauuuauguccacccggaacuucagaauguggccuuuguuugaaaauagggaauuuagggcugggcacgguggcucaugccuguaaucccagcacuuugggaggccgaggcagguggaucacgaggucaggagaucgagaccauccuggucaacauggugaaacgcagucucuacuauaaauacaaaauuagccgggugugguggugcgcgcuuguagucccagcuacuugggaggcugaggcaggagaauugcuugaacuggggaaguggagcuugcagugagccaagaucaggcuacugcaauccagccugggccacagagugagacucugucucaaaaaaaaaaaaaaaaaaaauaggguguuugcagauguaauuaagauaagaucauaccacauuagggugggcccuaaauccaguggccaguguccuuauaagacaggaggacacacagagacacaaggaagaagauggugagaugauggacacagacgcugaaguggugcagccacaagcaacggaugccgggcgccaccagaagccggaagaggcaaggaagggccccuccuuggagccuucagaggaggcaaggcccugccaacaccuugaucuuggacuucuggccuccagaacugugagagaacaaacuuguguuauuuuaagccacugaguuugugguaauuuguuacagcugcccuaggaagcuagugaggcggggucucccauguuucuccaggggcugucaccagccagagaaggacugucuuguucauguugcugugaucccuaaggugggugguaccuggcugccuucaugacaauuaauacccccugagagcugggcagcaggggcuuggaugcacaggugcagcuuaaggaagaucuggaaaugggaagggagauuucugaggaaagggauaggaagugcgugggugccagagcucugguuggagacggugggguggaguccacccagggugagggaugacugugguguucuuggcagagggaggugcuggagauagaccacuguuuugagggcagaggccaaguauaagggggcugccuccuuguaagggccuggcuuuccucuuggcagcaaaacccagcuccuagcucagggggacacucaggagagagccacagcguucaagaucaggcagcucuggcucugcccuugugacugucacccccauccuggggucuugcucggauucugcugccauuaccacacccaaccccagcgggugaugcuggaugcauguuggaacagcagccccaacaugugcaugccucugagaggaccggcgggccuugggcuugcacugcagagagaccuggguucaaguccaggccccacacuucccagcugugccacaagucauuuaauuguucuaagucucggcuuccuucucuguaaaguggggaauuuugcacuaccuguguaucucaggguguucaugaggauuaaaugcacuaaugcuuuuagagugcuuagcaaaugccuauuaaacacucaaaauuguuaguuauuauuauuuauuuugaguuugguuggucucuuaguaaauguaaaggcaagacuaaaaggaaauaauuauagaaaacaaacagcauaaaaauacagguuucuaaaguacagauuucagccugagugucugggcuggcucagcauacuggugucuguccccccgccccaggcugggcauucacugggcuucuguaaagggcuucugcccuggccucuugcccucuugaagccaccgaggcccuucagcaugcuguugcugaccacagcugccgauugcuuuguaguaggaucuggucugcaggucucacucuuugucaggagcucgaucagaacaacccagcccugagggcucugcuucaagaggaagucaggaaucuucuugggaugaacugguauuaguuuuggcuccucagccucuccagacuggcugguucugcuuugaagauggaagcuugggugacauccuaugcucaugugugcugcugcccccugcaaauccccuucaaaucaaucacucaagcaggauggguuuggggaagguuugcagugugaggugaguaggaggaaggccuagccgggaaggccaguguccaaggauugugcugguguccagggacugugccaguguccaggaacuagaggacggguccccauugcugcuggccauugcagccuaggcaagacaucguaugugucccagagagaccuccaccaucaaggacucuguaugaugccauucccugugcuaccuguauuugagccuaggggugggccuuuggaggggaggugucaagggagcuaacacuuccccugccaacuccugaaugcuccugggaugggauuauucuuggucuccuuuauguuguuucuauguacacggccuugccauugucucagggcccugaguaccuucauuaaaaugugagaauucacccccugcagacccuuugcuugcagaucaccaaccaucuggucucgaauugccauucccaguuugccuccugguuuacagggcuuugucuaaggccuuccagcaguguuuuuaucaguccauuacuugcagaccuaguacugcagaggaggcuaucaaauggccauucaaggaauaguccuccuauuagcuaugccacuggucgacuuuccucacugccacagauuggcauauaucagaacucacggugcuccauuccagcguggcaauacugggaaucugcuugcucuucucaacagccccgcaccaaccccccagcaaugucuggaugaaagucugccuguaaggacaucugguauaccuccgguaggccaaggggcaacgagauggaacaccaagaaacaccaggccccccacacaagaccaucugcagggagauacugucaggcucugcugcugagacacguuaccuaucugugcaggaaguggaggauuguucccuagagccuggggucagagguagucauccugguucacucuucucccugcagauucuguggcucugaggguauugucuccucugugggcagauggccucucuuguuuccuggugagccugggccaugguuucuggcuuuccauacacucuacucugccagcguccauuccuucugcccuguuugauuuccuucccuggggcuugucuguugagucagccucugucuucugccaccugcuguggggacuccccuugguugacacaccaagauugccuuugaccuagcaccccagaugcccgcugcacaagcgggaugaaggaacuggaguuuguucugcaggaagugcugcauggccaauggucuuauggccagcccacuuucuagccuguugagaagaggacgagugaguggucuuggcgaccucccucuugcugcaaaauuucccagggguguccaaaagucuucccaguggacccugcgggguggaggggggcuguuccuuccacccacuggagagaaucagaggguggugguggaacccucaggggccuccuucugcccuguccugggguccuggugccuggcaaggcuucuguucauuuauccaggcucucuggggaaucucuuuuauuuuuuguaaagcucucuccagaaagcuuuccuguggcugggaucuauuuccugcucucugcagucccauuggccuugcuggccuuccuucucuuccugggucugccuuuucuugugucuggauuuagacucagauuuuucuuccuuugguaccuuguacuucuauauccugucuccuggcagagcccugaaggguggugagagagaccccaguagaagacaugaagaaccuugccagaugccugaaccugcuuguucuaagauaaaugcauucaaacucuugaugaacuaagagucuccucauuccuucuugcuugguguuagaacuuuauauagaagucccauccuuuuucugccccaugggaagagucuaccuggaugcuuuaucuuuuccuuggaugaagccagaggcugcaguucaaauucucagaagcacccggguccugaugcucaauuucuuuacagcagagguuuugagacgguugguaacgaauccagagggacccagugacugccuccucucccuggccugaguggucugcuguguccccucugauuuuuauccagcccacuccauguagggaggcauuggugggaggugauucauugcaagacuguagcucuguguaaccagcccuggugcaugcacugccuacauggggaggccuuggcuucugggccaugggcauggcucccaguccucugaugucaaaggggcaucuaacguugucaccuguuguggaguuggaggguagaaauagagaggacccauaauucagggauuagggagagggccucugacugggggggaaaggggacucuuucacugaggguguguggccacgcguguaucgguuggaguggcagggccuucguaugggucugcguguggggacacaugggagagcucacugcaugcgggcgagaccaagggcccauguucucuccucccuggaugcuguauucugugcaccugaccuuaagcugacagguuagaaccccacaguucauagauucuauuuuuuguaaagccccuuuugugaaacacuaaccucagcuaagaggaaagaaagaagaaaaagaaaaagagcugaguucagcagcugcaguuugcuguauuuuucaucuugcaucagcaaguugggaccacaaauaaucuggucuuauaugcuccagugaugcugcuguuaagacuucacccuccuccuaaggcgcuauguuccugggagccugcauggcucccuucccuggcuucuggcucagguggccaggaggugggcagacagggcagggaguccaaguaggaggaagggcacagagggggaaaagcacuggcuagcauggggguguguaauuaauuucugaaugguuucugggaucagcuaaacauuuccuuuuaaccgguuacccccagccucacauccuuuguuaguucaggaaaaaugucauuuauaauagacauugccuugauaaauugcuccagagaagcacagcauucucauuagucuauauaaugagaaagacuccuagugguggcauagcugcccagauauuugccugauaggaaaaauauuugucuacgcaguuuucucuagaaggcuuggaauggagggcccaaugcccccugaagccugugacuccgagaauauauuugcccugugcuuuuuuagagcagaacccagccaugccugguccucccugcuuccuggugggucugggauguggugggcaggcuccagcccacgguacucacaugagucucuuucucccugcuuugcguccugugcugaaagcugaagaggauuugggugcaauuggacugccuuuuucuuauuauucccaagaagaaagaucauaaacagguauacagccaauucuauuuuucagagcuaguuuugcauagggugguuugguuucaucucccaaacacucuuuuguguggguaucacagccacuuaggcauggagaggugcagcgggcguuuugacccaaauccuccuccucgucucugacuuccuuugcccuucugcguguuugagaauggacacucuacccagccuuccuccacagggacccacuggauucuccucuguagguccccaaggcacuucuucauguuaagaguggugcuuaaggauguguguuaauucucgcaggccacuggggccuccuuuagugaauggcuguuaucagagaaagcagagacacuuuuccaaguuucuaaccaccagugggcaggauaagaggaaggggggaaaggcagacacacuggagggcauuucugggagcugaacuaucuuggugcucaaguuaaugaaacauugauacauuuugcuuugcugcuagcugaagaucugccuauaauuuuacuuuucaaggggagguguuaggagaguucuuagaucuccugcugcuuagagaaaguccuccaugccuccagacacagucccaaucaaucagucccuucccuucccuccccucccuucccuuccccuccccuccccuccauuuuuuuuuuucuuacuaauucucuuccucccuccauccgguggcaacugagucccuuuugagugucaggcauuucuuugggcacugaaguuuuaaacaugaauaagaugguuucuauucugaaggaacucauagcuuaauaggagaaacagauaugaaaaauguaaguuaugauacagugaugccagugcgauaacuggaguuugugaaacaugauuagaguugggacaaggcauucagagaagguuuucuggaagaccugguaccugagguggguuuggaagggugaacuggaggaaguuuaaggagaaggcuuucucagcaagggaagcaacacaggaccaaggcauaugaaacgucacggcuggggaacguguguguuugaaguugcuauaggguugggauggcaaagaggagagaugagaugggagagaucaguacauccugaucauggauggggaucaggguggcaaagauggguuguggaagcccagggacuucuccuucagggacuuagacuagaaauacacagggcuccucauaacagccaaggcuggcaugccaggcauggucccugguacuucuugggaaucucgguuacucuucccagaaacuccuugcccccuuuuauggaugaggagcucagucacagaaaggugaguuggccuaggcuauacccuuugugacuggcagagcuggggcuugaacccaggggauuuggugccuggagucuugcucucagccaccgugcuuccugccucucagaagaaguucaugcucagccuaaaaugccacugaguuuaggccaagcauucaucucugacuuuucuccauacguuaugugucaggaaugugauuugaugcaagaaucucucugaaucuuuguaacaauaugccguggaauaauaggguuugcauggauugugaggcugagaaacacauucuguggaaguugaagggagaggcaauguugggaguaacagaauuggggagggggucugggucuuugaguaggaggucuucagaauugggaaugggaagaaugaaggcuggagcugcuagaacuaagagcagaagaacuuggcuaaugagacuucaguugucagggucuucggacaaauuacuggucuaggaagagcauuugagagagugaccacugcaggggcaccugccacccccuucucaagggaguaaaccuggugcuuucuacucaugagcaggagggaggggaaggguggggagggagaaagggaagaaauccauccucguaccaccagcaagaaccguaucagcauucagagaaaguugaaagaaaucuuucagcuggcuggcuaccuagcucaaggcuaaccacacucuuaacacaauaauaagucauccucacugaauaauuaaauagagagccuucauaaguauugacuuaaugugacagcaagucuauagugacucgggguuugcuuauguaaacacaaucucuuguucagcuuacuuagcaguucaaugaaauagaacaguccuucaauuaaaaucaaaugaugcauacguuuaauucuuucuccucuugccgaguaauaagagguuuggaacauagguggagggauuggggagagaaguggagagaaggggaucugcccaucugcuuguguuuuuggaggacgugaaggaguguauccaauggcggucucaaggagaaggauguggccuuggcucccaucucugggcccugugggaagauccacguggacuuggguuggccucugucucaucuaggcccuccugacccuguuccagagcagacuuggacccccugcucuggguggcauauuggucucuuguugguggcuggggucugauugauugcuucuggucagcugggguucagugcuccagccacagcccucuuaggucauuucccauggucaccuucauggcucccccagaggagagaggggacacugggugagcuccaggcuggauggcaagggggggccaaggaggcagguggcaccacagugacucccuuggauggcugcaggagagaaagaaaacuuuauucuguggcuucaggacacugggacagggggauggguagggggcugggcagaguugggggcuggggagagcacggcagaagggaaaaaccagaaaacccacuggcuuuguggcuaggauuugaaccuaagucuucuggccuugcugcuguguugugaguuaauuaaccucucuagggcucuauuuccuuagcaaaauggagcaaugauuccaaugucagagaacuguucgauuaccacucagugaugguaacgaacccuuguugcguggcccuaugcuaacagaggaggugcuuguuaauaggucagagagaacauggcccuuuggcuugaagggacauagcuccugccuucuacauggugucucaugcuaaggauugggugguggagccuccuaauguuaaucacaacaucagugagcauugagggagugcccacuguguugcaggcacuguucacacacauacgcacauuuguucacuagguauuucauuuaauccuuguaaggacugucuauuagucuguuuucacacugcugauaaggacauaccugagacugggcaauucacaaaagaaagagguuuaaccggacuuacgguuccauauggcuggggaagccucacaauuauggcagaaggcaaggacgagcaagucacgucuuacaugaauagcagcaggcaaagagagacaguuugugaagaaaaacugccccuaauaauaaccaucagaucuugugagacuuacucacuaucacgacaacagcaugggaaagaccugccuccaugauucaguuaccugcuacugggucccucccacagcauaugggaauucaagaugagauuuggguggggacacagccaaaccuaucagacaguaugcaauuaaguagcauuauuaccuccauuuugcagaugaggaaacuaaggccuccuuuaauuaccugcucaagaucacacagccaagaguugcugagccaagguucaaacacagucaaugugacuuuagaaauuggaucucauggcugggugugguucugugcagggucuagguagagggguucuugaagaagucaggaccucuugugggaggagaucaaagauuucuacuucuagcagccccccugaggucuugguuguguccugaaggguuugguggccauuucccaggauagcccuaggcucuuucuccaaccugcaaguuccuaggaucuggagcagcccaggaaagaguagccaggucuucucugagaugguggcuuuucugucucagccacuuugucuuaggauagacagucaguugaauuugcugaggcuuccagaacccguaacauuuucucuaacagaaggcuuagagaaaucauuguuuauaauaacucuggauuccugaggccuaguucaauuaaaguuaaagaaauaauuacaaucauaaggcaaguuuauuaaaaaugaacauaaugaacagugucuucuauuagcaucuuuugaaauauacuucugaaucuuguugguucauaacuuaacauuuucuccauuuguaaccggggggcauaaacucuauugucuccugcuuuuuaacugcauaucaugauuucauguuuaaauuuucauacauugacacgaucuacauccuugccauuuugauagcaauguagcuuucccugguguuaaugucugucugauccguuccuuucaaguuaagcuggagaaauaauccaaggccaguucugucuucuuucaugaauuugaucaucaucugucuucggaguugcucuccuugaagugcuccuguuacugggaaauaugggaauucuugauucuuguauaacuugggagaaagaauucagccaagugacgcacagugaggguuaagcagcagaguuucuugaaggaagauaaaguaagcuccaagagagcagccggcugaccuggcuggaaaaauagcaguagcaguguuuauuuaaagagacagcacacuuugaaggacaagaccgagcaggcugcucagaagaaugagccagcagcagcuagugcugggggacucucuuaaugagaaucuuaccugauuauuccugaaggggcgugagguguuguuauuugcaagcauguuucgggagguccuuugggcuaggguugugcuugcuagucuacguguuacaugucucauuggcauugaaaaucuccaugcauggcuguguuuuuuuacuauuauaaugagcaaaacucuccucgugggcaaauuauuggaggcguaugcaugcuugucaguggggaaagucccaucacguuuaucucuggcuguggcaugauaaguccccuuuagugcuggaggagcccaaucucaaggccagaaguagacaguauagccguugucuuuucugcugagugucagugggcagcaucuccaggacuucauuucccaggggcccccuugccugccuacuucuggccaucugccuacuccaacacuccugcaguccuggcucuuuugcuugggcuggacagauccuuuguggguuuuguuuuuggcccacguggccuuucuagugugugcuucuucugauugcuuaggaccuggacaaaggaggucaugcagaauuagagagugaccuaaauaguagucaagaauguuucugucuuuuuuuuuuuuucuuuguuucccaggcuggagcgcaguagugugaucugggcucacugcaaccucugcaucccagauugaagugguucuccugcuucagccucccgaggaggugggauuacaggugugugcuagcaugccuggcuaauuuuucgauuuucaguagagacagaguuuugccauguuggccaggcuggucuugaacucuugaccucaaguaauccgccugccucugcuucccaaagugcuagaauugcaggcgugagccaccgcgccuggccgaauguuucuguuccaagugacagagacccaacuaccuuaagaaaaauaaaaacagaaucaauuggcuuacauaauaaaauauaggaagggcagaggagaaucccagggacucauguacagauaggucuuggucucucucucucucguucucucucucucccuugcuuuucuuguaccuuguuucugcuucucccuccgguuagcugcauguguauucuuauuaggauuaugaggcuagaauugugguucacaucuguuguaucuuagaaccaaaaagaaaagcauguuuuuccuugccugccccauuaggaaaacuuuagacaaggacccuguugggcccagcugacauuauuuccuuaucucuaggccaguguggccaggagaaaggggugccguggcuucccagcccaggucauguuucccccugggcccaggagguggcauacagccuuuaauagaaccaccuggcccuugggaggccaaggcagguggaucaugaggucagaaguuagagaccagccuggccaauaugguaaaaccccgucucuacuaaaaauacaaaaauuagccaugcgugguggugcgugccuauagccccgacugcuugggaggcugaggcagaagaaucgccugaaccugggaagcggagguugcagugagcccagaucacgccauugcacuccagccuaggugacagagcgagacuucaucucaaaaacaaaaaacacacaaaaaaacaaaacuaucuggcccaacgaggaaguccucuuccccagcccaccccaggggagcugcuguucugggcagaaagaauaguaaguauccacuguacaguuaaagaauaaacaggaaggaagggagccaaguugguccuugacuucaugaaaccagugguggcaggaagacacuggaaaggauggaagaucagguuguccacagugagcccuggaggugugggaaagcagccaugugggugacauucauuuucccuuuucucagugucacaucacauugaacccacuuaaccaaggccugcacugccagaggggacguuagaaagccauuccagaggcacuuggggcuauuaaggccauuuucuccacguuuccauaaauugucuaugaaaccuaucaugaguaauuugcacuucuuggaaacccuuuuuucccuccaugaaauauucaagugccccauuccuuugugucaggcagugcugguggccgcccuuguuugugucagccaccguaccuggccuggugugcuggcugcagguugugugacugugcgauccagccuuucugagcuucuguguccucauugugaaauaugcuacuucgugggauuguucagaaaauuaaaugagauaauagcgccugacacauaguagguccucaguaaaugucaacucccuuucuucccccuccucuuucacuucugcaaccaggacaaaccugguuuccauggaagugacauaacagguaucaccugauaaacgagaacuucagucaggccuggaauucuagcacuuugggaggcugagguggguggaucacuugaagccaggaguuugagacccccugggcaacauggcgaaacccuaucucuacuaaaaauacaaaaaaaauuagccaggcaugguggugcauaccuauaauuccagcugcuccgguggcugaggcacaggaauuguuugaaccugggagguggagguugcagugagccaagauugugccacugcccagccuuggcgacagagugagacccugucucaaaaaaaaaaaaaaaaaaaaaaagaacuucagaccaguauguauugaucagcacuggaaaguuuuggggauccccaauauuauucuacaucagacaaauuugggaaaguaugcucuugggaagguguuuacagccuggaccaggggagguuuuauuaauaacaauuuccuguauacuuccuguuggugaagaccaaagcauagugcugggaaguauguauccaaguguaacugugugucuccguggcgauagguguguguguguuuguacacaaacacgugcacucuuugccacguaacugugggcuuucucuggcuguggcgcaaagcacugcuuuuuuuuauggguaagccauaaaguguggauauuuaaagcugagacuaggaggugaggucugaaagguacccacaagcccagcucugaaaccugugcagguggccacauucucaaacuucagccugccucagaaucccugggagggcuuguuaaggugcagauugcuggacucugcuccuggaauuucagauauugcuuguccggaaccaggcagggagauaggguggagcuagagaaucuauauuucuaagaaguucccaguugauaugaugcuuuuggucugcggaccacacuuugagaaccagugaccuauagaaaguccaccuguacccacgcaaaucuagaugacuucugcuuguguggcuugaucuuugcacacucagcccugcucucuuccccuuugcuggaggcuuauguauucaucaaguacuguugccaagcugggugugguggcucacaccuauaaucccagcacuuugggaggccaagguggguggaucacuugaggucaggaguuugagaccagcuuggccaacaaggugaaaucccaucucuauuaaaaauacaaaaacgagccaggcaugguggcgcacaccuguaaucccagcuacgguggguggggcgggggugcugagaaucacuugaaauggggagguggaggcugcagugagccgagaucgagccacugcacuccagcaugggcaaaagagaaagaguccaucucaaaaacaaaacaaaacaaaacagaacaaaacagaguugccagauccaacaaauaaaaauauuggaugcccaguuaaauaaauauucuggauaaaaaagaaaaacuggcucucccucucccucugccucucccucucccucucccuuucccucgucucccucucccucucccucgucucccucucccucucccucgucucccucucccucuuuccacggucucccucugaugccgagccgaagcuggacuguacugcugccaucucggcucacugcaaccucccugccugauucuccugccucagccugccgagugccugcgauugcaggcgugcaccgccacgccugacugguuuucguauuuuuuugguggagaugggguuucgcuguguuggccgggcuggucuccagcuccuaaccgcgagugauccgccagccucggccucccgaggugccgugauugcagacggagucucguucacucagugcucaauggugcccaggcuggagugcaguggcgugaucucggcucacuacaaccuccaccucccagccgccugccuuggccucccaaagugccaagauugcagccucugcccggccgccaccccgucugggaagugaggagcgucucugccuggccgcccaucgucugggaugugaggagccccucugccuggcugcccagucuggaaagugaggagcgucucugcccgcccgccaucccaucuaggaagugaggagcgccucuucccggccaccaucccaucuaggaagugaggagcgucucugcccggccgcccaucgucugagauguggggagcgccucugccccgccgccccgucugggaugugaggagcgccucugcccggccgcgaccccgucugggaggugaggagcaucucugcccggccgcccugucugcgaagugaggagacccucugccuggcagccgccccgucugagaagugaggagccccuccgcccggcagccaccccgucugggagguguacccaacagcucauugagaaugggccaugaugacaauggcgguuuuguggaauagaaaagggggaaagguggggaaaagauugagaaauuggaugguugcugugucuguguagaaagaaguagacaugggagacuuuucauuuuguucuguacuaagaaaaauucuucuuccuugggauccuguugaucugugaccuuacccccaacccugugcucucugaaacaugugcuguguccacucaggguuaaauggauuacgggcagugcaagaugugcuuuguuaaacagaugcuugaaggcagcaugcucuuuaagagucaucaccacucccuaaucucaaguacccagggacacaaacacugcggaaggccgcaggguccucugccuaggaaaaccagagaccuuuguucacuuguuuaucugcugaccuuuccuccacuauugucuuaugacccugccaaaucccccucugcgagaaacacccaagaaugaucaaaaaaaaaaaaaaagaaaaacuguuuagcguaaguauuucccagauauuaugugggacauacuuaugcuaaaaaaagauauucauugucugaaauucaaaugaaccuacacguucuucguuuaauauggcaaccuuuucauccaacugggggucaagugucucucucucucucugucuccugcugcugcuuuccugcaacugaacaggcuacagcugccaaggaaacacgcccagagaggguuuguguuuuccagacagauccaccugcugcccugagcucacuuggcagacuuagcuuggucucagccgagauggacuuggcuccucuucauuuugguucucuugcuggcucucuguuuuuuuccuaucuguuccucucucucuuucucucugucucucaugccuucuuuuauaccaucucucuuacaagggguuuaaaaggcaggaaacugcaaagugauagggcugauccaggaaaagucuguucucagcagcaagaccagaguccaggagugaccuccugguguuggagggaagagugacguuuggucuagagaaggcacagagaucaccagcagccuuguauuaugaaaagcauaacauuugccuuggagaaauuugccuagcagugcuggggcgaggggucauggcuggagugggacaguguccagggcuucaaggaaauuauaccacguggucucugaugcuggcagagggagcccacugcuguggacuugaucacacguggaggggcagagagaaacuuuagcaaucaaaggccuccuggagccuugggcuuggacucuguguccuccuaaauagcuccauuugucacuuuaucuugccaaggcugcuggacgcugaggauggcgcaauggaggaacagaaggcuuagcugcuucucuucacuuugccguacgcuuugcugucugccgggcucaggccuguguucucccccuccguuugcuaugaauagcucuccaaggcccuggcaccagcaaucaggccugcuuugaaagaaguaggucauaaccucagaggagugagggggugcucuugucaguggucacccgggggccuagccaaggggcccugagugccuugcccugcuuugagggcugugugccucuuccuguguccccagcauggcauggagaaggacgguggggucaggaggcccugguuuccagcaggcugggguaugguagaacaggagagcgagagggagccccgucuccuugaugcgcucacuugcccugugugggaccgagauccaccuugcaggauaagugggucuguuuuuccuucuguaucagacgccagggaaagcuguuccugcugugcacuucaaguggcaggcacagcgcuaggcagagaaggaagaugaggauggugccuccugucuccaucgggcgccugccauuccaagcgcccucacucauugucuccuuagcucucugucgcagcccaaggcgggagguuggcaggugugacucucccuguuuguucacuggggacacagccccagagacaugacaggccagcccaaggucacacagacagcgagugagagauggagcguggccaugcgacagauacccacuccuuccccaguggcugggucugccccuccccucuucccugaggagucccucuggccagccccaccugggucuggaugcuuucaccuucuguuuccuggcuggcuuccucuacucccgccucucucccuauggcccugcucuccuuguggcccgucagggaaauauuugggauuucccaaagggcaaaggaacaggaagccauguacuccccauucaugcugcuguuccuucuccagcguguggggcuggaggcauuugagaagcugcauggauggugaggccagucgagguccugaggguucccaaugucagggaugggagaacuggccuugcgggagggaagcaaggcucccugugcacugggugggaacuggcauugccugggaggcucccaguaccugcagagagugugugggcccucuggucugcuguggugggcagugugcuccccaagggagauaagcaagcaaugaucucccacugccccagucccuggcccccaggcacacuaccccggccccuuagcuggaguuuccuuucugauguugcguccacgcuugccauucccaucuuuugucuguuagccacgcggcagggcucgauguguauuuggagaaaggaugcauggcuaucuacaccugcccagaggagcagcuguggaggauauggaugaggaaaucaauggaaucugccacucugagaauguguguucuaguuggaaaaacccaguagggcaaaaucaggaacugcucaugcaaugaaucuuucaguugccugguccaggcuauguguguguagcuagaauauggaaacggaagaaauccacacagcuaggugggaagggcuucauggggagggacuggugggucaggagagagcugggccugaugcaugacggccuggcguuagaauggacuccugcauuagagcuaaggccuggugcuuggaugcccuuugguggggagaggaugggaaccagcggcuuugcucauuauccaguggccuccuugucccacacccugaaggagcuagguccugccuuuaucuucuugcccaccugcagcccacuccgguguucggaccugaucauauccccuuagcuucuucuggagggagacauuuggccaaagcaaacagugaagucuuugaaagggcugcauucauuuccuggggccgcuguagcaaaguaccacaagcuggguggcuuacaacagaaguuuauucuuucacuguucuggaggccugaagucugaaaucaagguguuggcagggccaugcuuuuuucugaaggcugaaagggagucuguugcaugccuuucucuuucucuuaguuucaggcacugcugcagcccugggcauuccuuggcuucuggcuucaucacuccuaucucugccucugcugucucauggcguucuuccugugugccuaucucuucucuucugaugaggacaccagucauuggauuuagggcccacccuaauccacugugaccucaucuuaacuugauuacaucugcaaagaucuuauuuccaaauaagaucauguuuauagguccuggggauuaaaacugcaacuuuuuuugugggggacguauaauugaacucaacagauuuugucucuaaaucccaucuaccuguuaagagucucuguccccucucaagccaccucuuggaucucuggaggucugggacaugaauggagacucccaccuuccccucucauagcacucucucucauuugcuggcugcggagggggauggauguggguuuugacaucuaagauggaguugucuccugcaggggugaaggauugcuuggaaaugcugcugcugcuuguuuugaggaagcagagggugcauuuaugggcagaagagaaggcagggauaacugcagauuuccuccucguuuccuguggaagacauugcuuuccugaggugcagaaugauggcucuggaagggccuucaagggcuccaggcccuccugcaacacaggagcacuggggccugccagaaauggugcccaccuuguuggagcucuagacuugagucuuggcucugcuacucagugacucugugaucuugggggcaaaguuguuuagcuucucugaggcucagcuucuucaucuauaaaaugggauaauaauaacugcuugucagaucucacggagcauuugugaggguuaaaugauaaaagauggauaugaaaguaccuuuuaaaccaucauugugguaaaauacacauaacagaaaaugcaccauguaaguguauaagucaguggcauuaaguauauucacaugguuccggaaccuucacugccauccaucuccagaacuuuuuaaucaucccaaacaguuaaagugccuuuuaaagugcuaauuagaguacuuuuuauucauuugauacauaagaaacuagagucccggagaagcagggaacuugggcauggucucccagugaguuagggcagagcugagcugacucuugguuugguacccauggccuucucuuagccugcaggguccuggggcacaucccaggaggguuuccuccucucagaaccaucccucaggaucgcgggggccuccagagaaacgaauuuguccaguggugggacauacucagcccgugucugcauggugggggcccccucagcaggcaccagcaccuuccgguggaaagccugcauucucucuccuggcucaggcuggcucagucccucucagccuucugucugucucuccuucuaccuguuccuuucccaaaugggacaggguuccaguggagaaccaggggagcugaaccuguggugaacucggagauggcuucaugaggugcuauaugugcaaaggauguggucaagggauuugggugaccuggguucugguccauccugcagcuagcuugucgagucaccauagaauucucauggagugcauggcgacugaaguccuacugaguucccaucauugggaaaggcccgugaacagaccuuauuacuagcuauuuggagcugcugugagacauaguugauaugauacaugagggcuguguguguggcaaaggacacucaccuguagaaggugaugauugucacuugacauggcagagggggagcauccucccccagcccaggcuguugguaacauuccuggccagggcccagggcaggaggaagaggaaggaauggagauggccaugcauauuagacuuggauuccccauguuccauggaaccuuccaugucuaggucuggagcugagggcuggggacagacccagcucagacacugucugccuucaaguggcucauggcccaguggggaacauagagcugugcacaaggaguuuugaugcagugucaucgaugcugacagaggggaauggguggcggcguguuaccgucaccaggggaagggaaggccgcuucugccuggugggacuaggguagggguggagggauggcagaggagccuuugcucuggcuuaaugcagaagagaccaggggaggaugcccguggcaugucucacccagggagacucuuuugccucccuggccacuggcuuccuugacccucagauagguccuaugaagcaucuagggaagggacuagucaccuguuuugcuggugggauuuugcagugccggguugaaggacuugggcaggcucauccagggcugcagccucucagaagguggacccagcuuuccugccugggguccaggcauucuccacaaacccacccggcuccagccuaaaagagccauuuagagcaggcuguuucugugccuugagggguccuuuuugucagccaaugacuggguuuuucuuaagccgcacuaugugccugucucuccgggaagucucuguccucaagaagcucacagauugagcccccacaaagacuugguucccccgacuuuccuccccucccucuuccuggcuucuuccacccugggaagcugcagggaggagaugccacuggcaggacagaggagacagaaggcagcuagacugaaccccuguuuucucuauugcgucuucuacccaccaccaggucccggcuggccgacuuccaugccaauugucgagccuccuaccagacggucaccagcugcccugcggacaauuaccaggcgugucugggcucuuaugcuggcaugauugguaagcucuuccugcucaccugggcucuguggguccuugcugcccccaucucagcagggcaggggccgcagcccagcucagggccagcugggggagacagccugagcccggccuucucugcaucagauucagagagcugcgaggggaaaccaggggaaaggcaguuuuguaacaaggcggaggaccuagcucuuuaucaugggggaaggagggccccaggggccuccuaaagcuuuugagaaaagaagcaaagguaacauuuauugcaugguucugacauuccaggcucugcacugagcaguuuacacggacugucuuacugaauucucccaacagcucuugcuagcggggugcugauaaucuccauuuuauagaugaggaaacugaggcuguagagcaguugagugacuugcacagucucaccucgcucauaaauaucggcacuggggucugaucccaggaugugagccucauucacccugauuugagaauguuggcugcuugcuggugaaggacaaagcaagggcccacacucugggaggggcuccagggcaucuucucugccuuccugguggcaaggagcccaguguccucuaugcugcuggccccucugccccugcugaacauggucccugggauagucaugcucagaguuaggagugcgauugggauggauguguguuuuggggccaggucagaggauggguaccacgccucugcccugcugugccugggguuggucugugggcccaaggggaaggccccaccguaccucucuccucucccccaccuuucuuccugcccaggguuugacaugacaccuaacuauguggacuccagccccacuggcaucguggugucccccuggugcagcugucguggcagcgggaacauggaggaggagugugagaaguuccucagggacuucaccgagaacccaugccuccguaaguucuggauguucuccccaaccccagcagccccucccaccccuccuggagucuguccuagccauucccaucuccuuccguggggauggcuggugauguagaugaggcuucuccgccauggguguugcccguggggaccuuggguuuugagcuuuuggagauucacaccagagcugucaguaggccagccucaguuuaccaccagaggucuugaaccuaugucaagccuguuauuuggucugguuuguuauugggacagcuucagccaguuuccuuuggagacugagcccucucaugaggaucgcuggcaucugucaugucucccuuuaacgaguuuauuucccccuggaaucgacuuccuuuucacaucgucaaacuccuaacccagaagccagagagagguuagccacagucuagcucagucugccuuugaucuuuccagcccagcacccauugccauccaugcccaccugaagauuucuucccucuuuccuucccuccauuauuuauucuguccaucucuccauccuucuguuccucccucucuguguggcacuagagauucagggauccaagucaucgaggaggugccugacggagguagacugagaggggucacuuaugaucacagugcaagugagcugcucugggcggggggucugcacaggguucuugaggagcccaggauggggaugcccaagucagccaggaagagggaggcccugaaggcuucuuggagaauguaucuguggaugguuagcugggcaucggucaguugaagaggcagggggcgccugccaguccacccugggcagagguccugggcuccacagaagaccauggcggguggagggaacugccaaucacguagccuugcuacauagcacugaagaugaccagaguggcaagaguuaucuggacagguagauagcauccuugucaugcagggccuugcaggccugaggcauuuagaucuucuuguccugcaggggugacagugguacuguggguguuugaaggaaugucagcaagggugugagaucagaucagcauuccagaaagugaaucugccuguguugugaggcagcgggagucagagugaaucaauucugacaggugaccugacacagagaggcccaucagaaggccauaguagcugcucacaggggcacacagugguggcugugaaccagagcagugggaggggaacagcgaugggagaugggguggagggaucuuuaggaggugagcucagcgggcugccagugcuugugcagggaggcaccaagggugacccucaggauucugacaugggggaccaggguagauaagagaugauaccuucaaggcugcaauaugagggaucaaagggaaaggagcguugacaaggguaggaggagacgccuagcccaggcuuagacauaacgaguuugagauguguguggcucguggaggcggagauuuucugggcaccucucuggauggugugggaggagcagaggccacccagggagagccugugguguggagugggcagagggcugaaugugggaccccugcaugccaggguggggaccugggaacauccgaggaggcacaggggccggaagagccugugacuagggagcugggggugaggagcuuugggagguguggcugguggcaccaugcagaggagguggcccccuccuccccuaggcuccccugcaucccacccccuucuuuuucuccuuuuuucuucuguguuccccaucauguacacuucuugcuauucuggcuucuguguuuuuuaaccucucucuugcuauauucuguagcugugagaccuuuguagguaucugaagaagagguucagcagagggaaucuggcugugcuaugcccuguccuggcuucuggaccauuccagggaaggggguggucagggugaagagugugaggagcagggacaggagugacggacguggguucugacuucucugcaucugcccucacccccaucccagggaacgccauccaggccuuuggcaacggcacggacgugaacguguccccaaaaggccccucguuccaggccacccaggccccucggguggagaagacgccuucuuugccagaugaccucagugacaguaccagcuuggggaccagugucaucaccaccugcacgucuguccaggugaggguguguggcugaggcguggggggagcaccauggcaccggaaguggcaugggaaaugacucagcugaggccagggagggaggguccucccuuuggaucagggacccaagaggcagggaggagcugccgggggucauucuucaccaguuccuuuauuugggcauucaucuugcaaguguuaaaccccuguuacaucacaguguuauaccugcuuugcaggcuauagggucugaagaacaggcaguggggcacagccucggugcaggugcagggggaacaaguccuggcuguguguggggcagugaggcacccgucugaguggggcagcaggcuccuagggucaacagugcaccuccacagugccaggaugcaggcuugaccagggacucagccuggcgggguuucaagucccuccugggcacccauugcagaagugcaugugccuguucugguuauggaaguccuccccuucucuuucugcuuccuucccccucccuugugggcuccccugcucaggagcagcugaccuccaagugcccuccuggcgacuggguggggagcucuuccauguccugcucccuccacuuagcuccccuccugauuggagcugaggugcuguugucacccuugggcagcuccuaaugacacugggcaugcuugaguggcugcaagcagggggcuugggguccugcucugcagacaacugcucaauuucaugcuagagcggcgggcagcucagccagucggggcugugccaucugucagguccuccagacucuaccagccuccugcaugcacccuucauccugagccucuuggaccggcccaucuggggagaggcugacuuggcaggaugcuggcaaccuucccaggacucccacugugguuccuuguggucauaagguccaaagccguggcuuugggaaccccacccagcccccuucaccaucagcucugaugauucugaggcccauuuaauucuuuuucuucugcaguuugccgagccaucaguugcuugguuucuuguagccccagccugguuuugugcagucucaccaucgggggccugcucaaaucuugguuugaucucaguggagauaugggugaucuguaugugacaugauacaugcgaaagugcuuggucaauggaggaaugcugcacgaauguuaggcguuacaaauccgggggcuggggaggcugccuggcagguggcuggaggccuacagacuaagucagucugggcaggacagcugagagagccucccaggaggaaaggaggagaaauagacccuccaaagggguccaaccucuaccacucuccaggcuucuucucagagaaauggaagaggaagggccucugauucaguuuuaauuacaauguuuuuauuuuuuauuuuuuauuuuuugagacggagucucgcagucucgcccaggcuggagugcaguggcgcgaucucggcucacugcaagcuccaccuccuggguucacgccauucuccugccucagccucccgaguagcugggacuacaggcacccgccaacaugcccagcuaauauuuuuuauuuuuaguagagacgggguuucaccgcguuagccaggauggucucgaucuccugagcuugugauccacccgccucggccucccaaaguacugggauuacaggcgugagcccccgcgcccggcacaauguuuuuaaugagcaccugcuaucccaugcugggagcuggaagugucgagugaauaagcccucgccccugccuuuggcuugccuggggcuggcaugggugccuccccuccuucccagcccacaucuguccccugucucucagcuccccuagcuuggaccaucucugauugaguggcuuugugguggcccuuguggggucguaggguguuaggggcacccauagcuauagaagggaguaccugagugaucacagggacagagagcugagccuggaugggaggaagggugggggagccuguacacccuagauacacccuagagggagaggcaagguuauuuugcugaucucuguccuccucuguccuuccuucuuccuugggggaaggcuuagggaaccccagagaugguagccaguugggucccuacguggguaucuguaugucaggacuugaaagacccuccaagaucuuccuaaacccaagccaccagaggccuggugaagacagcagcauguccacagccccacagccaguuggcagucgagaagggccagcaacccugccuccuggccaccuucugguuccuccuccuccaaaucugcuccccacaaaggacuuucccacggugggaguggggcuguucaguggggcugugggagucuuggacgccaccacaguagagccaggagcccccucccaguuggcccuguggccgaugucuuagguccuacucucagaagugucuccuucaggcuuuggcccccucucugggcagcccugccucccuggggcucuguggaccuuggagaggccugauagggccugcaaaauggucucuccuggggccuucugguauauuaaauauauaccuugucugaauucccuugcccuucucuccaucccacugggcucuagagcagggaaccugagugucaggucagucuuggacaccugcaggaugggugagcuaccugcuggucugcacuuggccguuccucugaguaagacgucucuccuuguccacuccucuccaccuggugcguccuacccugaugucaccucuugggaaugccuucuccgauuccguccacaccagguugccuuccgccugcucugggcuccugcuuugcguguucauggccccaucgugauguguucuccucuccccugcuaggccagggcccccagaggccauaguggcaucucacccuccugcgucacccugcguagcugggugcacagugccuggcauggagugggugcuuuguucagguggaaggagagaccccgguguccccaguucauuggauucauugaaacucccugcuguccuagaggaugggcucuguguguuucagugcccgcagcucucuuccuucuccuaggugcccucugugcgcaggacugggaagcugcagaggugaaaaugcuuuucuguugaagguguaggaagguuuguuagagacucguggucuuaugauggggccuggaccagggcagugcagugagggcugcagggagacgggcgaugguuggugcuuuccuggccauggccugcuguucucccugacacucccuuggggcuacucugggcccagaaugccaauuuguaggaccccuucagaucagcuggagucccaccuuucccagcaccagggagcccugcaacauaccaucuccuuugcuuccccaucuccaccugcccaccugugauuuggacugccagucacaucuugggcaaauuaaaaaugaguuuugagagacugccccaaggccccccucacugcaugccugcagccgacucugcagccagcggccaccucucucuccucccuccuccugucugcuccuggaugggucucauacccagcacacagaccuguggaccucagagcaugggacugagagaccggucagugcauucauucauugacucaacagaaauucuuacugcacgucacuacaucccaggcaccgaggcuaacaagccucaugggccgggaccauggucccggugcuggaggauugacaggaugaagcucacauggcuaugagggagaaggugauuggugcaccugcugcgugcgggacugguagagggugaugggguccagaagagggagagagugcguugacugggaguggaggccaaggacccgugggcauaacagugccugcugcuaggccugaaaagaaucgggagaaugggugugggguugcagugggcaggcugccccaggugaaucagcagcggagccgaggcacagagucaggacagcacagagugcugagugggggucugcugugcugagugggggucuacuauacugagugggggucugcugugcugagugggggucugcugugccugguuuuacaaaugaaguguuacacacuucacaaccacacccugucugcauugucuucugucacaggcagcacugaguuguggugauggagacagugugagaggugugaguuacuggggauggugcaggucagggaggaaggccaggagcgcugagauuuaggggcggggccagggccagaagcagggagugcaggagagccauggcuucagccagcaggacaacacuagacuagcgccugggccagaccagcgaggcucugggaaugccggccugcgcuucggggguaggcaggaggugggcaaggaagaggaggaagacaaugauuuccuucucgcuuccugggcaacagagcaucccugggagaaagcuauggaaggaugaagcaugccuuucccacuguccuucuucuuucugcguccuucccccagugccaucugcaagggccaguucuuugaugcuucuggggcacccacagcacagcccucaggggucagcucuucccacagucccugugcugccuccaugguggaggauuugcuguuagcagccuuguguccugccauccuugcagccuaggccugugugcuuuuggacuggagccacagaugccucuaggggaugagaagcucuggguagggauggaguaagcuccaggcuauuucccuagacccacaggcaggcuucucuccccucuguguauucgucugcugugaaggugguuguauuagucuguucucacgcugcuaauaaagacauaccugagacuggguaauucauaaaggaaagagguuuaguggacucacaguuccacauggccggggaggccucacaaucauggcagaagaugaagagcaaagggacgucuuacauggugacugggaaagagagagugugugcaggggaauucccaucuauaaaaccaucagaucucaugggacuuacucacuaccacgagaacagcauggaagagacccacgcccaugauucaguuaucucccacugguucccucccacaacacaugggaaucauaggagcuacaauucaagaugagauuuggguggagacacagccaaaccauaucagugguuaugugcgaguuuauuucucuauuagaguaugagccccuggagggcagggaggcacugaauuugagacacuggugguuuuggcaucagagguggucucucuuucucucugccccucccgccacuaggugccaccuucaggaaaggucagcugcugggcaacacucccacccaagggcccuguugccccuggcagagaccacaccuuggggcagaugucccuugggauggcccagggagguguuucacuguccccugauaaucagcaucagaugagaggguacagugguuguccucagcccucuugccucccccuuuauucucuccccugcccucuguugccuccuuccucuauuucuucccucugucuucuguuccucuguccccuccccuccugcuaucuuucucccucagcuuccuccccuuaccaugcccuccccuccccuuuccguuuguccccucucccucuccucuguccccuccccuauccucugucccuuccccucucccucuguccccucccccuucucuccccuccccucuccucugucccuuccccuuuccucugucccaucuacccuccucgguccccuucccucuccucugucuccuccccucuccucugucccuucaucucucccucuguccccucucucuucucuccccugcccucuccuuugucccuuccccuuuccucuguccccucccccuuccucuguccccuucccucuacuauguccccucuccucucacucuguccccucccccucuuccucuuuccuguuuccauuucucugcuucucccuucaccugguuuccucucuuccuuccaccccuuucuucacucuccucuucucugucauuuuuccuguguaauacuugccaguguccccuccacucuauccuauuuaagaggaacuugucaaguucugcucacuccgaggagcaaaguccaguugcaggcccccuuugcucucuggagcgucggccuuuagauccucucucuccacaccuggccaagcucccaggccagggaaaaugcacuuggugugugcugguugcuuugccagcugcucugcaugggcugaccucggguguaacccugcagagugucuagguccggggcuccccugagaguggcacccacagccacagcacauugugcaggccccacccuggggcccuucuugucgguuguuuucucaagccuuauuuuguuaagcaguagacuauuauccaaacaauuuuaugcguaccuccaauauacaaauaagcuaagacuccaauauacaaaacagcuaagacuccaauauacaaaacaaauaaaaauggagcuguuaugguggaugggggugaggaucuugagugcagggagcuucugccucugugauuccccaugggcuccacugguuuagugaggaaaggggaggggacagaggagaggggagaggacagagggagagggagaggggaggggagaaagagggaaaggggacagagggagaggggacagagggagaggggaggggacaggaaaggaggaggggacagaggagggggaggggagagaggggggaggggacacaggagauggggaggggacaaaggagagggcucccaaugguuuagugagcucuguuggggguagggauguagggauaagacauggacucccagaaagggcggggacuggccugccacaccugaaacaaugagaguaggaagugacgcuggguguccguaggugucaggccacaggcacagacuccaacaagccauaggaugucacaaguagggacugaggugacugagcaaggauuggccaagggacucgggaggacagaugcgaggccauuaugacagcacagccucugagggggugggcguguucuuuuucccugacacccuuccccguggccucacagucuuagcuggaacagcaccaaguccuggggaguggaguccaggccuugggucuggaagaguugucgagcacgugcccuucugcagagggcaacagcuggggaguuggcugggcaucaccuuggcaccuggggacacuccugguuccauucucgcugugcuaaucaucaccgugguccuaucuccaccauuggcagugacucuacucuuggccagcgucuccaugugacagcuggggucuuguuuagcugaccagaugcccugggugguagauugccugugauguccaagggguuauugauacuucuggccgagggcagugauugcggcauaauuucuugggcuucccaguugcuuuugguggccagaacuucccuggaagugcccugggaacaagccauuugaauccuggauggaagcgcugcauccccagcugguucccauggaucuccauuacagugaugauaacagagggccguucaucaugugcgcccucuggcccugcauccagguggccacaccaggguagacaaucuuggaaucauuaccaaggcagcccuucucgucccucaccuugcccacaguguucccaggugugcacauccguguaggacagaaaugggcuggugcaguugccagauauccaccuaauggaccaguggcagacaucacuaaucaaucaugccucucuuccccucaagcccagaugaaugcucaugaucuuuuuauauagagcccuccaucagccauggcaaauuaacaggaguuggcucuuggaggcuguuuaugaucugugacauucauucauucauucauggaugcaggcaucuagugaaacauuuguugaguuguuguuaugaaccagacacugcucagugugaggaaaagaagacauggucccugcccaagaguugcgcugaguauauggacagacaugcgaauggcugaugacuauauaaugccgcuaguugggagcagaguuagaacucuguucuccaggagccagaggagucggguccuaauugcugagggugucagagaagggcagaagccuuuugugcuggguggaauugagcuacccucuucaccgugugcgcuggcugugcuuagcggagccaacagugcauggcggggccucaucuaagucucuggacaaagcccagccaggaacagccuggugacucguccugacuggcaccuucucucucgcaggagcaggggcugaaggccaacaacuccaaagaguuaagcaugugcuucacagaggugaguugggggcagaguggggaugggugcagaaggcugggccgguggggggcggcauuuccccggcgagccucagauccagcgcccucaaaucucaucgcaugggcugggccagcugagcuucuggaccagggugggcacuuacucugcugggguggggugggggagugcgaaggcugcauccagggccccuggcucucuccuuggggagagacaaauggcugcucugagcagaggcccucccaugccuuccuuacucucuuaagacaguugugucgaccaccugcucggcacuguugcugugauauuuaggaggcacagaaguggaaacagacacaguucuucccuugaagaaacccccacuauaggaaauauauauauauauaaaaauaaauaaauauauauauaaauauauauauaucucauauauaugacguauauauaaauauauauaucucauguauaugacguauauauauauaugacuuauagacccaagacaguaacuuagaugagaagaaaaggcagugugagaccucacagaagaaagagaaacucagacaaagauguucagggagggcuucauggaggaguggggauuggaagaaauugagaaacagggcgaaugugggcucccuugucuccccuccccuccccuucccuuccucucuccuuccccucuccuuccucucuccucuccuucuucuucucuccuccuucuucagcucuuuauaccaucugccuccucacugggacgcagguccucagcccugaugcagggaggaguagccuguuauccuggugaccacugcccuccucuccaaaccccagggcuugugaccagaagggacagagcauucccuucugcuccugccugggccagcuccgggagagucagcgcucccuucagagugcaaaggagggucccuguggguggaagagaggacaggggcuugagguguccaguuccugaguccguuucucugccgggucccaggccuccugacuguuuucuuuguuuucauucucuuuguuccugauucuucuccugcugcggacucagcucacgacaaauaucaucccagggaguaacaaggugaucaaaccuaacucaggccccagcagagccagaccgucggcugccuugaccgugcugucuguccugaugcugaaacuggccuuguaggcugugggaaccgagucagaauauuuuugaaagcuacgcagacaagaacagccgccugacgaaauggaaacacacacagacacacacacaccuugcaaaaaaaaaauuguuuuucccaccuugucgcugaaccugucuccucccagguuucuucucuggagaaguuuuuguaaaccaaacagacaagcaggcaggcagccugagagcuggcccagggguccccuggcaggggaaacucuggugccggggagggcacgaggcucuagaaaugcccuucacuuucuccugguguuuuucucucuggacccuucugaagcagagaccggacaagagccugcagcggaagggacucugggcugugccugaggcuggcugggggcaggacaacacagcugcuuccccaggcugcccacucuggggacccgcugggggcuggcagagggcaucggucagcggggcagcggggcuggccaugaggguccaccuucagcccuuuggcuucaaggauggagaugguuuugcccucccucucugcccucggguggggcuggugggucugcagcuggugugggaacuuccccacggauggcgguggaggggguucgcaccgugcugggcucccccugacuguagcacggaguguuggggcugggggccagcuccaggagggcuugagagcucagccugccugggagagcccuuguggcgaggcauuaaaacuugggcaccagcuucuuucucgguggcagaaauuuugaagucagagagaaacgguccuuuguuggcuucuuugcuuucucguggguccuuuggcaggccucccuuuggggagagggaggggagagaccacagccgggugugugucugcagcaccgugggcccucaagcuuuccugcugucuucucccuccuccuccuuuccccuuucucuuuccucauuuccuagacguacgucaacuguauguacauaccggggcuccucuccuaacauauauguauauacacauccauauacauauauugugugguuuccccuuucuuuccuuuuuuuaagcaacaaaacuauggaaauaauaccccaacagaugagcgaaaauguauuauuguaaaguuuauuuuuuuuaauacuguugucuauaauggggaaaaaggacauuggccccgcagugcccugccccagucagccuggcugggcucuggugggggcuccugauccgcauccaagcuuaaccaaggcuccaauaaacgugcuaggaagcaa

SEQ ID NO: 192514 - RNA, 71804 nt, Homo sapiens
accguuuccggggucagggcauuccgucccgccccgccgccggugcaguguuggaagcuccgguucucccggaaguggcccaggucucucugucgggguccccuccaucucgcugcugcugaaggccgcgagggcggcggcgauggcggaggcggcgcuguugcugcugccugaggcggcggcggagcgggacgcuagggaaaagcuggcucucugggaucggagaccggacacgacggcgccgcugaccgacaggcagacggacucgguauuggagcugaaggcggcggcagagaacuugccggugccagcugaggugaggugaugggcaggaaccgggccggggcgauggggcugggauucuccucgggcgccccggcaggaccccggccucacuagccucugcccaggauaucucuccacuccucccuggccaugguggcggauccggugggaggggccucaucucccaggcugucaggcuucgcucugccugcgaccccgacucuaauucugccuggggacggcuguggggguguccugcagcuggugcucgccggaacccaguccucccccagcagcaugggacgguuggcccggagccuugcaccgaacguuuugccccagacgaggcguccugucagccgaggcguaauccugcugcccacucucucccagaaggagaggcagucaacccgaggugcugugcugcaggacagucuccagcgcgugcucguuuaccgccuuaaugauucaccuagguugcuuuguccaugggggucuuggggagaccaaaacuugguccugagugaguuucauuuaucgcacauugaacuaugagcucucaaucaagugcaaguuaugggagaucagauuuauuucaccuauugcaaagcaauaaaaaugaauuuuauuugaaaguuggcucaguacauuauuaagcagugcugguuuucgguguuagagucaauguguuuaauccacuuaccauuaggauauuaugcacuacugcuucuugugugauucaauucaauuaguuguaauagcaggaaguaacaugaauugucagauguuugacaaacguuuuccaguuuugagggccagguuuaggaggauuauuuuauauaagcaguggugaugguuacuuuugauguuggaagcauucuuuucucucgcucugucgcccaggcuggagugcaguggcgugaccucggcucacugcaaccuccaccucccggguucaagcgauucuccugucucagccucccgaguagcugggaucacaggugccugccacuacacccggcuaauuuuuuguauuuuuaguagagaugggguuucgcccuguuguccaggcuguucucgaacuccugaccucaagugaucugcccgccucggccuccgaaaaugcugggauuacagucgugagccaccgugccuggccugaagcauucuuuuuauacgauuuggaauuguguccaaaugcagauugaguuuagagucuucaacuuuuucuguccuccaacuuuagagauuugauuuaaacguucucuucacauucacuguuguaugcucagccaucaaauaggcguucuuucuuggguuucuuuuuccaccucuaggauaugguaccggaaguggaucugaaaucaaugaaggcgcagguggaaauuucuuuggcucagcuaucaaacucuuuuauacccuggauaauaaaaguuguuugcucuauaaauuuuccagucuguuuauaauugauuuggcuccuacugcagcaggaugcuuggacuuaauagcacugagggugugaugggggagauacauauucuacaaaaaaauuuguuuucauugucaugggucauaaacuauuauuucuuauucucauugagcaugaaggagaacguuuggaaugaacuaaauggaaucuuucauuuucaccccauucuuccauauuuaucauuagccacaugcagucuuuaacauauguuaugucccuacucugaguuagguauugaagauagaaagauaaauaggaaagaugagauccuuagccucauagagcugacauaauuguggggaucaugaacauggaaaaaaagaacaaagaagguauguucagauggugguccauaauauaaggaaaaucagauaggauggugugacagaaaaggaugaggugugcccuuuuagagaaagagggaagaccuuuccaaggaagugacagccugaggugagaacugaugauggacuaccugaagcuagccucauaaagacuaaagaaauaacauugcagcuggaagaaagaacagcauaaggucauggguagaggaugagcuuaaugaguucaagaauucagugagggucuucugguacgugcagcuugguauuggauuccugugagaaugcaauagcugaggccaggugcgguggcccacgccuguaauuucagcacuuugggaggcuaaggcgggagaaucacuugaggucaggaguucaagaccagccuggccaacauggcgaaacaccaucucuacuaaaaauauaaaaauuagcugggugugguggugcaugccuguaaucccagguacuugggaggcugaggcaugagaaucacuugaacccagaaggcagagauugcccugagccgagauugcaccacugcgcuccagccugggugggugacaggcaagauucugucucaaaaagaaugcaguagccgagcugguuaugcacacauccuggaaucuuugagaaggcaguucucauugcucuucagcuuuacagcccucauuuuccuuuucugaaguguuuauaugucuguugggaagacuuuggaauuaauuuuuuuagcccuauacuacucuuuuaacauuggcagcaaaagagagugccacaauuuucauuuuguccaaucaguauaacucaaggauuuucuguaguguuucacaauuuucacgagauaaauuacuuccugaacaacuggaacugagcaggcuaguagaauagcaagaggccaacuaacucuuaaguacauaucauaaagauguuaacuucuuuagaaaauagcuuucucuuuuaugaaagagaacuagucuuaucuuaaaaaggaauuaugccuuuuuuggcauuagagaaaauaauuuacaauagaauauuagguagacuuuuguagccagggcaaacuuaguagugaggggccuauuucuuucuguugaauuuaguaauucuugauaaagugcuaaaauaauuuaccccgacauuuaccuauaauuuacuguuacagcuguuguuuucuuguaggcugugugaccuuagaugugauguuuaucuuuucuaagccuuaauuuucuucuuuauaaaauggggacuuaacucaugaugaguacuuaucucauagggaauugugagaauuaugugaaaucacguaugcaaggugcacguggcaaguuacuugcuauuauucuugugcuuucuuucaaauuauuaacaucuuaaaagaauagauuagaauccugugaugcugagcugguauaggugucauucagaccaaagguaagaaaaggagagguuaagugccuugaggaagguucugagacuccaccuauaccucuucaguaauuugcuccaagcagagaacaaaacaucagguuucauuuagggaauuaauugaucagauugauuauaaaagugguuuucuccaacccagaacucugcaagaaguaaagcuugggagagaaagguauguuacuuguuauuucagggaccugcucagcuggucaggcaaagcuugagaauuuauuguacuuacuauuuaauguuagugucuccauuugcauaaacuauacaguagcucugcagcacuggcccauuagcaaucuagaacuguguucucucucuaguggugucugucugcuccaucuggaagccaggacagugcugguaagcagcaggcauucagucaccuccuccugagaagugaaugagaggucagaacaggaaagugugugauaccaccacaccccuuuuugacuugucauucuauaccagguguuuugagaaaggaaggcagcugccuagucuacuuaaugggggcauuuucucguauguuauuaaaaagcaacuuguuuugcuacuuuaaaaaaugauuuguuugaaguaauugcauuauggcuucucucuugcuugguuugagagaagaugguuuuguauuagaacaaggaaacagggagccuccuuuugccucuaguuuuuaaaguucuuaugauugaaaaguaguauuuguacuugaaguaaucaaauagaauacucuuauaaauuuagaauauauuuacucacaucuagguuacagaacauaucuggaauaucuauaguaguuucucaaguagaguuuucaaauuauuuuauuuucuaaaguuaauuagaagauaaacuuuuuuugguucaagauaacagacugagcacacguguaugacaucccuggaucccuuugaaaugacaguaauaaauguguggcacaccaaaaccaaagaugguaucaaugaaccugaaaguugggcauauuuauagaaggcaggaagcauguaguauccuuuuaaaaaucauucuaaagacuuaaucacagaaccaggugcaaauauuauaaaauuugauaaucuaaaaaagagauaguacaggugacagaauuugacaguaaacagggaacagauauagaguuacuaauuucuuuaucuuacauggugaaguaaguaagaguguauauauaggaccuaaaauugaugaauucaaacacaaagcaguaaauauuuuuuuuuaagaguuguagaguuaccauaaaagaaaacugaaaaugguuaaacuggugaaaacugagggugggggagaauguuacuuuucauuuuaacucuucugaugauuuggauuaaaaacaauuauauucauauauuuugaauaauuuucauaaaagauugaucaaaaauucaaaauuauuucuuuaguuccuucuacuuuuacaguucuucauuuuacccucaaauucuuuagaaaaacucucaaauuauaaacauugguauuggcuuaaagaagaagaauuggacgagcaggggagagggaagaagggagacuugcuuuucacuuaaauauucuguauucuugggacuuuuaaaauaagcaccccuuuauaguuuaaugacaaugacaauguaagaguaaauucugucuuuuccuuauacucuguugaagagacauuuuaaaauguugcauauuaagugaaaaaggggagguguguauacuguuauuuggguuuaagguauacuuccuuuguauaugcauagaccaucuuagaaaagauacuuaagaaacuaguaacauugauagccugccccugaggaggaaacuagauggcuggagaaugaguuccaggggaaggagacuuuucacugacucccuugaguuuugugccuugagauuuauuaccuauucaaauaaauacacuuaaaaggacagcucuauguauuauaaaugauucugggacaaaaggaguuauacuuuuuaucuggaauuuguuauauguugugagguaguacuagaauuaugcaguguaaggccucaugaacucugaugggagaauaugauuauuacauuacuuauuaaaaaggugaaauaauguagauucacuugcaguaaugagaaauacuacugugaucgguacacuuugcccacuuucccucaaugguaacauuuugcacaacuauaguaucuggugucacaacugggauuuugacauugaucuacauucuuucagauagacuuauaaucguuuuucucaaaagaaguugaauuacagauggauaugggucuaggugauguuggaagacugaaguuugccagguccucuguguauuuucaguuuuuuuagugguugccuuaggauuuacaauauacagauggucccugacuuaugaugguucagcuuaugacuuucugacuuuaugugaaagcuacauguauucaguagaaaguguaccuguggugccgggcauggcagugagccacagcucccagugagccacauacuuuugacuuaggauauuuucaacuuccgaaggguuuauugggacacaaccccaucauaagcugaggagcgucuguacuacuuuaauuagucacagccuaccucuaaauauuauaccacuucauuaugguauaacagccuuacagcaggauucuuuggcugggcaugguggcucaccccuguaaucccagcacuuugggagacugagacaggaggauugcuugagcucaggaguucaagaauagcuuggguaacauagugagaccucgucucuacagaaaaaaaaaagaaaaaaaaaucaaaaaguuagcugggugugguggugcacgccugcagcuccagcuacuugggaggcuuaggcaggagauggcuugagcccuggaaaucaaggcugcagugagcugugauugcaccauggcacuucagccuggguggcagaacaagaaccugucucaaaaaaacacccaaaacaguauucuuccauuucuuccuuucccuguuuugugauauuguuucaggcauuuuacuuuuacauauguuauaaacccacaauacauuguuacuacuuuugcuuuugacauuucuugcugagugauuuaaaaaaagaaaaacugucauauuuaccuucauuuuaaucauuucuggagcacuucaguuuuuuggguagauauguguuuuaucuagcguuauauucugccugaagaauguccuuuaacauuucuuguaguauaggucugcugguaaugaauucucucagcuuuuguuuuuuuuuuggucuuuuuuuugagacggaguuuugcuuuuguagcccaggcuggagugcaauggcgcgaucucggcucacugcaaccucugccucccagguucaagcgacucuccugccucagccuccugaguagcugggauuacaggcgcccgccacuacgccuggcuaauuuuuguauuuuuaguagagacaggguuucgccauguuggcuaggcugguccuggacuccugaccucaggugauccaccugccucggccuccgaaagugcugggauuacaggugugagccaccacaccuggcgcuuuuguuuguuuuaaacaguccuuauuucuccuacauuuuaaacagauaauucucuauagguguagaacucugaguugaguguuuuucuuuuggcacuuuaaagaugucgcucuauugucuucuggcuuguguaauuucugaugagaagucugcuguaauuuuuaccuuuauuucucuguauagaauaugucuuuuucccucuggcugccuucaagcuuuuaucuuugguuuuugaaaguuugaauaugaugugcacagagggguuugccuguguguauguguguauucugcuugggauucucugaauuucuuagagcuguaguuuuauaucuuucauuauuuuuggaauguucucaacaguuauuucuucaaauauuucuuccacccuguucucacuuguucugcuucuuuugggaucccauuucauguaauuugauaucaucauauaauuugauaccaucacacaauucuuggaugcuauguucaguuuuuauuuucccacucuguuuucucuguaugauucauuuugggugauuuuuauugaccuaacuucaaguucacugauuuuuuuuccuuaacuguguucuguguacugaugagcccauugcagguauucuucaucuuuguuaccauuauuuuuauuucucacauuuccauuugacacaguuuucaguuuucuguugaaauuguguaucuguuuauacuucuuaucuguguguuacaccagagccuuuaacauguuaaucacaguuauuuuagauuccuugucugauaguucuagucucuugcucaucugagucuggcucuguugauugcuuugucucuugacugaguuguuuucucucuuuuuuuugagacggagucucccucugucgccuaggcuggagugcaguggugcaaucauagcucacugcaagcuccgccuccuggguucaugccauucuccugccucagccucccgaguagcugggacuacaggcgcccgccaccacgccuggcuaauuuuuuguauuuuuaguagagaugggguuucaccguguuagucaggauggucuugaucuccugaccucgugauccucccaccucagccucccaaagugcugggauuacaggugugagccacugcacccggccuguuuccucuuguaauguuugccaucucuuuuuucccaugauuugccacaggugagccagugcuugcagccugucucuuccuggaggugccugucgcuccccagauuuuuaucuacuugguuacucugcaagacugguggauucaagacuaguuauaaucuuguggauuauuuggcuuuuuguuauugugaggguacaagcaacauuucuuucagcuuucuucauccuagccuagcuuucguguguuuucugguauauuuuccaaaucugagccauaucaccccggccccccuuagauauaaucuaaacagugcugauagaauuaugugauugaauuugugaugaucuguucauauagaacuaaauuuuauugcuaauaaaauauaauuuuguaaagacggcuuuacaagaaguugauuagauuuauaaacuuacucuguugcugcuauuagaugggaauaauaauaauauaauaucaguacucaaauuuauugcuuacaauaugucaggucugugcuaagugcuuuacaugcagcauugcuucagguggguuaucuugagucuuggguggcuccccaaggagacagcucauguugcucauuagaaggguucugcagagcagguguagaugcggcuuaucucagcacagcuuccucuguccuccagaaccccuaguggcagcauacgguugcugaugacacuuuagacucaggauaaauucuuacuggauuugagaaacuuaauucuugcugggccacaguccuuuuauacucagggauuguguuaccauucagaaagaguuuacaugaacaagugaugcccuuaauaagaacuguuuaccuacaccuaggacccuccugacucuugagccaggcucauuuguggggagaaggcagaucaaggaccuuccuaaauacuuugucugcagcuuuccagcauucuaaaaagccaguuuucccacaucuuuguuuucuuuuuuacucuuuuuuuuuuuuuuuuuuuuuuuugagauggagucucgcucugucgcccaggcuggagugcaguggcucgaucucggcucacugcaagcuucacuucccggguucaugccauucuccugccucagccucccaacuagcugggacuacaggcgccugccaccaugcccggcuaauuuuuuuuuguguguuuuuaguugagacgggguuucaccauguuagccaggauggucucgauuuccugaccucgugauccgcccaccucagccucccaaagugcugggauuacaggcgugagccaccgugccuggccuucuuuuuuacuccuuauaguaacguuaugauacagacaguguauccguaucagcuaagagaagauaauugaggauuagaaacaucaaguaauuugccccaugucacacagcuuaugaaugaacaggagcaggauucuaacuaggcugcauuguaauguacuuuacuguaccauaaauauagcccuauuugaacccauacacaaaaaacucuauuuuuaaaggacaguguuucuaaauuaguggugcauuuugcaucuagcuuauuuuaguuuugaagagaaaaugcuaucuucagaugaaacuucuauauuuagaagguagacaggguagcaccuuccugagaccuuggaucuugucuuauaucaauggaccuuaaaugucauaaacuaagaacugagagcugaaaacuggaauuugaaccuaaacaauuaggcccuuuuacuuuccccagcaucuacuuucccuuuguuuuggucuaaaaacagucuguaugucuauaaauaaauuaacaccuggucuuucuuugauaguggagaacuagaaaguacuguaggucuaauauugucaaagugagaccuugucugugggccgcuucugaaacugauggaaaacucuaaaauucuuccuauucaguuuuaauuucaaaauuugucagcaggaagguguggugagaugugccaguggguggguggaaaugguaggaggagguaauguuuauuucuaaucaauucuugggugugauuuauuuauuuauuuuuuuagacagggccucacucugucacccuggguggguggcacgaccuugacucacugcaaccuccaccuccugggcucuggugguccucccaucucagccucccaaguugcuggaccacagaugugugccaccacacccagcuaauuuuuuuuuuuguauuuucaguagagacgggggugucacuauguugcccaggcuggucucaaauuccugggcucaagugauccacccaacucugccucucaaagugcugggauuacaggcgugagccacugaacccggucauugggugugauuuguuaauccuguuggucaggcuuuuguguuagauacuggggagggcaaacuacuuucaauagcacauagguuuucucuuugccuggugguaguucacaagaggcucaagugagaaaauguguguggauuaguacagauuuaccacccuuauuagaaagcuaacucagaccagacuugguggcucaugccuguaaucucagcacuuuggaaggcuaagguaggaggaucacuugaacccaggaguuugagaccagccugggcaacauguauagacccccaacucuaccaaaaauacaaaaauuagcugggcgugguguugcgugccuguaaucucagcuacuuggagauugaggugggaggauggcuugaacucuggaggcagagguuacagugagcugagguggcaccuugcaugucagccuggaugacagagcaagacccugucaccaaaaaaaaaaaaaaagcuuacuaauggugggacaucagugucauguuuauauuuugagaugagcauuuaauauagagccuaaaauguuaguacuauauaguauuuauuaacuuaaugugauuuaauggaaaauauuucuuucucuuucaaaacaacugagauggaaacccaaucuugaguuaaguucagagaauuuucaagucacuuaaauaucuuugugacucucuuuuuucaagcuuccaauugaagacuugugcaguuuaacaucccagucacugcccauugaacugacuucaguagugccugaaucuacagaagacauucucuugaagggcuucacuuccuuaggaauggaagaagaaagaauugaaaccgcacagcaggugaauugcaguaucuuuucuaaggauguuugauuauuucagaugucugaagacaaggcuaauaaaguccuaauuaaaaguucugaacauuugucaccauaauuaacauuaagucuuucuagaacauucuugauuuugcauuaguuguggcuguuuacguguuuuaaaugaaucuauugcccaauuauaguuaugauauagguaaaaaaacaugagauuccauguuuggacguugauagauuauugagguuuuaaugucuuaugcacuuuugacuucccccaaugucugucuucuguuaaccuguucccucagugugugcauggguaccccuccaucucacuuguugcuagguaguccuuuuuuaaaaaacccaaauauucuuuuuauauuaacauuuguaguuauuuuucaguaauuuagcauguguaauuuuuucuugguuuuuguucauuccuaauuagaaaccuaaacuuacaguaguuucuucugccacuuuccuugucuccucuuucuuuuccuauuaagagucaaaguugaggcauugaccaaauaaaacauaaaguacauguguuggaacuggauuacauauauaguaaguugagagaggcaguucuacaaaccgaugaagaauuacaguuccugagcuaggcugaccugcaccugaaagucagcuccaucauuuagcaucuuugugagcuuaagcaaauuacuuagcuucuuagaucuuuaguuuccuaauauauaaaacagggauaauuauauauuauuucacaggauuuuugugagcguuaaauacgauaaugcauguaaauucguuguguagcaaguacacaguaaaugcucagcaaaugauagccaagguacauggcaagccuguauacccuugacauugaaucuuacuugagauucaguguucucagguucacuugaagguagucuugcaccacaucugugaacuuguuuggccugcuuaaaaaaaguccucuggaugaaacucguaccuguucucucuuuaaaauuaaaaaaacuaauaugcugacuuauaauuuauguacaauaaaauguauucauuuuaagugucagcucaaugaguuuugaaaaguguauauaccuauguauguaacuaacaacuauaauugagauauaaaacauuucuaucaucaccccaaaaguuucuucauacuuguuuaaggucaacuccccgcaucccccuuuuaaauaauagauauuuuucaggccagaauucagauccagggcuagcugauaccagaguccauauucucuuuuuuuuuuuuuugagauggagucucacucuguugcccaggcugcagugcagugggcaaucuuggcucacugcaagcuccaccuccuggguucacgccauucuccugucucagccuccugaguagcugggacuacaggcggccaccaccacgccaggcuaauuuuuuguauuuuuaguggagguggaguuucaccuuguuagccaggaugaucucaaucuccugaccucgugaucugccugccuugcccucccaaagugcuaggauuacaggcgugagcuaccauucccggccccacaguccauauucuuaaaccacucuguaauauuauuuuugaguuauagccucacaguucuuauuagauaacguuaauauugauauuugcccaaagcacuauguuaccuacucaaauuuuguaaacgauuauagcaaguaggcauuagccuguuaggaagaaauauucauuuuuuaccuauuguauguuuaauacucuuccuuaauuugacugugaaaauggucaguuuuuuguuuguuuuuuucaauccuuaagacaucugaaauggccuuuuuuuuuuuuugagacggagucucgcucugucacccaaacuggagugcaguggcgugaucucggcucacugcaagcucugccucccggguucaugccauucucccgccucagccucuugaguaacugggacuacaggcgcccggcuuauuuuuuguauuuuuaguagagacgggguuucaccguguuagccaggauggucucuaucuccugaccuugugauccgcucgccucggccuccgaaagugcugagauuacaggcgugagccaccgcgcccagccuuuuuuuuuuuugagacagaauuuugcucuguugcccaggcuggagugcaauggcgcgaucucggcucgcugugaucuuggcucacugcaaccucugccucccggguucaagcaauucuccugccucagucccccgauuagcugggauuacaggcaugugccacuacgccuggcuaauuuuuguauuuuuaguagagacgggguuuuaccauguuggccaggcuggucucgaacucccgaccucaggugauccgcccaccucggccucccaaagugcugggauuacaggugugagccaccacacccggugaaauggccgauguuuuaauauccuuugcuuuuccuagcauauggguauuguggauauaauuaaacuauuuucuccuggccuaaaacugauuaugucugagcccuaagcaauaaaacuuggauaacgucuguccuuuugacuugcugcuuagcauguagccacuuuuaauuuugucaguuuuaguuuuguucacaauauaauacucuguuuuuccaguuuuucucaugguuugcaaagcugcaaacucagauggaucaagaugaaggaacuaaauauagguaugugugucucuugcauuuguugaauaucuuaauuuuuagaucacagucaucugaagcauuucauaaucagugucuuuaaauaaaacugagguauuaagaaaacuguaacagccauauauucuuuaagaauagccagugagaagauuugggucuuuaaaacuguuauuuagaaguugugugauuaaaaacaaaaagaauuacauuauaauuaauagguuaggagggauagauguuaguuuuuagauagcuccagaaagaacuagguucagguaggaguuguagaggaauucuaggagguguuuguugcuuuuuagaaggagaaacaucccugaaagacuuucaggauggccacuuagguugguuguaacuauacuucugucaguggaugcugacagcaugggggaaauguugacggcugauuugggggcuguggguugaguguccacauucaggguauugauuuguugauggcuauuauugcuaggcagugugguagacucuuuaauguaugaucccauuuaaucuucguaacagcugugugaggaaggauauuacuauucuuauuuuacaaaugagcaaccugaggccuggaaauaauaaguuacuugcuuaaucucaugcagacugggcagagcuggggcuuggacccaggucuucuaauucuaaaucuagaauucuugccaugacaucacaccaucuuucaaagagggaagugaucugaaggauuggccuuacuuggugccuugggauggcuuuggugucccagucuuuagaaguugagccagugauucauugccuuauaugugaaaagccagauuauggcuucaaggcuaauuccuuuuguuacuuauaggauuagugauuugccuucuuaaguauugaaacgguuuaugacauaacuuuugguacauuucuuaacauaaucaacuuaugugcauaggcaguuuuccuccugaaauucgaacauuuugggaaaaaugagccuuuguuguuuuuuuacugugcuuauugggggaaaagauuauugccaauccccuuuugguucuguuuucuagacagaugagggauuacuugucuggguuucaggagcagugugaugcuauauugaaugauguaaacagugcucuucagcaucuggagucuuugcagaaacaguaucuuuuuguguccaauaagacaggaacccuacaugaagccugugaacagcuccuaaaagaacagguaauuuggaguaagagagaggaucagucauuauauuuaauauuuuaaaauagaugaauacaguuuuauuuuaauuuucuuaauuucuccaagauguucaacucugcuguguuugaggcccugugcucagcaugcagauuguuacacugacagccuacuuuuuaagugcaugugaauagcaaaggcaagccuucuuauguuuugagcuguuaggucucaguacaauuuccaaauguaguggcuauguugguuugcucugaucacucuuuauuacugacacuuuuauuuuuuauuuuuauuuuuuuugcucuguugcccaggcuggagugcaaugacgugaucucagcucauugcaaccucggccuccugggcucaagcgauucuccugccucagccucccaaguagcugggauuacaggcgugugccaccacaccuggcuaauuuuuguauuuuuaguagagacagaguuucaccauguuggcuaggcuggucucaaacuccuuaccucaagucaucugcccgccuuggccucccaaaguacugggauuacaggugugagccacugcacccagcuacugacacuuuucaaagaagcauagugauuguaccaauggugagauuuugaaaagaucaacugauugauuacuuuugacuuagagcuagaacacuuaaguuaguaugucucagaauuuucucuguauguacuuuuguguauuuuaaaaaugcgaucauuuacuauuuuaugaagagaucauauaaaauuuacuguaauauuaucgccccuuuuaguucaugauuguagaaauacuugagcugaauucucauaucugauauaaaccucugugucuaauguaaaucuguuuaguguaacuuugagacuggcauguugauucuuauauucuuauaauaauugauuuuucucuuuuaaaaaaugcaagucggaacuuguugaucuggcugaaaacauucaacaaaagcuuuccuauuuuaacgaauuggaaacuauuaacacaguaagcauuguucuuuacuucuuauaaaguuagugauuuuuguuuuauuuuugccuuucuucgugucaucuuuuaaucuauaaauuggcuugagugauauuuuaauuuagcuugcuugcugauagauauuccuauuuguagacaguggagauaccauuaccaguucagauuuuuaaauauuugaguuaagauguguuucuuaaauuguauucuugguauuaaaaucucuuuauuggcuaccucuuauaguuucuuauuuguaagcuuugaagaagauuguaagaagaaauauucaguuuuagauuuugcugugguuaugcuaccaugauaguagucaaaacauuuuuaaaacuuauucucauguuuaguuugaagaaaaguauaguccucaaaauguauaguugcaucccaauaaaguauaauaguuccaauaaagacaaguguguaaauuauauuucuguguuucugacucauaaauuaaucauaacuauguauaagucauguuauuaaaaucguuuaaucauagguauuuaguuuauuaaagacauagaacuaaaacuuguggcuaguuaacaauggaaugcaauggaaaguaguucauugccaagcuauuuguauaucaggauaagaaaugauugacugguugcauuuuacuuucauaguaugacugcuaaauauaguaugacugcuaguuaauccuuuaaucuucagaaaaaucaccacugcaaguagaaaaauuauguauauuguauaccagaaagugagaaaucuagguauuucauauauuauuugaauaugacauuguauagugggguaauauauaccauguccuaauucaugaagaguccaauuaaagcuuauuaggaauaaacugaauuaaaucaguaugcuuuuucuguuugucccuucuuuauuguacaugugggcuacauucgaggauauuuuggugacuuuuaaaauuuauuauaaagacauguuauguccuaaaggcaaauaugcugacucuaauccauaguuuccaacuuuuaucuguaucauuuuuuaugaauuaagauuguuuucuuuuucucuuaaagaaauugaauuccccuacauugucggugaauagugacggauuuauaccuaugcuggccaaguuagaugauuguauaacauauaucucaucucauguaagucagaguauuuuugcauguuuuaaagaaauccuuagauuccuauuccuguuccuaucuuuuuguguuuuucaacuuuucuguguuuagcagauguuccuauuauaucacuucuugugcuguaaagugauuauuucuguccaagggaaaaauauguauuuguaacauauuaaagaaaaguuguagugaauucuuagucguuauuagcagugguguaaaaaguacuuuuagcuccugcaauagccccuggaauggaacacauccuggcugacucagcuuuaucccaucuaacaggaugagccguuuuuaaauuguuggugucuugacaugcccgguauuucuuuggaaacagaaaguguuacuuggggggaaauaaagggacaagcccuuugauuuaaucacccucuauuucuguuucuucaggauuuauugcuguguuuauuuccccuaacuccuauucuuuuccuaguugggucuuacauauuagccuugaagucuguggggugcugaaaauaucuuuuacuaacaacugcaaauauguauggagcuccuacuuugugccaggcacaggggguuugacugugacuaagacagucacaguauuuauucaucuucauggaguuuaugaucuuuaugaaaccuguuuuugaacuuuauauauugcuuuacauagggacaccuugguuuucacuaaaagcuugcuuuuuaucuguguucauuuccacuuuguaaaucuuucucuuuuccuuacagccuaauuuuaaagauuaucccauauauuugcugaaguuuaaacagugucuuucuaaagcuuugcaccucaugaagacauauacugugaacacacuacagacccucacaagucaguuacugaaaagggugaguuaacugaucucaacaacagguuuuuguuauuguuguuguuuugauucauucaucuuccauaaucuuuggcugagauuaguacuuuguaauuccaaaaaauuuuaaccuuuuguuaagaauauguacuacagcuuuuuauuuauaguagggaaaaaugacuauguuauaaauaucccuugcaaauguuauuuucaaauaauguuuaauagugugagaaguauucaguacuauaugaugaauaaucagauacaaauuauuugucucuuaaaacauuccuuuucuaucuuuuucaugaaaauauuagaaggaaauauaccaaaaucauaaaaguggcugugucugagugguggguuaaugugcuuuugaagcauauucauauucauaugcaaaauuaugcaucucauaaugcauaauuuaaauuuucuucuuuacccuuuuuuuguauuuuucaacuuuucuauauuuagcaaacauuuuuauugagcacugccuaaugcuugauauuauauuaggaauuguauagaaacaaagaggcgcuaauaaggucccugcccucauggagcuuauauucaaaagaaauaaccaguacagaaagaagcaaaucaauuaguuaauuauggauuguaguugauucuagguggaaaauuaacagaguguaagguuagaaaauaagaguagaauaagcuaagauggucauugaaaauauuccuuuccuaagaaaauaaaaucauaaacguuauguuuugguuuuuaagcuugcuuucuaaagaacguggagugucuucuugaacuuuccaugcaaagcuugugauguuuggcuugcauuuuuaccguucacauuguucuuagcugacauaccaacuaaccuauauuuuuuuuuauuuuuugcaaaauuuucaguaaguuuaggaaacuaauagcucauaaagacugguaccuauuaugugcuagugcuuugcuauugagcugcaccaaaccuuuaggaguuuaauggaugcacugagucuuagagggaugaaguacuugggccaguguccuacauucagugaguggcagaaugugaaucucaauucagaucuguuuaccaccaaaauuuaaauaauguaagguuaauuuuaacuauaaaggagagagagaugacaguuccauuuaauuauuucucauguguagccauaauaauauuuaaucuuccugagauuuuucucccuaagcuugcuuauuuauuuauuuauuuauuuauuuauuuauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugguuacuugagauuagggauuggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuacuuccuuccacacagacacggcaaccauccgaucucucaaucuuuuccccaccuuucccgccuuucuauuccacaaagcugccauugucauccuggcccguucucaaugagcuacugggcacaccucccagacggggcgguggccgggcagaggggcuccucacuucccaguaggggcggccgggcagaggcgccccucaccucccggacggggcggcuggccgggcaggggggcugaccccccccaccucccucccggauggggcggcuggccgggcggggggcugaaccccccaccucccucccggacagggcagcuggcugggcagaggggcuccucacuucccaguaggggcggccgggcagaggcgccccucaccucccggacggggcggcuggccgggcgggggggcugaccccccccaccucccucccggacgggguggcugccgggcggagacgcuccucacuucccagaugggguggcugcugggcggagaggcuccucacuucucagacggggcagcugccgggcggaggggcuccucacuucucagacggggugguugccaggcagagggucuccucacuucucagacggggcggccgggcagagacgcuccucaccucccagacggggucucggccgggcagaggcgcuccucacaucccagauggggcggcggggcagaggcgcuccccacaucucagacgaugggcggccgggcagagacgcuccucacuuccuagaugugauggcggcugggaagaggcgcuccucacuuccuagaugggauggcggccgggcggagacgcuccucacuuuccagacugggcagccaggcagaggggcuccucacaucccagaugaugggcggccaggcagagacacuccucacuucccagacgggguggcggccgggcagaggcugcaaucucggcacuuugggaggccaaggcaggcggcugggagguguagguuguagugagccgagaucacgccacugcacuccagccugggcaccauugagcacugagugaacgagacuccgucugcaaucccggcaccucgggaggccgagguuggcggaucacucgcgguuaggggcuggagaccggcccggccaacacagcgaaaccccgucuccaccaaaaccaaucaggcguggcggugcgugccugcaaucgcaggcauucggcagacugaggcaggagaaucaggcagggagguugcagugagccgagauggcagcaguacaguccagcuucggcucggcaugagagggagaccaucgggagacgggagacgggagacgggagacgggagacgggagacgggagacgggagagggagagggagagggagagggagacucucccuaagcuuugauugguaugcaggccaagcaguagccauaggaaaugguugcuguuggguuuucugaauuauuuguuugcuaauuaucuuccuuccuuauccucccccauguuucuuuaggauccuucaucuguaccuaaugcagacaaugccuucacauuauuuuaugugaaauuucgagcugcugcccccaaagucagaguaagucuauugacauaacuaggacauugcuaugaaauuuguucaucugcccuuuugaaguacuguuguauguuaggcucuuuguuuauaccgaggaagugaacuugaaugaaagguugacauuguccuuccacauuauagcaguguaucuuaguguugugucuagguucuuuaaguccacagagcaggaagcaucuagcuuuuccugugaugcucagggaugguuucuagaugaaggugauagacggguuuuaaaagcuuggcugguggucuugaagggaccaauaagguguuuugauaaagagagaacagcacauauagggaaguuuguaggagacauaaaagacauacauuuugggagagaucuuuauacuacaaagacucucucacgagggauguuacaugucgugcuaauuuaggaaaaguagagaaccaaugaagugguaucuuaaacagaggaguuauuuggucagauuugccaaacagacauguaaaccaauggaacagaauagagagcucagaaauaaaugcaugcauuuucagccaacugauuuuugauaaaagcaccaagaacauuuuguggggaaaggaugauugcugggaaaacuagauauucauaugcagaaaaaugaaacuagaccucugucucucacuguauacaaaaaucaaaacaaaauggauuacagacugaagaucugaaacuauaaaacuacuagaagaaaacauaggggaaauguuuuaggacauuggucuaggccaagauuuuauggcuaaaacuucaaaagcauaggcaacaaaaacaaaaauagacaaaugggacuauaauaaucuuaaaaucuucugcccaacaaaggaaaacaauuaccagagugaagagacaaccuguagaaugauagaaaacauuuacaacuauucaucugacaagggacuaauauucagaauauacaaggaacuuaacagaagaaggccccaaauaaucccauuaaaaaguaggcaaagagacugaguagacauuucucaaaaggagacuauacagauggccagcagguauaugaaaaaauguucaacaucacuaaucagcagggaaauguaaaucaaaaccacagugagaugucaucucaccccaguuagaauggcuguuaucaagaagacauaaaacaaaugcuggugaggaugcagacaaaaggaaauucuuauacacuguugaugggaauguaaauuaguacagcuguuauggaaaacaguauggagauuucucaaaaaacuaaaaauagagcugucauaccauccagcaauaccucuacuggguauuuauccaaaggcaaggaaaucaguauaucaaagggauaccuguguugauugcagcacuauucgcaauaguaaagauauggaaucaaccuaagugucaaucaguggaugaauggauaaagaaaaugugguauauauaaacaauaagauacuauucagcuguaacaaaaaaugaaauccugucauuugcagcaacgugaauggaacuagaggucauuaaguuaguaaaauaagccagauacagaaagacaaauauuguauguuuucacucguaugugggaacuaaaaaaguuggucuuguggagguagagaguagaaugauagauaccagaggcugggguggguuggguggaggggagguggagagguugguuaauggguauaaauguacaguuuaauaguagaaauaaguucuaguguucaguaguguaguaggaugacuguaguuaacaauuuauuguauauuucaaaauagcuaagagggaagauuugaaauuuucccagcacaaagaaauaauacauguuugaggugguggauacucuaaacacucugauuugaucauaacacauuguauccauguaucaaaauaucacauguaccccauaaauauguacaauuauguauuaauaaaaaagauuaaggaugcaauauaaaaaauggauuauggugaagagagauuugagacagggaggccucauuacuaaggaagauuaugcaguaauccaggugagauuagggggugaauuaaugcauugguaggauauuucaugagguuggguaugugccuuauucauucuacguagcaggaguccaugauguauuuauuuggauuaacugauagcauggagggggcaaagaucaauauauguuauauuuuauaacauaucugagauacauuuaauugaagcuggugcauauauauucuuucuacucauugugaaguuucuagaaauaauaaucuacuuuugcuuacugacuucacuuccuugcuuguuucugucuugaaagucagccaauugauggcugggugcaguggcucacaccugcaauccuaguacauugggaggucaaggagggcggaucccuugaguuuaggaguuugagaccagccugggcaacauggcgaaacccugucuguaccaaaauuacaaaaauuagcuggacacgguggugugcaccugugguccggcuacuugggaggcugaggugggaggacugcuugaacccaggaagucaaggaugcagugagccaagauagcaccacugcacuccagccugggugacaaagugagacucuguuucaaaaaaaaaaaaaaaaaaaaaaaaaagagccagccaguugaaaggaauuuuuuuugacaaagugagacccagccucaaaaaaaaaaaaaaaaaagccaaccaguuuaaaggaauuuuuuuuuugaaaugggagaaacuuaguuuuguuuauagaauauauauguggaauauguauacaaccuagaugucuaacagaugucuaacuggaugucaguuuauggcaugaagauuuagauugugccugauugauugcuuuugcuuauuagccaaauacuaaugauaaaaauuugauuagaaaagaaaagguauagauaagagggcucagugugguggguaauuauaaaaugauuauauaguuaucaguggcuuuccuacauaccauuaguaacaaauuaauauaugugauggggucccauuuauaucagugacaaaaagcauaaaauacuuaccuagcaguaaccuuaacaaacauaaggaugaagaaaaugacaaaacuagacagaaaauuauaaaagacugaguaaaugguaagcccaucuucuuccugguuggggugauuuaauuuuuaaaaugucacuuucucccagaguaauuuguugguuagaauguacuccuagcaaaaauuccaauggauuuuuuuuuuuuuuuugcaugauucuaaacuugaucugguaaauaggcaagacuaaagaagaaaauuuugaaaaauacagugucauugauucaagcauucacugacagauuggaauggaaaguugugguacuuaauauauuaagaaacaucccaaauaggaaggacuggaguuuucuacacgguauugggaagauuugcuaaauauuugaaaaaauaguaagcuuuuuacucuauaacauuaccaaaauaauauauucuaagugaauauauucacuuaguggaaacuauaugcaaguuaaggcugggugacuuuugucugucauaaauuggcagauuaaggucagugcuucugaggauuuaugagacaggcaguacugcugauaggaauguaauuggauuauuuucuaaaaaacauuuuagaagaauagaccaaaaacccauaaaaauacauaccucuuuugaccugguguuuugggguccccaccugggagguagguguuauuacaccaguuuuauacaguagggaguggaaucucagaagugaaccagcuugccugggcucaaacagcuacuaaggagcgggugcuggaacccucuaguuucacucaaggcucuucacaaaugggcucugauucuucagaaacaaccuagauaucaguagaaaugggauauuauguagccuuuuagcauaaugcuuuaaaucaugcuuacaaugauucauugaguguugacuagguaccagguacuaugcuaaggccuucuauacauuuuuaucuaguauugaaaaguauuuaaucauaggaaaauguuuaugaaauaauguuaauuuuuaaaaaacagauuauaaagcagaauauguaguauaauuacaguuuuacuuaaaaagaaaaauauaggaacuguggauauaaaaaaacugaaagaaaauauacugaaaugcuguggugaauuuuugguauaagugauuuuuaugauuuuuaacuuucuuauauuuacaguuuuucugaauaugugauacaauuaauauuauaaucagaaaguaauggauaauauaacagagaugguuuuuugaugcauuuuuucuuacuuugcagacucuuauugaacaaauagaacugcggucugaaaaaauaccugagugaguaccuagaaguuaaucugauuuccacaugaaccuuugucuuguaguacuguuuuuccaaaucuggaucucugauauuuuaugagcaauugccuuccagcuuguucuuguaacauaccacuuauuuuggggagcaaggucacagacuuagccaguuuacaugacagcaguuuuucccauacuaggauuugcuucuuauuugggcagauguggggucacuauacuuggaaaagaaagcuuucuuuaaaagauaaagcuuauggcaucacaguucauuaugguuugcuuuuguuuugugucuguauuucuaguauuaaauaguuaaugugggcaaaugagaggugaccguuauagcuuuaaaagagguuuggcaaccuacacugggauuuaagaugaaauuuaguuuacauaucugaaaugaaaaguuuaaucucauuugcuuucugucagauaccaacaacugcuaaaugauauccaccaguguuaccuugaucagcgggagcuccuuuugggcccuaguauugcuugcacuguugcagaguuaaccagccaaaauaauagagaucacugugccuugguaaguuucuacuuguuuugguuuaauguuaaaucuuccucuugaguuauguugauauccuagaaacuauaccugguuaaauaagauuuggggcccauaguuaacugaaaaagcauguuuuucauuaugacaaaucuaguuugguaauuagccuuauucaccuuugcaaaauauucucauuuuuuacuuauuuuuugagauaagaagauucacaaauaaauauuguucuugaaaaaugagauuucaaaguuuguagauuuauauuaacaauuuagcuuuugcugcagaagugcuuuuuuguuuaguguaauuuuauucauacuauaaauuuuuuuacuauaaaaaaugcauaagcgcucuuuuuugaaaugcuuuugaacuagaaaaguaauuuguguuuauuaugagaaguuuagaaacuaaagcauuaagaaacuaaaagucaccuauaaucucauuaugcagucaucuaucgaaaaccaaccauuuuccguucuucaguaaguuguuuuaagaguguguauguguuaucucugcacauaaaguguaggcuuuauuucauaaacaucagaaauguugugugucuuuaacuguaggugguguguguuuguuuacugcagguucguaguggcugugccuucaugguucaugucugccaggaugaacaccaacuuuacaaugaauuuuucacaaaaccaacaucaaaauuagaguagguggacauggaaucuaacucuuguucauaaaauuuaacuugcuaaugaccauaaugaaucaguauauuauaggaguauucuaucauuaacuggagaauguuuuaacuuguuugugucugugaacagaauauuguugggugggacagauauuuucuuaaaaguuauuuucuuaaaugugcaacuuaacaugcuuuuguauuguuuguaauguaauuauuuagauauuauggugugauaggaagaaaucuauacagaauucuguagccucgggaucuagaucccuuuaucuccacuaaguacaauaauuccuucuaguuaaaaaauucuaugauucuaacuaaugaaagauuuaaaaauacagauacuauuuaauaaccuuuucuuuauuuuucucaaaaugucuuucagauccacuguuagucacuuuugguuucuuaauguucacucuuuugacucuuacaaacauuccaagcucaugacucuuguaaugaggaagagaaaaguauuuuaugguuuuaguugaagugaucacuuuugaugaaauucuguguagaagaguaccauugacaguaugaagcauauagacaacuuaaguuuuucuuuuuaaauguuuaaaauuucucaaaauacuuggcguaugaccaaaguacuuugaauuuuguuuaucuaaaucuauaaguauucaauaauuuuaaacuugucuuuccucggggaaaaaguuaccauuugauugauagugaaguagaauauaaaagguaauuaaguccucugaaauacuuuuuauuguuuuugaaaggacauauagaaaauuauugcugaaauagauaaaaguuguaauagguugacuuuuguuugggggcagcuacuuugaauugacugcuguggauugcuugauucugagcuuuuaaagcaaaaacuguuuauagaauuacuuucagcuuuucccuuaucauucuauaauguccucagauacuauuuuccaguagauacuuauuguucuuauugacuggaagaaaucaaugaggauuucuaaauuauuacaaaauccugaaaaaacuacuacuaauagacauuuuuauucuuucauuuuagugagcuuuuggagaaacugugugugucauuguaugaugucuucaggccauugaucauucauguuauucacuuagagacucugucggaacuuugugggauucuuaaaaaugaggugcuugaagaucaugugcagaacaaugguaaaugaguagaaaugaucauuuuaaguuauaucacuggcucaaugaauuugaaaaaaaaauaagugcuucuucccucaccccacuaaauagauaaauuuaauauuuuugaagcuuggcuugaugccuuaccccuucuugaaugaaguugcaccuuauucugucacuaaagacacaaucagauagggaaagaaucuuaaaaucuggguaaaauuaguaauaaaauaauuauagucaguuuucuuucuggcaucuggaauccagauagaacacaucguuacuuuuggguuaggcauuucuagcacacuguuaccagaauacaaaauacauaaauaaauaauugaauauauuguauacuuuugauuaaaaaacaggaauuguuuuguguauauucauaauaauaguugaucuguuuugaaauuacaaauaaagaaaagcgguucucuggaauagcucuacuuuguccaucugauacauucuucaguauuugauuugauugucauagagaacaugauuuuccuaauaguaccuagguaccuuuaaaaaauacccuuuaggccgggcaugguggcucaugccuguaaucccagcacuuugggaagccgagguggguggaucaccugaggucaggaguucaagaacagccuggccaacauggugaaaccccgucucuacuaaaaauacaaaaauuagccaggccugguggcaggcgccuauaaucucaacuacucgggaggcuuaggcaggagaauugcuggaaccugggagggggagguugcagugagccgagauugcgccauuacaccccagcccaggcaacaacagcaagacucugucuuaaaaaaaaaaaaaaaaaaacaaccuuucaaguaauuauucuacucacagaauuuauuguccucaguuuggcuuucauugagacacuaauuuguuacucuuccaaaguuacucaauugcauuuaacucauucauuuucucacauuuuacugcuucuaaauuuuuuauugcuucugauuuuaaaauucauaugguuuuuuuguuuuguuuugguuuuugaguugggggucucacucuugucauccaggcuggagugcaguggcaccaucucggcucacuacaaccucugccucccggggucaagugaucucccaccucagucucuugaggagcugagacuacaggugcaugccaccaugcccagcuauuuuuauauuucuuuuguagagaggggguuuugccauguugcccaggccggucuugagcuccuggacucaagcagucugcccuccuuggccucccaaagugcugggauuacaggugugggccacuguaccuggccaaaauuaaugugauuuuuuuuuucuuuuuuucucuuuucuuuuuuuuuuuuuugagacggagucucgcucugugcaguggcgcgaucucggcucacugcagccucugcuugccggguucaagugauucuccugccucagccucccgaguagcugggacuacagguaugcaccaccaugcccaacuaauuuuuguauuuuuaguagagaugggguuucaccguguuggccaggauggucucgaucucuugaccucaugaucugcccgccucggccucccaaagugcugggauuacagccaugagccaccacgccuggccucuuuuuuuuuuuuuuuuuuuuuaaauagagauagggucucacuguguugccuaggcugggcuugaacuccuggacucaagugaucauccuaucugcgccucccaaagugcugggauuacaggcaugagccaccaugccucgccuaaugugauuauguguuaucuuuaacccccugucuuuuggaaagcuguuacaggauuacuagugugucuuaacauugauggcaucuuuuuuauuuauuuauuauuuuugagacagggucuuacucuauugcccaggcuggagugcaguggcaugaucacagcucacugcagccucaacuucccgggcucaggugauucccagcucagccucccaaguaggugagauuacagaugcacaccaccacgccuggcuaauuuuuuguauuuuuauggagauggaguuuugccauguugcucagguuggcugaucuugaacuccugggcuccagugaucugccugccucagccucccaaaaugcugggauuauaggugugagccacugcgccuugcugauggcaucuuagaaauaaagaaauacuaaguaaacucauacuuuauuuuacuuuuuacuuuucucugugaaaauguuaacaagucauucaauaucugugguacucaauuuauuuguaaaauggggaugaugauagcccaguuaauaagcuaccuuagcaauuucuuaggcuuggucugaagcuauaugaaauaacuuuuaaagagcaaagcacucuuaaaauucagauuuuauuauucauauuaauaauauaauuaaacagaguacugcccaguuuuaaaguugaggaaauugaaagacauuuauuaaacuuuuccaagcucauugagucaugcugaaauagaauacaaucacagccucugaagcaaaagugguucauacuguuucugaacaauuuaguaacaucuuugcuuguuuaaaagaaaguguuuuucuaaaucuaaaagaauggaugauugcacuuuuuuaucagcugagcaacugggggcauuugcagcuggagucaagcagauguuagaagauguacaggagcggcucgucuaccgaacccacaucuauauucagacggacaucacgggcuauaaaccagcuccuggagaucuggcauaucccgauaaguuagucaugauggagguaggaucuccuuacuugaucucccgucugcccccacacagcuuuuagauguuuuauuuauuauuuuuuuaaaaauuuauauauuaaaauagagacaggguuuccccuuguugcccaggcuggucucgaacuccugagcucaagugauccaccugccucggccucccaagugcugggauuacaggcgugagccacugugccuagccuagauguuuuuuacuaguuaaaaugggauuuuucuuuuuaauucuuccucaaaauguaaaaucaagauaaguuugcuauaaaaauuaaaggagauaaaauuuaaaagaauuaaaaauaguuuguuagguugucuuuccuucaaguuauguuuuuuuguuuuuuuuguuuuuuugagauggagucuugcucugucgcccaggcuggaguacaguggugugaucucggcucacugcaacuucugccucacggguucgcgccauucuccugccucagccucccgagaagcugggacuacaggcgcccgccaccacacccggcuaauuuuuuauauuuuuaguagagaugggguuucaccguguuagccaggauggucucaauccccugaccucgugauccgcccgccucggccucccaaggugcugggauuacuggcgugagccaccgcacccggccccuucaaguuauguuuuauaaacauucuauuccauucucuucccauuggcaggaaauacacguucucaauuuuaaaauugaguuagugaucccugugauuucucuuuagaaauagaagaagguugauaauguagaagccaccagguugauggugaugauguaaccgugugucaugcucucucauaaaaacccuggaggccgucuccucaaaauuauaccguacaaguguccaguuuaugguuugaagacuuggguuuaucuuccugaucuuucaguuccauauaugucuucauuuucuuugaguucuggacagacuuuaaauaaugccuaagauauuagugcugaaacagaauuagaacuucuuaaauggaaauuuucaaauauaagcaaaaguagaaacuguaauaugaugaacucuuagguaccauuaccucagcuucaacauggcuagacuuuuuguacucccuuucacccccauuaauuauuuuaaagcaaauuccaaacaugauuucaauuaguaaauacuucaggcugggaaugguggcucaugccuguaaucacagcacuuugagaggccgaggcgggaggaucacuuaaucucaggaguucaagaccagccugggcaacauggcaagaaaccccaucucuacuaaaaauacaaaaauucaccaggugugauggugugcuccugugaucccagcuacucaggagguugagaugggaagauuacuugagcccgggagguggagguuucagggagccgagaucacgccauugcacuccagccugggugacagagccagacccugucucaacaacaacaacaacaacaacaacaacaacaacaaaguaugaccacucaaggcuaagcaggacggaauauaacuuuacacuccugaaguuuaauagauucuggguuacuccuucuaaguagcagaaaccaaugaguaaagauaucaagucaagagguuaaauaagcaaaacaacaauaacagaauuaaaaagaaacuuucaguagguaacucuaaaaaguuaagggcauuuuuauuuuuaacacaaccauaauauaauuaucacaccuaaaaacaguguaguuccuuaauaucaucaaguaucuagaacuuauuuuucagauucaccaguuguuaauauuucaucccauuuacuuuaucucuuuguguguguguguggcugagccauuugaaaguugcagacaucaugacuccucauuccuaaguacuucaguucuuauucucguaagaauaaagacaauuguucauauaaccacaguaucauuuuuguauuuaaggaaauuaacauuaauucaauaauauuauuuauauauaguccauauugaaauuuccccauuuguccuucagaugucuuuuuuuuuuuuuuuuuuuugagacauaguuucacucuuuucacccaggcuggagugcaguggcgccaucuuggcuuacugcaacuucugccucccggguucaagcgauuucaagaaauuguaugugaaacaauuucuugaugugaaguagggguccaguuucauucuucugcauguggcuauccaguuguuccagcaucauuuauugaaaaggcuauuauuugucuauuggauggucuuggcacccuuguugaaaaucaguugaccauagauuaaugguuuuuuuguuuuguuuuguuuuguuuuuggacucucaaguuuauuccauucaucuuuaugucuuauccugugcuagcaccagacugucuggauuacaguuguuuuguaauaaauuuuguacuugggaagcaguuuugcuauuuuguucuuuuuuuuuuuuuuucaaauuguuuuggcuauuuugggcuccuugcaaugccauaugauucuaauaauuugaaucuucuuucuuuuuuucuuggucaaucuagaguccuuuguuuucuugcacaagaugauacaggcguucaccuuuuccuugcuccaggaauguuucacauuccuugcuccagaccuacggucagcucuuucuccaggaacccuugguuccuuaaggggaaagagggugguauuuagaaaccaagaucugaguauuaggugugcucauuucuagugguggauuacuucuagcccucuuuaaagagcuagaaaauauacauuuuaaaauaucaugaguucauacugaaaucuccaguucagauccaguuccacaggguucuuccuuuucccauaucucguauucauguuuccagucucacagaagaaacccuggcuccuagcaccucuaauguauuuacucauuugcuucaaguuacaacauacacaaauaguuucagaauuauaacacuaaugccaugauuaauagcaaacuuaauucaagauuuuuauacuacuuuuguucuuagaauauauccuacuaagauauacaaugagauugcugucagacguuugauucuaaauauagaucugcagauuucaaaucucuuuagagauuuuugcccauguaaguuugccauuugcauggcauagggggaaauguaagagugagauagaccuggguucaaaucccagcccaguuaguagcucuuucuuauuuuuuauuaguauguuuaauuauuuguaaaacaggcauaauacugaccuuggaguauuguuguaagaguaaagauaaugacccagaaagcacuuaaugcugguagucauaugagagacaguggcuguuguaauuuauuuaacccuugaaauauugaaaaacagaauauuugacuuuuuaaaaauagucuuggccaggcacgguggcuugcgccuguaauacuagcacugugggaggccaaggugggcgaaucacuugagcccaguaguucaagaccagccugcacaacacagugaaaccccaucucuacaaaaaauacaaaaaugaggcaggcaugguggcggcuguaguccuagcuacucgggaggcagaggugggaggaucaccugagcccgggagauggaggcuggggugagcugucauugugccacuguacuccagccugggucacagagugagacacugccuuaaaaaaaaauauauauauauguaugugugugugugugugugugugugugaguguguguguguguguguguguguguguauauauauauauauauauauaaaaaagaggccugauuauuuuauuugaaaaauuccaaaggcaguuuuggugcuggugaauuuaaaaaaugucccuugaaauaauuuugcuaagucaucauguuucuaacguguuuuaaaaaaauauaaucuugagaaaucuguaagcuauuaaauuuuuuaaaaauguaaucuaauuuuugccaggucuaaacacuaaucuugcuuaauuaguuuauauaaggagugcuguagaccuaaauaucuguggaaaauagauuaaagauaauuucuuucuaaguguauccuguauucaucagcauaucuuuugucacaaagugccaaucuguguuguuaaaguugucagauguggcucagauacuauccuguuucuauuuagacugcuuuucuuggaugucaaauguccuaauuucuuuuauuuuuauuuuuaaaguagacuuuguauuguaagauaguuugagauuuacagaaaaauugagaaggugguacagaguuuuuauauacccugcacccaguugcuccuauuaccaagaucuucuguugguaugauacauuugccacaauuaaugaaccaguagugagucacugguauuuauuuacuaagguccauaguuuauucagauuuucuuaguguuuuucaugucuuuuucuauuccaggaucccauuuacaacaccacguugcacuuaguuuuuaugucuuuuuaggcuccuuuugucugugacaguuuuucagacuuuucuuguuuucgaugacuuagcaguguugaggacugguuuauaguguugucaugaguauuucaagcuuuuuauacaaugccccuuuguuggaauucgucugauguuauccuuaugauuagacuaguguuuuggguuuuggggaggaaaaccacagugguguaaaaugccauuguuauuacaucauauuaaggguacagccuuucaacaugaauguucacuguugauauugaacuugaccaucuggcugaaguaguguugucagguuucaccaccgugcaguuacuccucuuccccacuuuccacacuguacucuuuggaaggaagucccauguguaacccaugcucaaggaguggguugugcucuaccuuuuuugagggcaaaguaucuauguaaauacuuggaacuucucuguaagggagauuggucucuuuuuccaguuuguugauucaaucacuuacugaugucaguguggacuuggucucuuuuuccaauuuguugauucaaucacuuacugaugucaguguggacuuaacggauauuuauucauacuuuggguuauaguucacugguacuuuauuuugcugcuccagcuuucaccacugggagcucuuucaguuggcuccuauguccuuuugacauacucauuuauguagauuuuuuauuuugagaacuuucuuauuuccuggcacuauaagaacuucaggugcaucaguauauuuccugcuucucuccuagaaucgaccauuucuucaaggagugcugguuccuuuauugaaggauuguauuagaaagagaucugggcauuaggugugcucguugcuacagggguauuguugcuuuuaagcucucucaggugcuggcauagaaauauguguguguacuagaucauuccuguugcuccaaauccucaccagcauuuugacuuaaccuaauucauuucaaugccuagguggauaaauauguaauaauagguauguucguuuuaaaguuaacaggcuggaaauauguucuuaccuguuuugaggauguucuccuaaacuuacaucucuuccucugacuucuauuuaaacuuacugcauuuuggcuaguuauauuaauuauuuauauguuguuacuuuuuaaauaauauacagaaucaaccuugcagggaucagauccccuuguagggcaggcagugggggcuguuucuuuucugugguccauagcuggaauuaucuuuaugugucuugguauugcggauaacaacagggagcagaugggugguccauuugcaggagcugccuugacuuugagggccacaaagcagguaugaugaagacuagaucuguuucccagccugaucuagugaauggugcucccuccuuuuccucccguccuggccuucauuaggaguaucaguuuuuguauuauagauaagaaugccuguuuuaauugcugugucugauaggauguuaggugauaaaguuuucuauaugcucccuucccaguguaauuuagugguauauuugguauguuuauucagucauuacauggccuguauccuggaugcucccuuguguaguagaccuuuuggcuuaaggguaaccacuugcaguaaauaugcuuacugugauuuucuuuuggugagggacugggguauaagaguggucuggcugugacaucugcaugccguuuaggaauuagcuguacuuuccaauuucugcacguggaaugaguggacuggccuaugugguagggagucuguuuccuaaucaauucucuggcuauuaauuuuuuuuuuuaauuucaauaguuuuuuggguacaggugauuuuugguuacauggauaaguuguuuaguggugauuucugagacuuuagugcaccugucacccaaacaguguacacuguacccaauauggagucuuuuaugccuuaccugccucccagucuuugccccggaauucccaaaguccauugucucauuuuuaugacuggccauucuuuuugacaguaacuaaaugacuguuaggucuucauuucuguguauuuccaccuuuauaauuaaugcaaauuagugggauuuucauuacuaauuuaguaguuggugucuccuuuguauacugcaugauauucuuuaggcagugaguccaugcuaauuuuuaaaaaauaucuguuucaaaaauagcauacuguagcuauuaucacauaaagcaaaaaccuguuauuuggauuggccaguuacuugaacaaaaacauuucuaauauucagaauguauccagucuuaaaucugaauaguuuccaaaugucaaguugaaaauauauauauauguacuuuguauaaagaacauguucauguugccaaacacugcugaaaacgguaacauuccuucugauuucuuuauacagcagauugcacagaguuugaaagaugaacagaagaagguaccuucagaagcuucauuuucagauguucacuuagaagaaggagagucuaacagucugacaaaaucugguauguuaugaugucuuaacugccagcauuuauucauuuggguuaacaaaccuuuacugaggacuuguccugucccagacaugaaaaacaacuugugccuuugaggagcccacacuuuauggggggagauugccaagccacagacagaauucaguggugagugagaugcuaaugguuugcacaggguacccuuggaccauggaugaggggcauggaaauugcgaagggagaugagcucugagugugggaaggugggcucagugugggguguggugucugagagcuauaauguguuuaugaagaguaugagagagccaggugaaguaaguuuguuuaagauagauagaauagaauguagaaaggcaugcaggaauggaaaaccauggcuauuuugcauaauucaagugguuugguauguuugggcccagguuguauguggggaaggagcagguaaaauaggccagauagggauagaugucaugugauagucucauggccuuuggacuucuagcuggcauaguguaucauggugacuggaccaucagauuugcauuuuguaagcauacugagugucugggacuggaguaaaauacuauugacacaguuguaugggauggcuuggacuaggguacauguuauacaaggagcaaaauugucccaagaaucacccuggauacucauuagggaccuagacagcaagcuagaugggaaguaagccaucucuuccccacccagcuauaagaguggcccuaaagcguagcuccccaugggacaacugggaagguggguacuguaacuccaugggcuuuaaagagccccagcuaccucaagauccccaggugaagggcaucaucagguauucugagucuacucuauaaacaguugcuacacuaaauccagacugucaagcagcuggauauugcccaucugacaaagucauuuuaucaugcucgcccuauaggagggaggacccacagagggcugaaauuuccuccucugcaauagaacccauaccauguccuaguauaccucuugguccuaguauaccucuuuaugagcacgggagagacgagaguacauuucugucuugccaaccccggacuugugcguuuucucuuuccccacuaaagccuacuuuuuaacccauuacuggcauuacaaugaggcagugauggguuauuggcagaacuguagagacugaucaggaaguuguuauauuuuuccauuugaaagauaaaggugguuugaaccagggugguguuggggggauggagagaaauacagagaugagggauaugguuagaaguuugaaucaguagaauuugauggcaccucagaugugaggguugaauaagguccauguggaacaacugagagggucuguauuauaugguucuagaagcuguacuguccaauaugguagccacugccauugagcgugugaaauguggcuagucugaaugugcuguaauuguggcuagucugaaugugccauaauuguguaagauucacaccagauuuccaagacuuaguaugauauaaggaauggaaaacaggcugggugcagugggucacgccuguaauccuagcacuuugggaggcugaggugggcggaucaccugaggucaggaguucgagaccagccuggccaacauggugaaaccccgucucuacuaaaaauacagaaguuagccaggcguggcugcaugcgccuguaaucccagcuauucgggaagcugaggcaggagaaucucuugaacccaggagguggagguugccaugagccgagauugugccacuguacuccagccugggcgacagagugagacuccaucucagaaaaauaaaaaaaaaaaggaaaauaucuuauuaguaauuuuuauauugauuacauguuaaaaugauauuuuggacauauuggauugaauaaaauauacuaaaauuaauccugcuuccuuuuuuuuuuuugagagacagagucucacucuguugcccaggcuggagugcaguggugcagucucagcucacugcaaccuccgccucccggguucaagcaauucuccugccucagccuccugaguagcugggacuacaggugcacaccagcacgcccagauaauuuuuguauuuuuuaguagagaugggguuucacuauauguuggccaggcuggucucgaacuccugaccucaagugaucugccugccuuggccuccuaaagugcugggauuacaggcgugagccacugcgccugaccaauccugcuuucuuuuuacuuuuuuuuuuucuuucaaagagaugaggucucgcuguguugcccaggcugguuucgaacuucugugcucaagcaauccuccuguuuuggccucccaaagugcugggauuacaggcaugggccaccaugcccagccauuuuuuucuuuuuuaauagacauggagucucgcuauguugcccaggaugggucuugaacuccugggcucaagcaguccucccaccuuggccucccaaagugcuagaauuacagaugugagccacugugccuggccucuuuuuacucuuuuuuuggagacagggucugguucugucgggcaggauggagugcaguggcaugauauuggcuuacugcaaccucugccuccugggcuuaaagccaaccucccaccucagccucccaaguagcugggaguguaggcucaugccaucacgccuagcuaacuuuucuacuuuuuuaaaaugugacguuuuacugugucacauuuaugauuuacauuauauuuccauugaacagcacugccguagagcuguagagagaaagacugauuuagaaauaaaggaugagguguaguuggugcuuugggcuuguguaagaucauccuaggacagauuguagagugacuguagcagacgucuugggagagaaacugagccagugcugacguuaaggagcaaauggagauagaggaguaaacuaagcccaccaagaaagaacagccagcguggucagaagugggcaagugagagggugugauugaugucagaggaggagggguuggcaguguaguuugcguaaacaggugagaagaucgaaaucucaagaacauuguaguuauaaaguggcaugcuaaguuuuaaaacuuuagagguggaacaguugagaggaagaaggaagucuguggaaaguaauaagaaugcgauucugcgaguauuaagaaaaucugccccugggguaggggugugaggauggaagagaaagucuuuggaguugagaagguaaggaugaacagcucgucaucugugcaguuaucaguguuaucacaauggcgauagaacuugggguggaaagcaaggcucugagucagguaggaaguggagcaaaaccaaaaagaauagucauaaucacuuuuccugguuucccgguucccugguucccaccucuaaagcuggaagugagagaaugagaagccucugaaaggagggcuuuaaaugaugugaaguucauggcauacaaggaggugucagggcagauugguggagggacccaucuugugaagagaccaguuaucaguaccuucaaaaaguacagcuuuguucuguauguagagcaaguaagggggaggugaggcccguggaggacgacggaggcagacgugcaggagggcugugggagaagcccuggucccggggccugcucugcuccucaggaguggcagccagagggcacuuggcuuuugaggguuugccccggugaacuaguauuaguuacauaggaaagggaaaaaaugaacacaagcugacuucuggcuuuaaaguacuuaaacacauuuguuugacuaaacuuuuauuugggagaauucuuuuggcacuuuauuuugaagaagggauccugcacauaccauauuccuaaggaaaacuauaaauauuucaucuccuaaauauucuuugauguaauuuguuuauucuuuuucuuuaagaaacuuaauacaaauuaaauguuaguuuaaagugagcucuuauggaagaaauuuaaaaauuauacaaguuaaauaggaguggugagagagagagaaaaaaaaauuuuacaaguaguacuuguuuuuggaaaaaaagcuuacagaauuguaaagugaaaguacuggccaggcacgguggcucacaccuguaauuccagcacuuugggaggccgaggugggcagaucacccacggucaggaguuugagaccagccugacuaacauggcaaaaccccaucucuacuaaaaauacaaaaauuagcugggugugguggcacaugccuguaaucccagcuacucgggaggcugaggcacaagaauugcuugaccccaauaggcggagguugcagugagcugagauugugccacuguacuccagccugggcaacagagccagacucugucucagaaaaaaagaaaaaaaaaaaaagccugggugugguggcucaugccuguaaucccagcacuuugggaggcugagguggguggaucacuaggucaggagaucaagaccauccugaccaacauggugaaacccugucucuacuaaaaguacagaaaauuagccgggugugguggcaugagccugugaucccagcuacucaggaggcugaggcagaagaaucacuugaacccaggagguggagguugcagugggcugagauugcgccgcugcacuccagccuaggugacagagccuagguccaaccuaaaaaaaaaaaaaaaaaaaaaaaaaaaaaaaggaaagaaagcacuaagcuucaaccuuucucccucaucccuuuccccucaaaucugugcuauacaaccuacaggccuucuuguaagaauaugcugcuauaaccauuuauaaaaaggaauuaauguuugcucuguaacuuaauaccaguguaucauagaucuacuucuauuuucuuauuauugaaaacauuccaaauauacagaaaaguugaaagaaagaugaaugaugaacacccauacccacaacuuggauucaagacuuaacauuuuauuuuuuauauauauuuuuauauauauauauauauacacacacacacacacacacacauacacauauauauacauauauguguauguguguauuuguauguguugggguguguguguaaauauauauuuuaugaaccauuuuaaauuauugacgucauugacacuucacccuugaguauuucagcaucuccaaaaaauaacgacaucuuuuacuuaacaauaaaccauuauugcacuaaaaauuuaaugaguuugcuaauguccucuaaugccuaguccaucuuucaauaucaccuguugucucaaaguauuauaccagcuccacuuuucaugguucauuugaaauuuggucccucgacccagaagugauuguacuucccuuacagaggugucuuugcucaaccauacuccccaccugcucuuccucacagucgccagagucugccuuuucugaccuucccagugguggggggaagcccgcucuggucaccugggaauuggauguacuaacuaggccuguaugugauuugacucagaguguggaagacagucugacaggugaaccuaauuugauuaaucccccuguuuagaagugcuuuguuuucuuguuacucccccaccuccacaggcucccaccugcuuccuuccucaugacuacauagagaucugcuuccuuuuuuuuuuuuuuugagacggagucucacuuuguugcccaggcuggagugcaguggcgagaucuuggcucacuguaaccuccggcucccagguucaagcgauuuuccugccucagccucucgaguagcugggacuacaggcacacgccaccacgccugacuaauuuuuguauuuuuaguagagacgagguuucaccacauuggucaggauggucuugaacuccugaccucaugauccgccugccucggcaucccaaagugcugggguuacaggcgugagccacugugcccagacgaucugccuccuuuuuaauggcugcauucuauaaugugauuaugcuuuuccuauguuccauaaagauuauugaucacaauuugggaaaagcaacuuggguugagcauauauauaugaagcuggaauguauguauguccauauucauguguauucucaguuacuguguuaaaucucaccugucacugauuuagauuucuuaggguauucuugaugaaaacugaggugggaaaaaauuggugcccucuagcuacuuauagcuaaugagaauaagcaguuuauaguugccauguaaauuauuguaagacaaauauccacaugugugaaaugugucuucuuuuccacuuggguuuuagguucaacagaaucccucaauccuagaccacagaccacaauuucuccagcagaucuucauggaaugugguauccuacgguucgaagaacucuugucugucucuccaaauuauacagaugcauagauguacguguaucuuuacugugaauugcucguucuuucacuugaaauauuuuuaaauuuacauuuuaagaucuugauaaaguauuuuguuggauauucuuaaaaucaugauuuuuagauauggaaguaacuugaggucaagcuaauuuaggaauuucuaaccugaacuuucuauagaaacuuauaauucaguaaugggcuuuggggagucuauggacaccucaaaauugugggcaaauuuugcaugacuguuuuaugugugcauuccugaagagaagacccugacugcauuuagagcaaugauuaaauacagcagucauguaaugaauugucuagaugccacuauuucuuaaggauaugguucaaaaggaguaugcauuuacccuuacaccgcagagauauuuuauauuguaggacugcacaguuguuucauugggucaguagaauguacacuacucuauauuuaauuuaaaaugcauaauugcugggcuuugugcuuauagauuuugaaaugcuaccaaaagugccuuuugcccaguucugggacucuuaaggacaggcccagaucaccucuacagacuuagaugucucagccuuuuugcccagcugaugagaucucuuccagagagagguuuggauauuuggcaucucuuccuccccaggguguccauuagguuuauugaauaaugauauuaggcugagauucagcaacuuccugcaguggagucaggaucccaaggaaaauacgcaggaggcauauuccacauagaacccauugucaucacagacucuaggaaauaaaaccucuuagggugcuuaacagggauuuuagcuuaauaguagguaggccugaggaggucacuaugccaguuuugucuuaugccuuaggcuggcuuauucuuuuuucaccuagcuuauauucaaaucuuaacacuuuuagucuuaccgaucaaagguggggaaagacaauccaguguaaaauacguuaaggcugagcaagggaaggcgagggucuuggucuaagcugcucaucuuaagcuuucuuaggcaggguuagugacccagcagguggcagcucuaaucucuccuuccuauaguaauagccuugugggaaaccacagaacagggagaagcaauguaaaaagagaauaacaucaaguuggagaccagggcccaggacaguggccuaauaaugaauaggcucauauuuauguagaauggaggcugggagugaagcaaggggacugacaggaguccugguccaaccaccaugccacaccucugggaagauaguaauggcagaauuaaauuaagaaucauacugccuauaccauuugguaaccuguuuuuuuuuuuuuuaaacuccauuaugaauuucaccgccuccuucagcauucuuugauuucauaaacaguauucuauaauuuagauuuaguccuauuuuauuugucaguccccugucuuugaacauuuauguuauuuccaguuuauggcuguucuaaauaauacuguaaugaagagccauguacaugauuuccuaaaauacaauucuguuguauuuuuagaaguggauuuacugaggguuuguuuuaaaguugguuuuagagauuuaaaaaagagccccacaugagaucuuguuggagcgaaggcuccgugaggucagaaccaugccugccuauauuucuagcaucuagcacagugccuaguaugcuaaucaauauuuauugaauggucacaugaauguuuccagggaugacugcauauuacauaucuauguguugguuuagaaagguugcaugggaauaggaaaccaggaagaauaauacaaguaguaaauuaauccaaccaugagggcaagcaggcauuguuauuugcacuuacagccuaggauauuccuuuuuuuuuguuuugucaaaugccacaggcugauuauucucuuuuauuccaccagagggcaguguuccaaggauuaucacaggaagcauugucugccugcauucaguccuuacuuggagcgucagagucuaucagcaaaaacaagguuugaugaaguguuaggugaaauccuguuuccugguaaaauauuguggaauauagcauuuacuuauaggcacagaaguuuaaagcuguuuuggcaguaggauuuguuuaacaugauugaauuuugaggcucuuugagagaaacuguuauuucauuauagugcuaaauaaagacuguacuauauaagagaguccaacuuugcuaaaguaccaaaagugguacuuagguuacacauucuauagaguaaagguuucuuguuguaguccuagccacuggggaaaugauacuauuucccuggaauaccaagaaagcauuuucaaggaaacaucacaauuuauaaucaucucucucuacgauaauguuuuaaauaguugaauguucuuacauggaggaaaugagucagucaauuuugaggacagguaauuguggcucuggguugugugacuagaaggagucaccaugacuguauggcuuacaauuuuguuuguuuguuuugagacagggucuugcuuugucucccuggcugaagugcaguggugugaucauagcucacugcagccucuaucuccugagcucaauccauccuccuaccucagccucccaagaaucugggacuacaggcauguaccuucaugccccugccaaguuuuguauuuuuuguggagacaggauuuugucauguugcucaggcuggucucaaacuccugggcucaagugauuugcccaccuuggccucccagagugcuggaauuacaggugugagccacugugccuggccuuuuuuuuuuucugagagagggucuuacucugucaccuaagcuggagugcagugguaugaucucuguucacugcagccucaaccuccugaggugaagcaauucuccugcuucagcuuccugagcaacaggacuacagguaccuggcuaaauuuuuuauuuuuuguagagacaggaucucaccauguugcacaggcuggucucaaauuccugggcucaaaugauccucuugacucagccuuccaaagugcugggauuacagguguuagccaccgcacuuagcgguuuacaguuuuuaauccagaagggaucuggggcugaaggcugcuggcaugugcuucucccacagacccugagauuuuuuuuuuuucccaggaaguagagcauguucaaaaguguugcuuugcuuaacucuccucuuaaaauaccugucaccuauagggaaggagcugugggagcuguuucuagccaaaauuuucuucccacuuggaguguucagauccugugaacuuuuuuugauauauggauuuauaaacgugacuuuuaaggcuuuuauauauauauauauaauauauacauauaaauuauauauauauaauauauacauauaaauuauacauauaauauauacauauaaauuauauauaauauauacauauaaauuauacauauaauauauacauauaaauuauacauauaauauauacauauaaauuauauauaauauauacauauaaauuauacauauaauauauacauauaaauuauacauauaauauauacauauaaauuauauauauaauauauacauauaaauuauauauauaauauauacauauaaauuauauauauaauauauacauauaaauuauauauauaauauauacauauaaauuauauauauaauauauacauauaaauuauauauauaaaagugauauauacauuuuauauauauguaucucuccacagaauaauuugggaucuuguugcuaggaaagcuuuaucuuugugaccacuauauuuuucucauucaugaaauggagaggugaaaugaaauuuucacauggggacuagaaauaaaguuauagacaggcagauuuaaguuuuaacaaguauuuccaagucugugcccgcacauuuuugauaauaggugaaauuagaaaacacaugucuaauguuaaggaaaugguuacauaaauuguggcauguuuuauauaacaauauuacacagucauuaaauuuuuaaaaaugaaacaauaaaauuuaacuuaaacauauuaagacaacagguauuuaagaugcaaaucagauaauaugguaugacuauguaauaaaaugcauugaagaaaauauguaacagugaaagcuuuuaggugacuauggaugauuuuuucucucauucccuauacaucucuuuauuuucuacagugauccuguguuucucagaucucaggagggaaaaauaugaccuaauuuuaaaaaaaguucauaggcuuauguccucuuguaccacuguccucucucuuuuuuuuuuuuuuuuuuuuugagacagagucucacucugucacccacgcuggagugcaguggcgcuaucucagcucacugcaaccuccaccuccuggguugaagccauucuugugccuuagccacccaaguagcugggauuacaggugugugccaccacgcccagcuaauuuuugcauuuguaguagagacaggguuucaccguguuggccaggcuggucuugaaugccugaccucaagugauccacccgccuuggccucccaaaauguugggauuacaggagugagccacugcaccuggccauguccuuucucuuaagggaggcaugaaaagcguuuugauaguucggucuuuugcccuccuuaucuguaggccauccucuuuuaucuaauucuguuuccuacauauuauaagagguuuaaauauguauggagaagcucucaauuugauagacacuagcuuauuauuuucaugguugagcuuguguacuuuuuuuuuuguuuguuugagauggagucucccucugucgcccaggcuggagugcaguggcgugaucuuggcucacugcaagcuccgccucccagguucacgccauucuccugccucagccucccuaauagcugggacuacaggcgcccaccaccaugcccggcuaauuuuuguauuuuuaguagagacgggguuucaccauguuagccaggaugguuucucugucuccuuaccucgugauccgacugucucggccucccaaagugcugggaucacaggcgugagccaccgcgccuggccaagcuuguguacuuuuaucuuaaaaagugaucagugaaaauggauuaaugucuuaaacaguuuuuuaaggcaagaaauuguucuuacauacuuaaacugagcaccugucaacaaauuaacaugauacuauuugcuggauuacaauagcuuuagugaaguaauaaaaucuauaugauacaauuuuuggcaucagaguuguuaggucuuuuaaaaauagagcaaguauuuaaaauguguagcauuucccacuuaccuggugcucuguguucccguaugcagagugaguuuccaugacauaagucacugauuauguuuauuaaaaucaguggagagaguaagcgagacugggaaggaaucuucauuuaauaacuccuuuaaaauuuauauugcuuacugaaagauaacuuuaucuuuuccuaagguaauauaaaaguuucauuagcaauauuuucaaaauaagauucugccuugaguaacagcaagaaggagcaaauacagccuugcucuuauuaauauacaaacucuuuucugaaaugagagcuaugauuauucaguauuugaggauugggucagagguuugagaacggaguuugaaucacaagacucuuguggauggguccugagagggcagaaggacaugcuggaccuucagggauguggguagucagagcucuguugguggcaggaggauccaaaauggcaaccucaaaucauuuuacauuuguauaaauauaaguaugucugauguucuagauauugaaaccacuuugaccaaauagugaaagccauguuccugaggagaaacuagaaugccaggccaggucaggauccugcuuguuauuugagccuuucuuuaccuccucugcucugggccacaguuaggcugcaucaucucuucuaccucugcaccaggugaaaguagauuggacuucucuuuguaaauguguugcuuuacagccuugugucugacuuucuuggauuuuuaaaguagagcaagugacagugcaaauaagaguuugaagcaagauuuuuuaacuuaauucuagcauggggagaguucauugcacaacuaaagagaauugacaccauaggcuguaaaccuagguagauuaauguugauuaauaauguaugcuguauaugcuuuuauuuugauuuaauaugugaucauauccauuuuucugucuuauaauuuagacucagauugauggacaacuuuucuuaauuaagcaccuuuugauacuucgugaacaaauugcuccauuucacacugaauucaccauuaaggaaauuucccuggaccucaagaaaacuagagguacuuugcuguccuggcuggcacacuuggguguguuugaucuguccagaugugucagcacagguuuuagguuuauuuuauguucaucugcaauuuuuugcaugcuuugcuugcuaaauauguuauuuguucguacuaagcugagcugucaccaugcuaaugacuucuaacuugcuguauuuucuuuaugaagggaacuguaucuggacauuucaguuuguaauauuagacucauuuagacucugccacauauuccuacaaccaguuaaaaagugaaaaaucuguauaauaacugcuuccuaaguaaguaaugucagcuaguugggaugauuuuaagcacugaguugaguuugucaguuuaugaaaauucaggaagccagcuggguaaaaugagaagaguacuuaucuaagaauuugaaagcacuggguuuucuuccugucccaucauuucccggccuuugugugaucuuggguggguguuuuagcuucuccaugccaccuuccuuuuauguaaaaugagcauaaugaacuugucaugauaccuucacgagguuaucaagaucauuaagaccgaaaaggaaugaaaauauauguuaacaucuucauaaauuucaggugcuuaaauaaacuucagugguauuaaaucaguaaucauguaagauagggucuuugaguugguaauagacauugaaucaucuugagaaagaugauucauccauccuaaugauuugucucugaauuaguaagagaugauuucuaaaagaucagaguaguuaauuuuuaagauaauugaucuuaagcaguuaaggauauaccauacacaucccucaugucccuuaauuacuuacaaauuuauguaaacuuuaucuuaaacauuucuaagagauuuaugcucugaugccuuaagccauucauuuaugugaucaguuaacuucucucuaauguuuuggggcaauuaaaaaaauggucacucaaauuauuuucuauguguuacaguuuagaggaaccccaaauauaggauguucaaggauagcagguuuuuaguuccccaauuccugugccuaucugauaguggauuugauuuaacucacccgagagccaguguaaccucaugaugauucuucuuaaaacaguuugcucuauuucguucccuagugcucucucuuguccaccacggagaauauguuuugguucuguaaagcauguguguuauguacuuugugauuuuaaaauuuuuaaauuauuuuuguuuuuuucucuaaucuuggaaguggcacaccauguguuuuuguuuugguuugguuuuuaaauaggagccagauacccuggcuuuugccuuuacagaacacauaguuuuuuuaaagcuuauucucaucagaggcuuccaucucccacccauucugguugauuucauucauuccuuucagugugaggugugggaaucaugcucuuacaccuugaagaauucccagcuucugacaguucuuacuuuaagugaugggauagagcaggguugauuuacuuucuuucauuuuuuucuaaaguuguaauuuguugcugcuugguucuaguguagaucaacugaggugagagaaagugaaauaucuugagauuguggcaaaauuugguugaaaguguguuuuccuccaaauauuacaaagccuguguaacucuaccauaugaugauuugauucugugcagacagaaucuuugagggaucuuauagaaaagacagcagacacaacuauuuacuaaagcuuuacucugaauacugaacugauagagagagggucuucuucauuacuaccagggucaaggcaguaaguauuaugguagugugugcuugccaaaccaggguuacaagcauuucaugcuuugcuuuaucuggucuggcaaagcaaagagauguuuuuuucuuacucacuuaauaauacuugcuaucuuuacuuuuacgccucuaaccucucaagacuaacauuauauuguauugcauuugaacaucaaugagaccucagcuaauacuucacauagauucuaguuagucuggagguuaagggguaaauacguccuuuugguguuuucuucuuggcugacacauuaguuuauuauucugcuucaaaugaauaaauuucugugccagccaagauuuuaauaaagaagcuggguaaguauaugaguauuuuuuaaaaaccuauuuaauauccuaaaaguaaagcagugaaauuuuaaggugccgauuaccauuuaucauuuuucuuuuuuuugguaagugaauaauugagauuaauagucauuuugcaauuugaacuucuagaaaauaacucugugaguacuguagccaucacuggugcucaucucacucucagccuuucauggaggugaguugcugaaggugaauuggcuuuuugccuuguggugguagagaacugguguauguuacucauggcuuugcuguugaaacuuuacauguucacuggaugaguaauuuuguuucacagaugcagcauuuaaaauccugaacccuaugacugucccaagauuuuuuaggcugaauagcaacaaugccuugauagaguucuuguuggaggugagaaggagucuguuucauugguggugggagauaaacgacauucuuuacaugucuggugauuucuaggcacauaaaaacaggaggaaauuguuaucuucuuuuuaaggguacuccugagauaagagaacauuaucuugacucuaaaaaagacguagaccgucaucugaaaucggccugugagcaguuuauucagcagcagaccaagcuguuuguagaacagcuggaggaguucaugacaaagguauagaccuuggugccuaugugguaaagucauuuugcauucuuccuuagauuuccuuuugaauuacucucuuguguaaacucuggcagaaggagauauuaagcccaagucuuaaugauucugucuaggaaaucacuguguuuccuauuauggaagcuuucugguuuauggacuuuuagauaugcuugcacaguuuuuguuuuuaagaggaagagucgaaauauugcaaagcuaguuauagcugaccccugguuagcuguguucuguuuauccgccuuguagguuaucugcaugugggcugggacucucacuuucuccuggaccugcauggcagcaaccacaguccugggaaucaggguuuccuauucuuaaaaugggugauuuguuuuccucuuuguuuuacaugccguuuuucucuuccauuuugcauggauaauugagaacugaagacuuuuauaacauagcauuguuaacugucagauauauggauuuaauguacagucaguccuccuucacauugguggucucuuccuggaaacugugacuuuaagugaaacaacauaaaaugaaaccaauuuuuuuuuccucaucaacaguauaaugaaacaauguugaacguugaaggaacgacuuuauuugaggacaugcugugcgucauuucacuuaaagucacaguuuucaggaaccuauugcugauauuaagugaggacugacuauauguguggauaguauauucucucugucucucugucuucuaaucuaaaauccauuaacuggcaaaugccagcaaagagaaaagcagaucauggcuauuuugacauucuuguuucaaccuaaucauuuaaaaaaaaucuaagugucauuacuaaggacuuaaagauauuuaagaagucuugaaauuaggcuggguguguuggcucacaccuauaauccuagcacuuugggaggcugaaacaggaggaucgcucgagcccccagaguuugacacugguuaacaguccuggguaacauagugagaccuagucgcuacaaaaaacgaacaaaauuagccauguguaguggcgugugccuauagucccagguacuugggaggcugaggugggaagauugcuugagcugggaagucgagggugcagugagucaagaucauccuacugcaguccagccugggugacagagugagacugucucaaaaaaaaaauaaaaauaaaaauaaaaauaaaaaaagagaaagaaagaaaacgucuugaaauuuuuauuuauuaagccgcuacuguuuaccccagacuuguaucagaggacaucauaaaaagaauaaaaauaugauggcucuuauuuucaaauuugacuagucuuaacuggacagacaggauauauguaugaaauaacaaggagacagcuaugcaauuguucauuagaaacuucuuguuggauccaucaacgcuaauaugccugaagccugugguaaagacagaaaauacgaguuuuaaaaaauaauuaaaaaggccaaaaaugcauagaaauguuaaaguacucuuuuguuuaucacuggcauauauugcuuguuaaguggauuuuauuccgaguauuugcaaugugugcauaugcauuuuuuucccaccacaaaagccauaaaaaaggagggggauagaaaugcuuucuccuagguuuugauuuuuuaaaaaagguuugaguauugguacuuuguaauuuacagauaacuuacaguuuuuacugaaacuacccuugugaaaaacaagcugguagauuguaguguauauuucugggagaacauccacaguaguacuggugggaaguauuauagaugaauauuguacaauaacagaacagcagaaugaaucuucugaaauaagcaaguugauuauaaugaaauccaggauuaaagguuguucuagaacagcacaguuuuucuagaaaucaagagaauaaaaauuuacacgugcccauagucuuagcuacucuggaugucugaggugggaggauggcugagcccaguaguuagagaccagcuugggcagcauagcaagacucugucucaaaacauuuuuuuuuugaaaaaggaaauagagguuuauguagaaaauauuccaagucugaauuauguaaugguucuccauggacaugcuacaugcguauagcagggaucccugaacaaauguucauggaccuguuuuuauauucccuucguaaugggauugggaagggaaaggccuugccucucauccccauuagaagccagucucauccuacgugaucagucucugcugcccuugcucagaccacuuguaguugccucccuuuuccucugucaacccugggcccucacugcugcucacugaguuucuacugaguggacacugcagccuggaggacugagcuucccuuuuauggugucauauuccagauucaguucccuuucauccuguggcauagagugagucagagacaaagauacauacgugcacacacacacacacacacacacacgcaaccauuucagacacugcaucuuaaaauuuguggaccaaagauuuuucacuuuuuaccuagugacuguuacuagcauucugaauagcagagaaacaggaagauuuuauagaaaacuuuaaaaugauuuucuuuaaagguaaaccucagcauuaauuaccugcaagugcagaaucucaugccucuuuuauuuaguuagcuuuuuuuuuuuuuuuuuuuugagacagucuugcucuguuaccugggcuggagugcaguggcacgaucucggcucacugcaaccucugccucccggguccaagcaauucuuuugccucugccuccugaguagcugagauuacaggugugugccaccgugccuggcuaauauuuauguauuuuuuguagagacgggguuucaccauguugaccaggcuggucucaaacucuuggccucaagggaucugcucuccucggccacccaaagugcugagauaacaggcaggagccacugugccuggccuuaguuagcauuuuauaaugcuugucccuugauaaacgguugcaggaaaaucaacacccauagguacagaugggaaagucuuucaucucauuuggauguguguuuguaggucucgguauuuaucauuuggguguaaggcucaucaacaaaauguccucagcuuguuucuaaguuuggacugauuuuuaacaauauagauguauuaccguguagagaauauuuuuagauugucagagacuuguuuuugagcuuaaagaguuggggucugauuuggaucccuuucaucuacuguaaauuggccuuguuguuuauguagcuucuuccucugugcuccuuguugagacacuuuguaugcauuaauucuuacuacaucccuggaaccuggaguaagagaagcaucuuuauuugacagguugagaaauggguugaguauucaugagauaagcauuucuacaacaucuucaccugucugguuucuguuuaauaccugauuuuugguauaauuauugaucuuuccugagaaaaaauaaaauaaguacuagaagaguguauaugcucuguugccucauuuccugccccuggaaaaauaaccucuaaguauuuggccugagggaauguaaugcuauucuaaggcuuaggaguagaggcucauaugaaaacauuuggcuuagauuauuuucuaccaaacuucaaaaaguguugauacuuuuuuaucguucuagaauuccauuguacuaaauguugcuugaaacaaacucuuaaguaggacuugggaugguagugguuauaguagaaagcaagaacuuugugucaaggcagcugagcccuagauccugcaacugcgucugccaccuucugacugaaguuaagguuaucaggagagaaaacaagaucauauguguaucuguaaagugcuugcugcagaaauguuauuuuguaguacaguuugacaaauuugaggugaagauuuugcuuuagcacaaagucuaaauuaaggcauuuuaaaggaaguauaauuccagguuuguagcuaagcuuaaaaguguuuuuuuuuuuuuucugaugggaccaauuuaugcuaaaaacucagacuuauauauagaaaauauucauuuucuuucaaguaauuugauuauuacgaguuuauucuuaauauucccucugaaguguuguuaauuucuucaguaacacuauaaacuuaaauuuuuuuucuugaucuagugcauguaauggaguuugaucuguaaguuuaauuccugcucucaaggagguauaaccuaaagggaaauuaagauagaaaaauagguaaacaugaaacuguauacagcaauguuauugugagacgaugggucuuuguucauuguguaggaauuuuuaaaaagauggggcuucacuugacuagccuuaaaaaaaugaggcugauuggggaaaacuuuugaagcaaaugcucuuugagguuugacuuaaagauaaguaaacuaucuggauaguaaauagagauuaauauacuaguuuauauuuguuuuuaacauaaaaauacuugugcgaaaccuaaaucuauguuaugaaauugguuaaauucuggagcaaucagugcaacaguaggcagccauuacuauuaaaacaaaacuguuggauaugggaaaaugaccagaauguagauuuaguggggaaaaaaguucacagaacacuguucccagauuuguaaauguauacacauuaguauauuuauauuuuuacaacggaaaauauuuuggauaacauacacuaaaaugugaauguauuuuucuuuuagcagugucuaguaucuauaauauauaugauucauuuuuuaaagugcaccucaaaaaauaaagauaugaagagggauggagugagaggaggaaagaggugauuuuauacagguaggcaguaugagcaaaggccuagagugguccaggaggagaaauagaaacuagaaauaaaggggaggcugaagagauccaagucaacauuauacccugugucugcccauuauacccugugucugccuaaauguuuguauggccuuuugucugagaaaucuagagcuguugcucgggcuuuucuaaugagacuuucccgugaggccaaagccauggacugcaccuuuggcacaugacugucuauuuuaaaacacguuuuaugcaguuucucucucuuacccuccccagcuaccccauagcuccaccacagcuuacugucuuagaaacagucuuguucaagcagcuaagugcccuuuuuuggauccacuucucuauacugcugcuaaggaaugaaaagagaugacuagaagauggucauucaggucuaucuuuagcacugauuggucagucauaugugacuuuuugaugguauuugaaaaucuuauuuguuuguuuuaaugacauucucucugccugugauauaagaaaaaugauccuccauauguaaaggagauuuuauccagcuagggugacauuuuucuaauuacauacaaaaauaauuuaauauugacguaacaguccccuuaagagacaccuguuuuguguugacauuucucuagggcuucauuuuugucuuccuagugggaaguauuucagauagaaugccucaggacuuagguaugauuuuuagcaagauaaccauaugccuugaaaucacaaaagaaguuuuacuaaaaacguugauuacuuguaaaggauuaugagauaaugcauuuuuuuuagggcugcacauuugauuaucauuguguuuuaauagguuuaaaugguguuguguaucccuugagagcaguaccacccuugagagcaguaccaguuuaauuugucauugaugaaaugaaacuuuuuuucuuuuugucuccucuauuagguuucagcguuaaaaacaauggccagucagggaggccccaaguauacucucucacagcagccuugggcacaaccagguauucugauuugaccauuuuggauuucuuuuuuaggauguuauuaguuugcauuuauauaguccuuacugugacagcuuggaguugguuuccuauucacucuggggugcugcaaucugaguuaaugcaggauucaauuuggagcugacaggucuuaauugguuagcacuacuugcauuucagcaagcauuccaaggaaggaagaauuuuuuuuuuuuuaaaucacccaguuaaaaauaaaauauggcuaagauggaaacccuuugagucuguugauuucuguacacccacuauucauuguguucaagcuuugaugaaaauacugugguugauaggaagaaauuauggcgaguguacccacuuucaaguguaugaagaaauguugggccacuauuuuguuccacauuuuguccaaguuauccucuguugacauuuuagaguauugggaaaaaaaauuguaaaaauugaggcgucaguugggaguuggcaggcaauacuauugucugauuggcagauguauuugagauguucccagucuuacucuuucuuaaauguaaauuuuuuugugcuggagggcuuuggguuuuuuuuuuuuuuuuuuggucuuuagcguuagacauuuaaaaucaugacuaacuuugugaguuauuuuugguaccucuugcggcauuuuaaauugccauuaaaccagaauaaaucauuuuguuaaauugauauuucuggccauucucuagccaauauugugauagccuuugaaacuaaaaugggcaaaaugaugaaagaaugaguguuuuaauuauggguaagcuguguccaaguuggagggcagcuuuccacucagugagagagauccaaaaaaugauucuggcuuugcauccaugaaaaauuggcaugcacagucaccuaaucuggaaucaacuuuuuaauaugauugguuuuccauauugaaagagcauuauaucuguuagguauucauuuucuuugggaaaaaggauugaagcuauucaaagccuccaaaauuuuaauuuuuuuuuuuuuuuuuuuuuuuuuuuuuugagauggagucuugcucuguugcccaggcuggagugcaguggcgugaucucggcucacugcaaccaccuccuggauuuaaccaauucuccugccucagccucccaaguagcugggauuacaggcaccugccaccaugcccagcuaauuguuguauuuuuaguagagacgggguuuuaccauguuggccaggcuggucucaaacuccugaccucaggcgauccgcccaccucgaccucccaaaaugcugggauuacaggccugagccaccaugccuggccucaaaauuuuuaauuaugaaugccuuagguuaacuugaaguugaacugagaaauuagaagaauagcuauguaucacuuaggaagauuuguaaauguagagaaugucaguugucuuugaaaggaagauaggauuuuauuucaaagguuccucaggugaacuuugaugaugucaauauagguuugaguucauuuguuugacugcaaauaaacuuugugacauacuuuagguguuucguuuaccaugaugcagacaaggaacguucuauugucuuuauuauuuuaaacguucguugugaaauacguugugaaaaacguugugugugaaauagaaaucuuugacaucuuacuacaaaagcacacuuaauacaguaguacauucugucagaagacagaaaaucaggaucuuuuaccgacaauacuggaaauucuaaucauagucugacauaguauuaaccaccucuucugauuccucacagucaagaggcagacuuaucaguucacaacucagcauacuucuugaaggaauucugaugauuuggggauuaauuggagccuuugacucaagguuccaauugcuuuuauagggcuuaguuagaaauaggagcugauuuuuauuuugaacauuuauguaaaugaaacucuuggguaugauaaaucuuucuuaagauuuaaagguagaaaccaguacagcuaagcccagugucuugaugcauaauuaacguauugcucuuuccccuuuggaaagauccucucucucaaaauagggacugucauuuucucaaguggaacccuaauaggauucaaaguguuagauguauugugcucuuaagcauuacuagaauuuagaauugucauaguaaagcaggaguagauaaaaggaaacuggcaggaguagacaaaaggacagauugaaguaggacuugcugcuuugucauuuaacccaguuccuucuuucuuagugaggagaucuuagugaauauagcaaugacaguucaguuuaucuuguaguuguaucuucuaucccauuuaggcauagcagagguguggaguugguuuuugugaaucuguaguacuugaagcccacacuugaaugccaaagagagauuuauggccccuuggggugggagcauugaggacaaucuaggaacugucuugggccucucugcucuaaaaacugaggguuacugguucauucagacuuggucaaguucucagggaucauuucaugaucaaacaaacucacaggagagugaguuauaaauuaggaugcccauuuguuaauuuacucugacgaagaaaccuuuuuuaggaauuagaggacacuuuagucaccagccugugcacccacucucugcuuaucaagggcucugaagaccgauuuagugaucccugagguguguuaguaaugauagaaccagggcccauggaaguaagggucuugaaggagcuuucauguauuaaugaaaaauaagcaguuccugaauuauuuauucuuucuuccugagaaugucagcggcauuugaaccagagcaacuccaucucgagagagagcuaggaaaaauggggaugggauuugcugggcugcauucccaggagguuagguauuccuagccucuagauguuuacauuuaaugaaacagauuaguaauguuuacuaaacacacccaggcccaggaauguccugauauccugauaucuugagaacaaaagcauuccuaauuuugcuuuaaagauaauaauauugauucuugcaaaauauaguaauuaaaaaaaauuaacccuuuaucacaagccuuuguagcagaguacauauccccaugauguuuuuuguuauccuauauauaaacaagcauugaucuagggugggcacguuacuccucuuacuuuugggaacacccuacugucuacggaguaccuacucuuucaccacuuuacuuuuuuaacaaacuugcuuuugcuuuauacuguggacucgccuguauucuuucuuggaugagauccaagaacccucucuuggggucuggaucaggaccccuuuccaguagcaagagcauugguacuuucuuacccugcuuuacuacaacccuccucaauuaaaacauuguuuuuuacaugguauauuauuugaacuaugaaaagcuauaaaaugaaaaguaauuauauuuucuaccuccaaacuaguccuucuuucagaggcaacuacuauuaaaguuuccuucccaaaauuguuuauguguuuacuagcacauguggacuuuaaaaauguuacccaaaugagauuguacuauaccccuugcuauuucacuucuuauauaucuuagaggccuuucuguauagcauauccaacuugauccauucuauuuauuggaugcaucgaauacaucacuauagcaugauuucuuuuguaauucuuguaauggaaaccuaaauuauuugcaguuuuuguuuuuccuuauacucuuaacaugucuguauacucauaucuugguauuuuuuuaguauaucugcaaguaaauuucuagcaguggaaaugcuaaaggaaaaaguaucugcauuuucaguuuugcuagauagcgccuaauauuuuuccaaagagaugaaccaucuuguacuuccaucagcaguacacaaagaugccuguuucuccauacccucgucaaacauggauaucacaaucuuaguaauuuuugccaaucaucuguaaauaucucacugcuuucauuuacauuuauuuaugagugagguugagcaucuuugaaauuguuaauagucuuuuuucuuuguaguuuucuagauaacuucuuuuaaauacuuccuacagauuacuacucuccuuuucuauguaacuccuucagacaugacacuuggguuucauaguuauuuuuguuauaacuuuuugggauucuguuccccuucugauaauacaguauaagaauauaacaaauagauauuuaauuccccuuaaauauguguggauauuuucugaauggucuaagcaucucuuacugugagucauuucugcaaaugaacaaacucauucauuaugaaguaauucuuacuagugucucucugaaaaugacuuuuuuuuuuuuaacuuuaaucucuuaccuccaaauuccaaagguacauauuacagcucuuaugaauguccugaagcaugcuaggggaguuauuuugcugccuuagcccuugggauuagaauuuuguauaguagauauuuaaugaauguuuauagggcuuaugauuaaacuugguaaauaagcuauaaaaaugaaagaaauucuuuggggaaauaaagagucuuuucuucugcuauuuuuuucucccuuuauuccccuuugaauuaaaauggaaauauuucuuuucuuuuucuuuaugacacuaaugagguuacuuuauuuccagcaaaggucaaugaccuugcggcaacugcauauaagacaauaaaaacaaagcugccugugacauugagaaguauguccuuguaccuauccaauaaagauaccgaguucaucuuguuuaaaccugugagggugaguaucagauaacucauuugaauguuggcgggugacuucaaguauucuuugccucauuuaccauuuuccuuuugcuguagacauuuagaaauguugguauacuguucuagugaaguugaauaaucacuaugauucaugaaaggcuuacaaagucugccucugucuugauuaucuuuuuuucccacugucacuuugucuuaaguuuuuaauguuacuacugaaaguagaaauuaguaaauaaaccaaaaaaaaucagacccuuacauugcauguggcccagcucucaagagagcagcacuucaggaauuaugccccauuuuacuggugaguaguagaaauaaauggcuugcaguggcaaccaagggauuaaaugucagagcaaauuuagggcucauaauuuccagcucuguguugagcucuuguucuuacccaaggcauggguugauuuuuaaaguauauuuuaugugucuaggaacuuuguuaucuuuuguguaagaaauugcugcagaagacccuuaaaauuauucucuggggggacaaggcucgcuagaguuuagucuuccugggaagcauuaucugauaagucuucaucaggucaugccagcacugaaauauuaagagcaaauuaugcgucuuugguaauaucaugaaagauacaucgcuuccacucgcuuuggcaaauaucauuacaauuuaacauucauggugcuucguguuuaagacaacucauuugauaagaucuccucuccuccuuucuaagaauaauauucagcaagucuuccagaaguuccacgcucuguuaaaggaagaguucagcccugaagacauccagaucauugccuguccaucuauggaacagguaauggguagacugaagauccuuauuacuuuuaugcccucuugguuauuucaccugaguagauaaugucuuugagcaaacauauuuuuaguauuaauuuaaaaaauauuaccuucuuuuauucugaugaguaagaauucagccuuugaauuguucucucaaacuuuugggggauaguuuuagaauuuucaguuaaucucaggauuaaaauucuguuuaauccuuucugauaugaauauugcuguguuuaagagaaugaccuguuuguaaaagacucaaauaguggcauuuagcuugcugaauaauuuuguuugaaauaugcauaauaagagaaauacauuuuuuaaaaaaauuuuugauuuuucuguagguuacugggguacaggugguauuuggcuacacgaguaaguucuucaguggugauuugcaagauuuuggugcacccaucacccgagcaguauacacugcacccuauuuguaguuuuuuaauaacuucaagauugaaaacauggaaguuacugaguacccaguauguauuaggaguagccuggcgcuguggaggauauuuuauaucuggucuuaaguuuaggauaguuuagaaauuuaguauaugguaaggacuaggaaaucuggggagacugaucaggcuggcaagagccugacugggcuggguagaaacugggugaauaggacuaggcaauggugaguguagauaaaucuuguguuuuuguuuuguuuuguuuuguuuugaaauggagucuuuguugcccaggcuggaguucaguggugugaucucggcucacugcaaccucugccucccagguucaugcaauucuugugccucagccuccuaaauagcuaggacuacaggugccugccaccaugccgagcuaauuuuuguauuugguagacagaggguuucaccauguuggccaggcuggucuugaacuccuggccucaagugaucugccggccucagcuuccuaaagugcugggauuacagucgagccaccauacccagccagaaucuuuugaggaguguuacuguaguggagaggagaaagauggggugguagccggagggagaaauggggucauuuuaaaauugagauguucauauacuauagaauucaucuuuuuaaagugcagaguucaaugguuuuuaguauauucagaaaguugugcaguccucaccacuaucuaauuagaacauuuucauuacuccccagaaaaaccccuuagccauuagcagauccugcauuuccccgucuucuuuuugucucuguggauuugccuauucuggauauuucauuaaauggaaucauacaauauguggccucauaucgcugcuuguuucauucaccuagcauguuuucaaggcucauccguguuguauguaucagagcuuccuuuuuauggcuguauauauuccuuuauguggauagaugggucacauuuuaaaaagauauuuguaucauucuaggauauuuguacagucaaaauacuuccaaauaauuuauuugaaguaauuacuuucuauaugauuguaccacuaacucgauauauaauuggguuucuuuucaauauuuagagauuuuuuuucuauuuugauuuaauuuuguuucuuaaugauauaaaauacuugcaugguuuccaagucagaauuacagaacaaggugcauuuggagaagucuuguuccuuuuccgauccccuccagccuuucccuucccuccccuauaguuaacucuuuuuauuaguuauuggguuauccuuccauuguuuuuuuuuuuuuuuuuuuuuuuuuuugaguuggagucucgcucugucacccaggcuggagugcaguggcgugaucucggcucacugcaagcuccgccucccggguucaugccauucuccugccucagccucccaaguagcugggacuacaggccccgccaauuuuuuuuauauuuuuaguagagacgggguuucaccguguuagccaggauggucucgaucugcugaccgcgugauccacccgccucagccucccaaagugcugggauuacaggcgugagccaccgugccuggccacauuuuuccguaggguaacuuguuuuuuuuuaaagauaggagaaaaacgcguguuuuuguguucaugggggaagaucuacaaggaggggaaaauaucuugacaauguggguggaauuucaggaacaggcaggguggggccuuugugagacacacggggguucagucaugguaacaggaggaggccgaguguaugggcauggaugggggcugugaauguggcgggagcucauggaugugcucuucugagugcuucacguuucugagugaaauaagaagcaaggucaucaccgagagggaggagacaggcucgggugaguuuaguggauaugaauccaagagagaccauucaacuuaguugucuauuuuuuuuuucuccaguuauagucacuugcaugaauguagauguggaguacuugaucauaagauccauuuuauggcagaagacauuauuuuuguaaguuuaguuuguuauaaauucaaacuuacagaaaaggugcaagaauaguguaaggagugcccauauauccuuuaccccauuuucauuuugccccauuugcuucauuuuucucauuuuuucccuucccugucccugaagccccgcuuuuaaauaauuggagagaaaguugggagacauugugcuccuguacugcuaaauacuucagaguguauuccugagaacaaggaaauucucucacuacuccuguauaguuaccaaaacaggaaacuuaacauugauacuagugucuaauucacaguucauacacacauuucaucagagucccgguaccguuccugcugaucuucuugcugacauuuccccaguccagguccagucccaggucaugcauugcugucaggugucaugucucuuuagcuucuuuuaaccuggagcaguuagacagccuuucuugaccuugacaggccaguuauuccgcagacugucucuccauuugguguugucucuuucaucaugauuacauuuaggcuuuguacuuuggcagggaaagcacagaggugauucuguaucccucuucugacagcacucauuuauaaaugacaucggggugaugaucugcaucagcaaaacagcuguacugauagaaugguucacagccagguccauuuacccacaagguuccagggccugggugucagacaccuggagugcaggcagccauuucccuccuaucacuacugugacccggcucuggugucccaguccuccguuacagagcgggcagguugcuccugcaguuggucagaauuggcaugugaguugaaauucacuugucaugucuguucuugugcguuuuaaaaagucacuuaaaggacagcuuacaacucuuccaacaacacacugcauagaacaaggcacaguggauuauggagguauguuucuguccuugucaguguuuguauauaguuuuugccauuauucucauuggauuuuaagugauuugauggccuagguuuggugaugaagugugaccccugacagggccucccaaugccagugcccaguggcugccucagaaauagaccaacauugugggccaguuucuacuuuauagccauguuuacuggucucauaaaaaucuuggucuuuuucucucauucuguuuuuggggcucuaaacaacuuuuuuuuuuuccauucuaauugcuuuauuuuauuuuucaacuuuuauuuuagauucaagggguacauacaugcagguuuguuaccuggcuguauugcaugaugcugagguuuuucaacccuugugguuccccucccuccuugacuuuucuugaggacgguauuccauaggagaacuaacauagcucuuaauuuugcuuuucagcugagccuucugcuguugguuucuaaauaagcaggccagccgggcugugcaccuaaaugucugucugggaggagcaggcugagaagucuugcagucugcaggacaccgaggaaucguaugugggaacguccccgagaaccacacgagcgugcugcucagugcugacugcagaaugaaauagaagcaaaguguuacaggaucaguguuuucuuuucuaaaacaucaaaaugccaaagauuaaucugugauuggugauaacugccucguuuaaauggucacaagaaaugugaagagagagcuagggcagacaugcagugaaaugguucuuuguuaaaaaugugcaauaaaaauagauuacaauaaguagugcaaagaacuuuacagaaaucaagcgaauuagaaggccuguaagaguaagguuugcuaaaacgugaaacacuguaacacuuuuaaccacugagcauuccacagugaaauguuauuucuaugcucuuauuuaauguaauguuucuccugucauuuuugaaguugaguuuggaguagauugguugcuucugagaacacauucugccuuccugggaagucggggugucauccuuuccucuguuugaugugagguaguuuaaagauacaaggacuuugugugaagcuccagcaucugugccccuugaauugcuuaggugcagacaguucuaaagcaaggagcugcagcauucucaucauagauacgugcaguaucuuuaaugaguaucuucaugguaugauaguguguguuugugagugcgaaguaccaauuaaggugucuuaaauuuggcgcauagaggagagaaggaaaccugaggaguaguguuccuccugaaugaagguucaggucaccagccuucuguacacugccuuugguuuuagcaguucuuugaaaagcaaacacuuucauguccugucuauucauucagcuggcugugcugugcuguggaccagcuguguggaucucuagcccagcuacagcagaauacauuuuaccagcaaaccuaaggaugacaaacacuauccacaucugaaaacuaccacaccauaucagggaucauaaauuaugcauaucuaugaauuuuccaacaaauuccuacuuccugauuggauugguuuugccgcugauguuaaggcagccagcuucuuaguucaaaaagaauucugaguuuuucaaacacuagucuagagguggacauugucagggguucuggaaugggaccaggggaccuuuuggugcagugggugccuguaacucauuagacguacugaggcagcacuucugcagggugcauacccugauuguugucauuuguaacaggucacuuccuuuucacucaguuuaaauuggugauggacguugcuugauugagcuuauuacucucuauuuugagaagguagaagguaagagggcccauauucauucuuugccaugaaaugaaugaauuaggaagauuguauuuacuuaacuguuuuuuaaauacauguuuaaugaaauaaacuguaaaauauccaguuuuguguauuauauguacauuugauuuuuaauagccuuuccaaagaaaugagggcaugauuauuguacaguaaguacgugacugauuuaauuugauuuacagagcggaguguguucuuauaaaaauauuuaaugacauugguucuugucuuuugaucuuuuauuucugaaacacucaaacaccuuacaaagugcugaguagguaauagugacccaacuuguuugcuaaaugauuauuuguuuaaaucuguacaguuuuaaguguucacuuauacaaagaguguauauacuuucaaauaauuuaaaaugcuuuauauuauuuggcuagaaauugcuguuuuuaauaaaugugaauuuuuuaaaaauaaagauuuuugcuuccuaccuuguccucacgugucugauacgugugugcauuccuugaggaaaauuucuuuaauuaaaauuuuaauugaga

SEQ ID NO: 192515 - RNA, 25063 nt, Homo sapiens
auuuuuuccuuuucuccagcggccucagguucuuguuacaacugaguccggguuggaggagguguggggccgcugccgccagguaaguccuggcccgugccuccuccugccggccccgcuuucucugcggcuccuggaacccgggccugggguaagguugggcugcgauuuccgaggagccuccuuugcaaccgggcgugcucggggcugccugugcucuccacuucgcaggccgggccgggcucggcggggcgcgagguuccggggacuggggacagggcucugcuucucgggcugcugccuccuugggucgggccggugccgcggggcccccaucgcuguuggcguggggugauuccuguuccagggucauucagauccgagugcgaagcccguccuggcaucuccgcgucugcuaacgagccccgggcuugcaacccugcuugugcgucccucccacucgugcguucauucaaacggcagccugagcgcccgcgagcuucgcacugugggagagggcacaccacauucggaaucgcucguggcacacaggcugggaggaacuugccuggaaaguuaauguaccucuggguuuugaagucuuucuaggugcacuuucauguaaagcaguugcagugauuagcauuuuuguucugcgcaagaguagcaaacaauguuggcacugcccugcggauucggcuugcggugcuacuuggguagugagaaaguugaaaggcaugaaucuugcuuuuggcuuugccguugcgaagcuuugugaccgcgggcucaguuaauuaacgugaaacgagaugauaauuucgaagauuucuuuuaaacccggcuuuuuguaagucugugaugagcuuaguuuuccuucugcaccuuuaaaaagaauaggaaauaggaaaaguucaugaaagggcauuauugaaagggcagucgguccagcaaggaacaauaaauguaugagagcacauuaaaggcugugcaauuacaguuuuaagacuuaagacuaaaaagggaacaggaaguaaaacugaaagaacuuaccaagaauuaaauaagagaaacggcugggagcgguggcucaggccuguaaucccagcacuuugggaggccgaggcgggcggaucaccugaggucaggaguucgagaccagccuggccaacauggagaaacuccgucucuacuaaaaauacaaaauuagccgggcguggugacggaugucuaauucuagcuacucgggagguugagacaggagaaucgcuugaauccaggagacggagguugcagugagccgagaucaugcuauuguacuccagccugggcaauaagaacaaaacuccgccucuaaauaaauaaauaagagaaacuuggaaagcguucaaaaguacgaacagcuaguauuauauuuaauuaccucccuuuacagcuguacacaugaggucaggugggugaaaauaaauacuaagcaaccauguaagagaaaauguagacaggauguguaacuuagcauauauccuaaguguagggagaauccuuugaaauucuuaauuuguauagacaauuucauucagaaaacuuguuuuuaaccuuuauuuauuauuugggacagggucuugcucugucacccaggcugcuagagugcagugucauggucuuagcucacugcagccuugaaguccugggcuuaugugccccuuccaccucagccugcggaguagcugggacuagagucgcguaccaccauaccuagauaauguuuuggauuuuuuuaguauagguggucgucucauucuguugcccaggcuggucuugaaccccuggccucaagcuauucuccagccucagccucccaaguagcugggauuacagguaugugugacuagcccagcuaacauuuuuguuguuguuuuuuuacuuuguauuuuucacuuuuuuuuguauuuauuuauauauuuauuuauuuauuugagauggaguuuugcuuuuguugcccaggccggggugcaguggugcggucucagcuuacugcaaccuccgcuucccagguucaggcaguucucuugccucagccucccgaauagcuagaauuacaggcgcccaccacuaugccuggcuaauuuuuguauuuuuaauagagacaggauuucaccguguuggccaggcuggucucgaacuccugacgucaggugauccacccgccucggccucccaaagugcuaggauuacaggcaugagccaccgugcccggccuguuuuguuuuuaacuuuaaaaaauuuggaccgggcgccgugguucaugccuauaaucccagcacuuugggagucggaggcaggcagaucacaaggucaggaguucgagaccagccuaaccaacauggugaaaccccaucucuaccaaaaauacaaaaauuagcuggacgugguggcacgugccuguaaucccaguuacucaggaggaugaggcaggagaauugcuugaaccugggaggcagagguugcagugagcugagauagcaccaccgcacuccagccugggugaaagagcgagacucagucucaaaaaaaaaaaaaaaaaaaaauuauucagccaggcaccaacagcuuucuuucuuuuuuuuuuuuuugugauggagucucgcucugucacccaggccacagugcaguggcgccaucuuggcucacugcaaccucugccucccggguucaaagcuauucuccugccucagcgucccgaguaacugggauuacaggcaucugccaccaugcccagcuaauuuuuguauuuuuaguagagaccggguuucaccauguuggccuggcuggucucgaacuccugaccucaagugauccacccuccuccaccuuccaaaguguugggauuacaggcuugagccaccacacccggccaacagcuaacauuuuuaaaaauaaaauuuuuuauuuccucugcuggaaaauucuauauuuauucugaauguauagaauucccugcccugccccccaccaauauuuuuuuaacagcccuuggaagauagugucugcaaaguacuaucuagaggaagggucaugugauccuucagagaaaccuuaguuugaauauuugguagcuuugaccagggaaaguuacuuuucuucucugaggcuguuugcuuaguugugagauguggauaaugauaccucuuucauaggacugugaagaaaauguauagcaaugccuaacagcagguauucagggaugacugcuaguguuaguauuauguucauaacgcagcaaggagaaguaaggaauuacuggguuuuagcauggcuuagagaacauggcuguaagaggacugucaaaucagaagugaucuacagccacugcccgacacuggaauuucugcaaaguuguaauuccuuccccgagaugcugcccagacacuauugacugcuaaggacacauuaaucucucuaacugucuuggcuugucagccuugggacuucuguagauccaguugggauuuuuccaaacaacuguguuuggaauucaaggaaguguuucacgagacuucccuucagaaagagcuccaaaacaaagaaauggguuaguuuacugaacagagauuucagccuaagauacuuauagcccugucacagcuugcuguggccaguacagcuuaguggacaucuacuuacuuauuccaguccuaacuagaaccguuuucguguguguguguguguguguguguguguguguguguauguguguguguguguuugagacaaaguuucgcuuuuguugcccaggcuggaaugcagugucaagaucuuggcucacugcaacuuccgccucccgguuucaagcgauucuucugccuccgccuccugaguagcuggaauuacaggcacccgccaccaugccuggcugaguuuuguauuuuuagcagagacuggguuuugccauguuggccagguggucuugaacuccugaccucaggugauccgcccaccucggccucccaaagugcugggauuacugacaugagccacugcgcccgcccccuuuuccuuauuuggauguuugcccauguacugcggcucucuaguucauauuuaagccaaauuauucuuuuacucagcaaacauuaacuugauaaguuccaguaauauuaacugcuuagggaucuaguccuaccuuuuggaaaggaagagaaaggccaaaaaguuguuuuuaccuccugacuagcuaacuuuuaaaaaucguaauugaauagaaguacuugcuuauaggaugcugauccaggaguggacacuaauuuguagaaaaguuuuauuggugguacuucugaaugaaugggcaugugauucaucccaugugauugaaaacuaugaagaagcaauuccaucacauuuuuagcucuaguuaaguauuugcauauuaguauuaacccagagccucuggauuuuaaccuaaccaacugaaaacuuaauaucaaaaccgacagaggaaaaaguagccaaaucucauuaaaacuuaacuagcuggccaggcacgguggcucaggccuauaaucccagcacuuugggaggccaaggcagguggauuaccugaggucaggaguucaagaccagccuggccaacauggcgaaauccugucucuauuaaaauacaaaauuagcuggguaugguggcccaugccugugaucccagcuacuugggaggcugaggcaggggaaucacuugaaccugggagguggagguugcagugagcugagauugagccauugcauuccagccugggggacaagagugggacuuugucucaaaaaaaaaaaaaaaagagauggagucugacucuguuggcuaggcuggucuugaacuccuaggcucaagccauccuuucaggaacuacagaugcgugccacuacaccuggcuuuguuuugcuuuuuaaucugcaaucagcuaggucuaagaauggguuaaggaaguuaguacugggugguaaaugaauuauuggauuuauuauuaauagguucuuacagucucuuacaaucuuaacuauuauaugaguuaugaauuuaauaaggcuaagaauuacuuaagugcaguuauuaaauauuuucaaagauaauagggagaugagaggagucuuuugggagagggcuugcuccuuaguacugaaauaccuaaaaacauacagugguuuucauguuucauucuuacagaaccuucuauuuuacucauuuguaacugcuaugaauuugguuaauauccauaaacaaggaauaaugauuaauagauuuauucaaggugcccgaugggggguccuaguguuggaaacugauauucugggcaguggugacuugugguaguccucuccugggaaaaggagacuugggaaauuccuaaacacaggcaaaguaaacauguuggcauauugcuugccaauaaugacugaaaaguuagaaauuuuauuuuaaaccaacaguagcuauaguugauaguauauauacaaaaguauuagucauaugagucuccuguuaaggggugugaggccacauuuaccagcucuaauuacauacaacugcagaacaugucaugaaugugaaaggccuuagcuguggcacauaaguacaugucacagugagcaaggucuuauuauggaaaaggaagauggagggcaauauuugugagugucuuuaaaauauauauggcuuaaugcccacaauaggccuacagcuugacauuuauuuaacuuagugaauaaaaguauggaugucccccuaauugguuguguugccugcuguggugaugaugguguuggcgaagaagaaaaccgagacucagguuagcaggaacuucucuaggaagggugugggguggcucugaccccagagucagccucuuuccucaugccaaacugccucacagcugguaacguaauaaggcuaagagaagugagccgauauuuauagaauguagacuacaaguagccugugguggcugggcauaguggcucucaccucuuuucccagcacuuugggaggcuagggcuggaagauuacuugaguccaggaguuagagaccagucuacaaaaaauaaaacaauuaggcuggcaugguggugugugccuguggucccagguaguugggaagcugaggugggaggaucacaugagcccaggagguugaggcuacggugagccauguuugugccacuacgcucuagucuuugugacagggugagacccugucuuaaaaaaaaaacaaaaaaagaaguagcuuguaauuuuaaguaauugucauuuuaccuuaugacacaaguuugcaacauuugucugcugcagugcaccugagggaugugauccccaccccacccccccacccccaguaaggacucacuaagauagcagugaacgaauagcaaauacuuuuuuuuuuuuuuuuuugacacaggguguuacuguguugcccaggcuggucuugaaauccuggguugaaacaauucuccuaccuuggccucucaaaaugcugggauuacaggcgugagccaucauggcugcugcaaauacuuauugcaugaagaauagauuuaagauaaaauagacuucccagagaacagcuuccgcugcacuacacugaauacauacacgcauaccaagguaucaaaguagcugauuacuucuugaggucacaguaaaaauuaagaucacugauaaaguaagauuggaaauuguugauuugagguugaggaaauaggggugcuuugcuuuauuaaggggaggcuccccuugggaauugcugcagggguuuuggugauagcacucuccaaauaaaaccuaggggaagaguuuggagaagaaacugccugugugagaaguuacagcuugauaauaucuuauuguuguguccaggaaaaacagcacuggaggcaauguuucuauaaaucaaagaagagacagugugagaaugucagcccucaacuggaagccguuuguguacggggggcuggccuccaucacugcugagugcgguaaggaccugagggugguggaucacguagccugcuguaugugaugguguuugaugugaauguaguucaaguguagaaugugagaugaugaaauguuugucucagaauucaaaaugucuguuagcugggugugguggcucacgccuauaaucucagcacuuuaguaggcugaggaaggggaaucucuugaguccaggaguucgacaccagccugggcaacagagugaaaccucaccucuauuaaaaaaaaaaaaauuagccaggugugguggcacaggccuguaguccccgcuacucgggaggcagaggugggaggauugcuugaguccaggaggucgaggcugcagugagccaugugugaaccacugcacucuccagccugggugacagagugagacccagucucaaaaaaaagaaaguuuucuuuugguaaugcuuuuuaagacaaaauagucauuuuggcugcuauuagcaguuuaggguucgaaguuuaguggagagaaaguugauccuauugaccaaacacaaguuuuuuaaaauuuuuuguuuugagacagggucugguucuguugcugaggcuggagugcagucgucugaucucggcucacuccagccuccgccucccgugcucaagcgguccucccacccgggucucccaaguaggugagacuacagaugugcaccaccaugcccggcuaauucuuguauuuuuauuagagauggaguuuugccauguugcccaggcuggucucgacucccaagcucaagagauccacuugccucggccucccagagugcugggauuauaggugagacuacagaugugcacgaccacgcccggcuaauucuuauauuuuuauuagagauggaguuuugccauguugcccaggcuggucucgacucccaagcucaagagauccaccucccuuggccucccaaaguacugggauuauuaccaugcucagccucaaacacaaguuuuaugaaucauuuuuggauugugucuguccguuuuccuuguccuuucccccagcuuugccacuguuaaccuguuuggcuguaaagagguuugagaagcucaaggguguucccugagccagaugagauggacuguaguuaucuagucacuuucugaugaugcacauuauccaguucccauuugugacuuccucaucgguuggguuccacaucagauccuguuuguuuauucucuggagucauucauucagcaaacacugauugagcagcuguugaaugcccugugcuggguuggggacacaucauugcuuccagggcucagucacugcuguccaaggauagaauacugccccugugggacuggggagaauugaggccaagguggguaagcuggaugagccgugguaaccacccacucaccagcuuaggcucucugugcuggugggcuuucccauugacacagugaaucaagguuacugucugaggauggguuuuauauauuuggguggacuauuuguuagguacaguauuuaacauauuuaucugcauuaucagauuuauuuuauuuuauuuuggagacagagucucacucugucacccugucuggaguauggugacgugaucucggcucacugcaaccucugccuccuggguucaagcaauucuccugccucagccuccugaguagcugggguuacaggugccugccaccacgcccagcuaauuuuuguauuuuuaguagagacgggguuucaccauguuggccagguugguuuggaacuccuaaccucaggugauccgcccaccucagccucccaaagugcugggauuacaggcaugagccacugugccuagccagauuaauuuuagacuauaaaacacucucccaaguggaaaaccacuuuagaaaaugaacuuuuuuuaccucuuuguucacauucaaccccauuuuaaccuucauuuauauacagaauaguaacuuauguuuuucaauggauuuccuguuuagguaaaucauaccacguauuugcuuucuacaacaaugcagccuacccaaauccuguguagaauaagaugagguauaaauaaaaagauaaagaaaggaaaauauaucuaugcauuuuuuggguuuuauuaaucuuuugauuccucaauuuuuaaaaauauaaacaagauugcaaagugccauuucuuaaucacuuucuuaguuuauauuguagucugaauguuuccucaguaauauaucacuacguauccuuuauuuaguggaauuucuuuuuauuaagugaauuucuuuuuaaauuuuaagguacauuuccaauugauuuaaccaagacacggcuccagauucaaggccagacgaaugaugcaaaauuuaaggaaauuagauaccgaggaauguugcacgcauuagugaggauaggcagagaagaagggcugaaagcacucuacucggggugaguaggccuucaugcauuucugugucacuguucacuguuucacauggguauagacuucagaccaagacugcacagaucacaaguaaaaaguuugagguguguuugaaaagaacaaauagcaugacagauuuuucacuuuuaauuucaacucuaauuucuaaguauauauauuaugcagcagauguuuuggugaaacuguuuuacuauauucaaguacagacagacaacaauaaaaaauuauguuuguuuaaaaacauucuguucgguuuuucaugcuuugaaaauagcucuuuuucuuagauauucugaauuaaggagguuuuugccauaaugaaaauuauaugauguugauaagaguugcagugaacuacuuuccagucuuucaguauuuaaugaacaguauucuguaggcacuggauagugagugagaccuauaucagaauaccugcaggaacagaacguggacagccucaugucacgcuaagcaucuugauuuucuccaguacaccacagcacaaacuggugacccacagcccugccauggauccaccaauccccagagguuuuuguuuuuuuaauugagccaauauuuuaaaaaugagaaauugcacauaaaaaucugggacuccaucuucuugagagaaaucaacauuaggcccacauucauucaguuaugacaguaguagcuggggugaaggauacugucucugguuuacaaaaccucugucacucacauaguauaugugugugcaguucgacccagccuggaucauucacucauggcaucugcuuucuugguaccugucagcauuugaguuugcuauaucuauggcagacagaagccacugaaaguguuuaaguaggaggauggaccugaucagcuuuacauuguaaacaucaccugccugccauggagagaaagaauuaagagacagggagcacuagaagcagggcugucauguaggaagacuagaugaggaucugaauugguuuuggggaugaggaaaaagaagacaggcuagaaaacuauuuaggguguaggacugauagcacuacgugaccuaauaugagguuuccauacaugaagcggguagaagggaaggaggagccaagacuaaugucucaauuggugguuuuugccaguguguagcuggagcuuccauguccugguuuaggaaacacaagaggagagaugacuguuuggagaaggaagagaaguaguucagugugggacccuaucugaagguauacacaggacaucuaaauggagaaucuuggaagauuggaaaugugucuuuggauccauguuggaagcauggauuuggagucaucagucuuuuauuuuauuuuucauuuauuuauuuugagacagggucuugcuuugucacccaggcuggagugcaguggcacaaaauggcuuacagcagccucuaccucccaggcucaagugauccucucauugcagcccccuacauagcuggaacuauaggcacaacaagccacugcaccuagcugcacacacacaaacacacacacacaauuuuuuuuuuuagauggcguuucacucgguugcccaggcucacugcaaccucugccucccagguucaagcaauucuccugccucagccucccgaguagcugggauuacaggcaccagcuaugacaaccggccaguuuuuuguauuuuuaguagagacgggguuuuaccauguugucuaggcuggucuuaaacuccugaccucaagugauccacccgucucggccucccaaagugcugggauuacaggugugagccaccgugucuggcgcuacuuuuauauuuuuuauagagaugggguuuugccauguuguccaggcuggucucaaacuccugaggugcagugaucugccugcccuggcuucccaaagugcugggauuacaggcaugagccaccgugccuggccagccuuuagauggcaguugaagccuugggaguaggugagcucacacagggaacauguacaguaaggagagaagaagcauaggauagauuucuggggaaccccagcagacacagguaggaugcuguagagaaaagaaaagaagucagagggggugaugcuacagcagaacagggaggagacagcuacaaguaggacaaaggguaaacaguggcacacacugcaaagagcuuauacaagauccuacuugaaaagccucauuuaacuuagcaacaaagaugucaguuggucaccuugaagaggggaguuuugagggugagggcagcagaaacccugauugcaauucaagaaggaaguggggaaaugcagaaagacacccggggaguguccaugccacaacgugguugugguuuggagaggauaauaggacaggcauaucggauggaggaaaguaggcuuguuuuuccugauucugucuugaacuucuucacuuacauuuucauugagaauaaauaugaggggcuaggcuuucacuuagugagcuaauaauuugcacaucuggacccaccuguguuuuuguuggauuuugaauuuuacgaaaucguuuuagaggccgggugcaguggcucaugccuguaaucccagcacuuugggaggccgaggccugaggucaggaguucaagaccagccugaccaacauggcgaaaccccgucucuacuaaaaauacaaaaauuagccaggugugguggcgggugcccguauucccagcuacucgggaggcugaggcagaagaaucgcuugaacccgggaggcagagguugcagugagcugagaucaagccauugcacuccagccugggugacagagcgaaacuccgucucaaaaaaaaaaaauuguuuuagagaauguaguuugauuauggauggcacucugcauguggguugccuagccgauguuaagugauuuuuagauugcuuuugucccuuuguacauugguuuaacaggauugcccccgcgauguuacgccaggcauccuauggcaccaucaagauaggcacuuaccagagcuugaagcgacuauucauugaacgcccagaaggugaguggggaaucuguuuuccacuguggacaggagguugguugucugucuuuuuauucaagugguuuuggagcagguuuucuucagcuuauuugugacuuuccuacugcuacaagaacucuggguguaaagucuuaguuaauugugcugaaagcaaguugguuaucaacucaauugaggggagaaauaaugaaaaggaaccaucucugcaaacauuuuaauuaguuguccccaucuccaaaaugccuagaccaggggauguguuguuacuauuccauccaacuuaaaauuugcuaaaaucauaugaauugucaucuauuuuucaggaaaacagugaauacauuucuuaauauuaacaacacugaaugcuaauacucuggcuuuuugguucuguggcuuuguuuugauccauagaacuguccaucuucaucucuuuucacaaugggaugaguaccagacacuauuauguaagaguggugaacaagagcuaagaugcuuuggaaauacuucaggauauuucaaacuaaauacauacgaugugcuuuaaaaacuuucugugccaaauaagucgucauguuaucucauaggaauuauuguccuaacagauauagcucaucuuaauuaugauggucugaauuuauacauaaaugugaacuggggcugggugcgguggcgcgugccuguaaucccagugcuuuggggaggcugaggcgggcagaucacuugagcccagaagcuccagaccagccucggcaacauggugaaacaccaucucuacaaaaaauacaaaauauuagccaggcguggaggugcacgccuauagucccagcuacuggggaggcugagaugggaggaucaccugaguccaggaggucgaggcugcagugagcugugauugugccacugcacuccagccuagguaacagagugagacccuaucucaagagaaaaaaaauaaaaucacauuuagauaucaauaaauuuugcaaagcaaaauuccuucauuagugaaauuucuaauccuuuuaaaauuacuugauucaugaaacauacuuuuauuuuuuugagauggcgucuuggucuguugcccaggcuggaguacaguggcguggucuugguucacugcaaccugcaccuucuguguucaagugauucuccugccucagccuccaaguagcugggauuacaggcagcugccaccauguccagcuaauuuuuguauuuuuaguagagacgggguuucaccauguuggccaggcuggucucaaacuccugaccucaagugaucuccccaccuugguaucccaaagugcugggauuacagaugugagcuaccaugcccggccugaagcauauguuuuuacaucuuaaggugaacaaguaauguguaaauaaguuagaccuauaguugaguuucucacgggaagaacucuaaauauguagagucaaauaaugugucauuguuuacagaugaaacucuaccgauaaaugugauauguggaauucugucuggagucauaucuucaaccauugcuaauccaacugauguuuugaaaguaagcugugcuaucuauaucuuauaggcacauuccacauuuucuuauugagaacaacauucggguaauggaaucugugaauguaacaucuguguauaugugaaucuguuuauaauuuaagugccaugaagacuaacuuuuaaagguccaugagguggguuuuccacuuauacagaugagcucaaaagcagagcucauuuuggagacaaagauuucggugauugaggagaaaaaauuauuuaggcuuggacugcauuucauuuucguuuuucacggaaaauguuccuuguuuuauugguucauuaaauauagauggacugcaaguuuugcacagaucuaggcugcucauuaaugacuauuuuugaauccaucuuuuuuuuuuuuuuuuuugagauggagucucacucugucgcccaggcuggagugcaguggcacgaugucaacucacugcaaccuccacccugcuggguucaagcgauucuccugccuuagccuccugaguagcugggauuacaggcaccugccaccgugccuagcuaauuuuuguauuuuuaguagagaugggguuucaccaucuuggccaggcuggucuugaacuccugaccucaugauccacccgccuuggccucccaaagugcugggauuacaggugugagccaccgugccuggccugcaucuucuuuguuaaauuuuauuucaggaaauacagaugaaaaaauuuaauuacuacaauuagauuacauaacacauuaggagaccuuauugaaaauacuagggauagagcaucuuuaaauccuuuuuuggaagcaacuaauuaaauaaaauaaaaauuaggaaugacuuacuuuuugaaccccacagaguauuccuuuccuacuuccccucuuuucuuuuucugccccacuauuuaacuaguauucuaugcuucuaucuuguaccaguugguauacgccaugguuagaauccaaauaugaguaagacaaggacccugcccucagagagccuucaaucuaauaggggauucugacaagcauuacagccaucugcaguauucuggguacacuacaguuauauaugcauuguagcaaagggaccucguggguaaggaagaaauacaagguaccuuugccauaaguuuaccaguguugggguaagagagcuagagaaaaauauucguacucucauuaauuucuuaauuauaucuuaggccuuaugggaaggcaguuccuguaucuugguuuauuuucccacguucguguggcaauaacaguucuuuuagaaguuagugguaacguauuugcucccuaaacaaaaauaagguacacauuuuguaguaaaaaaucuuucuucauucuuaaaaaugcaaagagcuacaucaaacauucuuuuuauguuggaaucuuggucauguggauuccacuaauuaaaguguaacagaguguaacagguaucauguggcugucacuuggcuagcucgccugcauaccuuuugguucagcuggcuggagacuguaguggcuuggagcagcuaauuuaagaacuaugcuugccugugcuucgugcugccagguacacuggauaacucauuaauuagauuaaaccuuugaaauuaacuuuucucucaccuauauaguaguagggaaguaugcuguuuucuauccuagaaagacuuuuuucacaaaaaucaguuucuccuuuugacauuuaaugaacugcuguacguaggacucuggacucucuuagaugcuuuuuggagaucucagaguuccuaagaauaaauuuuuauacguuuuagucauuuuaagguagcaucauagcaguauuuauaugacaguuuuuuccuugcuaaugguuauuaagcaacugacugacggacugacugucagagguauacauugguugugggugggauugugguaguuucuuucugauguuggucuuuaaaauaaucucuagauucggaugcaagcgcaaagcaacaccauucaaggaggaaugauaggcaacuucaugaacauuuaccagcaagaggggacaagaggacuguggaagguaagccagaaggauggaucgaacugauuuauuuaguucuuuuuuccuuuuuugaauuuacuuguucuaucacuuaauuuuaauccaagugucguaauggaguaagggaagaggaguggcaucuucugcccaugaaaauaucuuucuuuauuucccuaucuauaaaaugggaauauaaggaauaugucaugauuuuuuuuuuuuuuuuuuuuuuugagauggagucuugcccuguugcucaggcuggagugcaauggcacgaucuuggcucacugcaaccuccaccuccugaguucaagugauucuccugccucagccuccugaguaacugggauuacaggcgugcgccaccacaccccgcuaauuuuuguauuuuuaguagagaugggguuucaccauguuggucaggcuggucucgaacuccugaccucaggugaucugccugccucggccucccaaagugccgggauuacaguugugaggcauugcgccuggccuaugucaugauuuuuaaaguugcuuuugaauaauuuauguauaagauauugugugaaggauaagcacuuuuuuuguuguuguuuggucuuuugcucuuuuuuuuuuuuuaaauucuuauggagaaggauuuuagguuacaguuccauuggguguuuugauccauacaauuucauggcuuguaacugaagucuguguuauuaggcaagcaugugguguagaguguuauuuccuaguauucuaaugacuugucaguucauagaauagccccuaaagaucauccagugugaucucucaguucauagaaggaaacuggaggcucugagaggugacuuguccuggccaaagucuggcccaaggucauauaguuaaugccagcaucagaauuagacuucagaguuuuugaguucuugcucugugaucuuuuccgcucugucacucuacauuucugccuccccagaggaaaagauaaaccuugaucauaguuuauggauuagaaccuuugcacauuugcaaggcuuguucuacagaggcauaucagaaucauuuuuauuguuaauauuuuuacccagggugugucccuuacugcgcagagggcugcuauuguuguugguguggagcugccggucuaugacaucaccaagaagcaucuuauucucucaggccugaugggagacacuguguauacccacuuccuguauguucauggcuuuuuuuaaaaaauuauagaaauucuaaagaaaguuuauuauaaaaguauuauauucuuauauuugaaaaguugcaaugcagaagugaagcaggaccagguagaaguccuuauuccucuacauaggcagcuguuguuaacaguuugauauguaucuuccaggcguuuucuacguguaugcaaauaugucuacaaaaguguauuauaugaacuuuauuacacaaauaagaucauguuuuacauucuuuuauuugcuuuuuagaauguaacaacaggcugggcacaguaguucacgccuguaaucuuaggacuuuggaaggccgaggcaggaggaucacuugagccuaggaauucaagaccagcuugggcaacaaaaugaggccccauuucuacaaaaaauuaaaaaauuagcugggcaugguggugcauggcuauggucccagcaacaugggagacugaggcaggaggauugccugagcucaggaaggugaggcugcagugagccuugacugggcgacggaacccuagccugggcaacagagaaagacccugucucuaaaauaaaaugcgauuuaacaacauauuccaaauaucuuugagugcuuacagacuucgugucaguacuuacggacuuuauuuauuuauuuaugugagacggggucucacuguuacccaggcuggagugcaguggugugaucucggcucacugcaaccucuaccuccugggcucaagugauccuccugccucagccuuccaaguagcugggacugccggcgcaugccaccacacccgguuaauuuuuguauuuuuuguagagcugagguuuugccaugucacccaggcuggucuugaacuccuagacuuaagugauccacccgccucagccucccaaagugcugggauuacaggugucagccauugccggccuggccuucauuuauuuuuaauagcugcagauuaucacauuguauggauauaucauacauauauauuaucauucauauguguguguguguguguguguguguguguguguauauauauauauauauauaaucauacauaauccauuggugggcaauguguggagacuguucugauugucacaaccaggggggaauacuacugacaucuaguggggccaggccagggauauagcuagugcugagguugagaaacuuugcucuggguuaauugauauaaaguauggucugugguagucuugugggacugaaaauauagcagaaccuaagaccuuugcggggcauuauaguaaggagaucuuuuucuuugauaucuaggaaaugauauaauuaugauauggcuagaauuacucugauguccacuuacagguaaauagauggaaaagaucauccuuggaggauuuccuuuauguuuuaugauccuuugacauucuagaaugucagguauucuuagcugucgcugggauuuaucagcuaguauaaucggugcuaauauguaagcaguuuaucaagcucucuagauauggcucuucuugacauguuucauguugauacauguuaguucaacauaguuuuggggcugggcaugguggcucaugccuguaaucccagcacuuugggaggccgaggugggcagaucacuugaggucaagagucugagaucagccuggccaacauggcgaaaccccgucucuaauaaaaauacaaaaaaaauuagcuggaugugguagaguacaccugaaaucccagcuacuugggaggcugaggcaggagaaucgcuugaacuugggaggcagagguugcagugagccaaggucacaccauugcacuccagccugggcaacagagcaagacuucgucucaaaaacaaaacaaaacaaaacaaaacacgaaaaccacaaacaagaaaaccccauaguuugggcagaagcuguuuucugccuuugauggugguuguagcucagugaugguuaacuuuuuuuuuuuuuuccaauggugucuuuauagcucaagcuucaccuguggucuggcaggggcccuggccucaaacccuguugauguugugaggacacguaugaugaaucagagagugcuucgagauggcagauguucuggcuacacaggaacccuggauugcuuguuacagguaagagcagaugucugucucugcaggguugugaauuauauauuuuuuugaucuaagaaguaacuaaauuaugaaagcuacuaaaacuaagaugaaugaugcuuuaaagcccagagauguacaugugugagaccauuuuugccacacugugcuuagcuuuuauaaauacaauguuguuuucuuuauaccuccaucugcugugaaaggugaggaaauauuuccugugauuauaaaagaacugggucuccuuccaaaauguacuuucuuccuguugggucaaacuaguaugaauaucccucauucagacaucucuguuaaaggaacacaucaaucuuacuuuaauucucaguuuaaauaauugggccuccuguuuuaugagugggugaaagguuucaccugucucugccacuagauugccaguaguaggauuaggagucacuuuuuuuuuuuuuuuaaggugauauuuauuuauuuauuuucaaguuuuaauguauuuuagauucaggggguacaugugcagguguguuacauaggcacaugcguagugguggagauugggcuucuaauguacccauuacccaaauagugagcauuacaccagacagauaauuuuucaacucuagccucuccccuuuaggaguccccagugucuguuacuucuaucuuuauguccguguguacccauuguuuagcucccacuuaaaaaugagaacaugugguuuuugaucuucuguuucugcguuaguuugcucaggauaauggccuccagcuccauccauguugcugcaaagaacgugauuucuuuuuuauggcuacaggggccacuuuugugguuccuguuuuccaacaugacacuagcacauuuuauucuucagguguugccuuaaugaagcaaagacacuuaucguauucauccaccugacaucuugggaaauagugguacucugaaugauaucucuaccacuauugcuucuuuauuugugaccuguucaggagcccacauggcacggaagcaacagaccguaauuggaauuaaaucuaauuuuuuccucacucaacaguguuuaucuccuuuguguggaguucauucaauccuucgugugggguuguugggcauggagccuuagucuuccacccacacaagccucuaaagagcaaagauuucuuaggcaguccuuccaaacaggauuuuauuuuuaagaaaaauaaaucagucuggccacuaauuauuauuauuauuuuuugagauggagucucgcuuugucgcccaggcuggagugcaguggcgugaucuuggcucacugcaagcuccgccucccggguucaugccauucuccugccucagccucccgaguagcugggacuacaggcgccugccaccaugcccggcuaauuuuuuuuuuguauuuuuaguagagacaggguuucacugcauuagccaggauggucuugaucuccugaccuggugauccacccgccucggccucccaaagugcugggauuaaaggcgugagccaccgcgccuggccuggccacuaauuauuaaugcauuuggcauaauuagaaaguuggaaguuaacuuuuuuuucuucuuuuaacagacauggaagaaugaaggguuuuuugcucucuauaaaggcuuuuggccaaauugguugagacuugguccuuggaauaucauuguauccuuuucuguugcaauagaucugaaaaaagauacagcuaaagaauacuauuuguauaaacucucauguuauuaauuauaauuuagaaguagguucugauuauuuugaguuccucugaugcuaagaagucacuacuuaguuucuuuuuuaggaaguguaaagucuccgugcuagacacugaaucuugcuuugauggugguauuauucaaaaguagugauacuacuaaaaagguuuaguuagacucuguucuagaagcugaggguauuuacgauuucagagagagagagaggaggauuggcuuuauagcccuagccaccuugggaaggaugugguuggcaacagugucuuagaaugcuuaucuuagaaagugccugaagauaaacaggaauuagcuccggaauuguuuggcaggccagcacgcuuccuaugugccacagugggaggcaggaaaggaaaggcaguuaacuuuuuuuuuguuuuugagacugagucuuuacucugucgcccaggcuggaguacaguggcgugaucucgggucacugccaccuccgccuccuggguucuagcaauucucuugccuuggccuccugaguaguugggauuacaggcacauaaaaccacgccuggcuaauuuuuguguuuuuaguagagaugggguuucaccaugucagccaggcuggucucaaacuccugaccucaagugaccugccccuuggccucccaaagugcugggauuacaggcgugagccaccgcgcccgugaggcaguuaauuagacacugaagggcagagugaugaagcaggaaugcuggcuuuugcuguccucuuguugcucuucaucagcuccugccucccaaggaaggaugcauaguggaagccuuugaggagagcuucccagggcuugcuaacucucucucucucucucucucucaaaagcuuacagugcuggaaaguuuuuccaccacagcaaagccacaaaagcuuaucagcguagaugccaucucagaagaggcugauaccaggggauuuacauaucucagcugugaucuuucugcuccaagcugaccuuggaagauaguuugaugugguuaaggguggaaccccuuuuauuuaaucguguccauagcgugggucugccuguaccuauuuguuauuaagugugccauuuguaagucuguuguuaugcacuggaguugugaagauggcauuuucugugucauccuuaacccauaaccacaguucuuugugacauacgagcaguugaagaaauuggauuugugacaagccaaggcugcaugagacaucuuucugaaaaugguaacuucugaaacagcaaagcuuccuguguuucacucugcuucucacugcuuggcucaucacagauucugggaugugagcaacagaugaagacuggguuaguugagauugcuguguguuggcauuggaugcucuucaucaaacguuuaauggcauaaacuaacauccaaacacuagucuuuaccacugaagugcccuucaacaucaaagauaauaugugaaaugcauguuucuugcuaaagaaaacuugcaagaaaaucaggagcgauguauuguuuuauucagggagaguagcuccugaugcaucucagcucaugacugagaaucagacugcucuagaaaagcucacuggaaccauggaauggagccuccgagaagguguuaugguuucugaauuucugggagauuuugcuccuugucaacugaagaaauuucauguauggagaccuggacuguucaaccccagguauaaacggugcaggaaauggauccuaggaauaucacacugcuuuaucauuuccuauuuuggcaggaucuuccacuuauaauaagugauuuuaagcuuugaagacuugacauuugugagaaauuguuacaaaguaauaaucucuaaauucguggugguguuauguguuggcuuugaagguugcaaggucuguauuggugggggguguuuucaagcagcuuagguucugucuuaggucauguuaguaauuagcuuuaugauuuuuagcaaagcauauguauuucucaaugaguaaaauggggauaauaacgucuauugauguagagggucaaaugaagaacaaauaguagcugcugcuacuugacuggaaagguaaauguguuuacaucaugcuguggaacagcucuaaacagucuauguagaagaggggcauguucucaugggcuucucaugguaauugugaaugaagcccuuuguuaaggucuuguugaagaaagaacacuguauaaguucaggcuuuaguacauuuuccuuagcaaaauguugguagugaaucaaagaguugauuuuuccagguuuccaguuuuuacuuuaguuuauguugugccugucuuggacuuucuguuuaguuuggauggaaaauaccugcuugaaauuuuaaaaaugauuucuuuagugcaucuauuuagcuaguuucugauaggugguauguaauauuuucccuuuuucuuuccuucuguagacacaauaagucauucucccucuucuuuuuuucuuuuucuauuuucuuauucuuuacucuaaccugcuucagagaaagagcccucuuccuucuugucuucaucuuagucuuuucaaaauaaaagaugacugugagaaccccaagaacuuccacuucugggaggcagccacaggacagggaacauauuuauuugggucucuucaguucccccuuugagaacaacauuaaauacauguuagcuggggcuccagggcauucuccuuccacaguagugcggccaaauucccagucuggccagucucuuuguugagacugaauagaaggacugcagguuuuuuuggaggaugagauaauuuuuccucgcaggcauuuuucccuugccuuccuuaugcaugaauggucccuuugaauauuauuuccaaaagugagagcuaagacaaagucaucaaaaagagaggauaacagaaggugggggcgggggcggggugcagugggguaggguuaccuguuaauugcugagacucagaugaaaguccagcucucccugggcaacccuagagggcagcagaggaccccagagcucauucaggccuugcugcuuguucuaaacuacaccuuaggauuuuuucuucuuuccaaaacauuccauugauuuuauaaagacuuucuauagagaggcuuucacuuuugaguucuuugaguuuaaagauugcuuuucuugaaaugcucuuuuuuuaauguagaaaaauuuuacuuuuucaaauaugcauacaauuuuuaaaacaguagaagcaaauucauuuuaaugaccauguaaagagcgaaugucagacaguauuauuaccaguuuauucaaauuacauacauguuccuaccaagguggaaagaaauucaaaccucaugguaaaacuuaagcacgauuuaagauaaaagcauaguauuucuucaguguagacuuauuaagugccuuauugaacaggaucuuaaccugcuuuuucuguuuuuuugaaagaguuaaugcaauuguugaagcuucuaaccaagaaacaacuuaaggaauugggagacuugguccccucguugucaggguucuggcuauaaguaccuccccaccuuuggguuuucuuaaauaugccaaaaggaauucuaguuuuuauaaccaauggguuuuuuuguuugugugcuuauggauuuguguaaucauugaugcuuaauguuguggauucauaauauaaaaaguggcuccuguccuuuauauuuauucaugugcuagaaauaguaugcauuauauaaagaguaugaaguuuucauaagccuuuauauuucaagcucuuuauuuaaacauuguuggaauauguggcauaagccuuguuucauuuauuuaauaaacuggaguaauauauaauaauaa

SEQ ID NO: 192516 - RNA, 47514 nt, Homo sapiens
ucugucaccauuucugucaaauuuauuuagaaaucaaaauuacaguucacauuuacuaagagcucaaaugauuacacaucuaauuacacauugauuauacaauuaauauaacaugaaacuacacaggauuauuagaaaaagauuaucagggugcccuagaacuuguuuccacaaagaaaaaacuccaaggauucuuaaaguagcugaauucuucaacuacucaaaaaacaggauucagauuuuaccuuguaaauuuuugcuuucauauagaauaauucuauuagaguuggaguacuagcaauugcagcauuaauauaauccaaagccaaagaauacuguccaaguuuaucaaagugcugugccaggaaauacugaacccagaguaguguugucggggguuccuucuccccauucucugcaaucaaacaaauauuaaauuauuauagaaagaauguaaagcaaaucacauauuuucucucuccuaauucauaaugaaaugacuauugcaauaauaauaagcaagaaagacucagcaaaaacuacuaauuucaaaagaaagagguaugacuucauaaaguucaaaaaguggcagccauguagagaaauaagauuguacuuugacaggcuucuaaccccaaucucacuccaaagaaacaaugcuggggaaaagauauacgucaaacuaauucugugaacucucagccugaaagcaaaagggcagcaagaccaggaaaagucaaggaaaaaaacuuggcaaagagauuuccuaacuaccacugcaagauuucagcagaggcaagaacugccaaacugccauggcuuaccauuuuccaggccucaauacuaaaucagggauacccaaaguugaagacuaugaccuauaggaagaagauacaccugacaaaguagaaacaacccuaccaucugacaaaaaccuaaguagaaaaaacacagcccaguccucuuaaaaaagcagucacauauauacacuuaccugaguucuauccuguuccccauccuguacccucuaacuacagaggagcagaaaagaaauaucaagcucucaaaauggauuucagaagggaagacauacuuguguaaaaaugaggaggaaagagugaauauacccacacuacaucaaaacaaacagguuuccuagcauagcugaucaaaugacaugcaaacauacuauagcacacauuaaaacacaaauaauaaaauaaaggcaaugaguuaagcuucuacucuguuccucuuauauaaacuauauuucaagggaaccaaguauuugaugaaggaaaguucuuuauaagaaaaauuccagcuaacgaaugcagaaauuauuagaaucaacaagggaucuaggcaaugaucuucaauugcugagaggccaaugaggaauuuuugucuuguucuaucaccaacacuggagugcaguggcaugaucauaacuaacuguagccuggaacuccuaggcuccagugauccucaugccucagcuucacaaguagcugggacuacaggugagaaccaccgaacguggcuaauauuuuaauuuuuuguagggacagggucucacuuuguugcccaggcuggccuccaaauccuggcuucaagagaucuuucugccucagcauccccaaaaguguugggaucacagguguggagccaccgugcccccacgccgucauggaccuuuuuaaugaguauaacaggcugacaacaucugaaucuuuaucaaucuuaacaucaaaaaagagagaaaaccagaaugucucaagcuuccugacaugacacaacaggaagcacaaagcaccacccguauuuaaacagaaccugaaucuaauccagcaaguaaaccuaacuauaacuuacaaguaugaaugacagugaaauacagcaaaugauaccaugagaaaggcaaucaaccaaaucuagaauaugggauauguaagacaaaugaccuuucaacaaaugacuguuuuuuugaaagggaggggagaguuauuguucuagauuaaaauaaugagacauaaccaucaacuuauggagauauaacaaccaauuauuuggugugaaccuuaacuggaucuauacucaaauaaaccaaacacaaagacuucuuuuggauaaugggggaaaugugaaugcggacuggguaucagauauuauguuaugagguuuugugugacauggcacugcgaugacuucuucuguuuacguguuuuaaauagagaugcacacuaagauuggguaucagauauuauguuaugagguuuugugugacauggcacugcgaugacuucuucuguuuacguguuuuaaauagagaugcacacuaagauauuuacagaugaaacaguaagucuggaaugugccuuaaaaaaacucauagaggguguggcagcucacaccuguaaucccagcacuuucggaggcugagacaggcagauugcuagagcucaggaguucaagaucagccuggacaacauggcaaaaucccaccucuagaaaccucccccaaacccccgcgugugcgcgcguaugcacacacacacacacgcacacaaaaucagcuaggcaugguggcacacgccuguaguccuugccacucagcaggcugaggugggaggaucacuugagcccagaaguucagcuugcgcaacacagugagauccccucucuuaaaaaacaucagaaaaauacucagaguaaugacauguaagagacacauaaggaacccggaaguuacuuugugcaugacugaaaacauucuaguguuuucuaaaguaacuugccuugauuuauauaugcuccuacaaauauagaaacaaaggaccaaacuaaagaggauuaaaaguaauaagaggguagaaaaagcagagaauuuagggauucaggaaaaacagguuccaauauaaacuaacuacauggucuuaggcaagccauucaaccucucaaguauguuuccucauguuaaaacaagguuaagcccaggugugguggcucacgccuguaaucccagcacuuugggaggcugaggcggguggaucacgaggucagguauucgagaccagccuggccaacauggugaaaccccaucucuacuaaaaauacaacacuuaggcaggagugguggcaggcgccuguaaucccagcuacucagaaggcuaaggcaggagcaucaguugaacccaggaggcggagguugcagugagccaagacugugccauuguacuccagccugggugacaggaugagacuccgucucaaaaaacaaacaaacaaacaaaaaaaccgcacaagguuaacucccaucucauaggauuauggaaaauuuaaauuaaguaagauugaaagugcucucauuucauucaccaauuugaaagccauuuauuaaguagccauuagguagcacacacauaauauacauaaaagagcauuacugugauuaaaaaugaaaugaguaaucaaauuccaauucaaucuaauuuaaacuuaccauaugggcuaaaaaagucacacguuuuaagagaggcuucauaauuaguaacaaguuccuggauuauagaaaccuguuaaagaaacauauuuuuaaaauuuaaaaauaucuucuugaagguauuuuuaccuauuaugguuuaaauuacauuuggaaaauauacagcuuauuucagaacuauaaauuaauuaaaagacuaggguaucugcuuuguccccauuccuaacaugaguauuuccccgcuuuggagaagggguggaaaaaaacacaaaauaauggacauugcuauauauauggaccacucacaagacaaaaaaaaaaaaaaaaaaauggaccacuccuauaagggacacauuauauaaauauucagauuuucuaaaaugucaugcauugcaaaaaagugaaaugauucaagguuugaaaauaagugaaauuaaaaaugacucuuuugcuuauuauuguuagcaauccuacaauauaauaauuguauuguacuuacuauaauuacgggguuucuuaaccaauuuacuuaucuaccuacuacaaaauaaggucuggugcucacuucagcagcacguauaccaaaauuggaacaguaagagauuggcauggcgccugugaaaggaugacacacacauucaugaagcguucuauauuuuaaaaggaauauuucuucauuguuuugugaaaacuggggcuuugacaucuuuauuuucagaaaaacaauuauauuucucuuauuucccuacgccucuuuacaaacuaaccaaaauucacuaugguuccccucacacugaaguggucaugugucacaaacucaacagauuuuugcauauauggcuacaaaagaaaccucuucacgcauaccauuuaauauaagaagguauaauuuaauuagcuuuauuuugaauccggauuacuccucaugccacaaagacacaggacaguguccaugaaaccacugaucauccuagacacuagucaaaacacaaggccaaacuguaacacuuuucaggccuacaugauagcuuucucacaugaugcugcaguauacggcaggaucucuaguaaaguucaauggacaauguggaaauaagguaggacuauacauuaacaguaaggaacauguguaaauaagagaaaaagcagaaugugaaaaaaauuuacacauacuaugacuucacuaaaacauguauguacagacaccacauacucaaugaaaauaugaccagacauuaggguaguagaaaauggguacauucuuuguguuuucuuuuuuaaaaaacaaagauuguuuaauuuaaaaacaaugguucugaaaguguuaucuucagaucauuaauaauacuguuaaacauuagugucaccaucauguggcaauuuguuagaaauauucuguacaaucuguuuugggguguguguguguguguguguguguguguguguguaagagacagggucgcccucugucaccuaggcuggagugcaguggugugauagucgcucacuguagccuugaacuccugugcucaagcaauugucccaccucagccucccaagcaacuaagacuacaggcauguauuaccaugcccugauaauuuuuuuuuuuuuuuuuaagagacaaagucucacuacauugccuaggcuugucuggaacuccugggcucaagcaauccucccgccuccaccuaccaaagugcugggauuacaggugugagccaccaugccuggccuguacagucuguuuuuaacaagccgucuguaaauucugauacacaauuaagaguuugagaaccacugauaaaaaaaaaaauugcaaagacuuuuuuuuaagcaaaauuaaaguuaacagacauuuuuaauccaccauaaccucuccaccaaucucaccuagaauaucuguaacuuaaaaaccuuuuuuacaaacuuagaaauuuaguacucaaguuguuaaacuuauaaaggcaaauaauuuuuuuucaggaacuugcgccaucuacugguaguugcuaaaacugcaaccagagguggcuuuuaaaagggcggacguuuaugcaucucuagggugaaaccuauguuuuguuuuguuuuguuuuguuuugagauggagucucgcucugucaccaggcuggaaugcaguggcgcgaucucugcucaccgcaaccuccgccucuuggguucaagcaauucucugccuuagccuccugagcagcugggauuacaggcacccgccaccacacccggcuaauuuuucuauuuuuaguagagaugaaggggugaaaccuauuuuuaaagaagucaguuuuaacaauaaaggguaccacaaaacauacacugaaguuacauauaauccuucauaaaagaauauaaauacuucugaauaaaacagaucuccagauucagaacuucaaaacaagaucugauuacgggggaaaaaagguaauggaaaauucauaggauaucuccuacauuuaaaaaaacaacaaaggggacugaccguugcgguucauuaggcauacuucuugaauauauuuuauauauacauaaauuuuuguuuuuuugagaccaagucucacucuguugccuaggcuggaguacaguggugugaucucagcucacugcaaccucugccucccagguucaagcaauucuccugccucagccuccugaguagcuggaacuaaaggugugcaccaccaugccuggcuaauuuuuguauuuuuaguagggaggggguuucgucauguuggccaggcuggucuccaacuccugaccucaggugacccgcccaccuaggccucccaaagugcugagauuacaggcaugagccacugugccaagccaaaauuuauaguuacuuuauuuuuauuuuuugagacggggucucacucucucacccaagcuggagugcaguggugugaacucggcugccugcaaccuccaccucccaggcucaagccauccuccugccucagccuccugaguagcugggacuacaggcaugcaccaccacaccuggcuaauuuuuguauuuuuuguagagacgggguuuugcccuguugcccgggcuggucucaaacuccugagcgcaagcgaucugcccaccuuagccuccuaaagugcuaggauuacacgcaugagccaccagcccuggccuuaugguuacuucucauucaguaauuaagugaacaauuuucuaaauuuucuaugaaaguuaaucuaagaaguuuuacucaaguauaagacuuauuucgcucaaguuuacuuaccauuuauauuuaauuagguaguguguaauaugacaaauuaauauguaauagcuauucuucuuuaaaaugguguuuugccuccauuauuuuaaagucaagaaagccaauccacuuaaguaucugagaucgcaacaaaaacauaaauggccaccuuaaauuuuauggccccacauuuuucuuacaaugugaaaaauuuuccaaguucagccaccuucuccugguuuacuuucuucuaacagcuacauuagaucaagauggaagaagcuuuuuaucuuuguuaauaaaaucuaaccuaagauaauaccauaacuguuauaauuuccuaaaguauguccuuggugaccagcuuuucuuauguaagaguuaaaagaacucuucauuaaccuuaaagacaaagucccacaacaucauaaccgauacacauuuuuuucgcaaugaagagacaaaucacagguuuaaaaugucacugcaauaugaaaguuacuaaauuaaguacacuacuuuaccagcaaggaccaaaauugcugaauuagguucugauauaagcacaauuacuagugauaauuuuggugcugaaggggcuaguuacagagguaaacuguccaagaacaaugacaauaaaauaaaaguaacuacagagaugaggugugagaagggugggacuuaccaucuaauuuagagaguaagggaaaauuaccauuucuugaacauauucaaaccaaguacuuuacaaacuuuauuauuuaauuaaaacacacaccaaugcuuuacguauuauuuuccccaacuuuaugaaaauacaaauauucauauucaaagcacacgagcacugauguccaacuucaauggaaucaaaguguaccagccuaggcaaaccuggauguugacucauugaacgucuucacuuaagagccugacacucacaaacuaauggcuaaaaaacaaguacuuucuaacagugaauauggaagucccaaaucaauguacaccucuucuuagagccuucaaacauuuuggggcugggugcaguggcucaugccuauaauaaucccacagcacuuucgggggcugaggcaggcagaucacuuaagcccaggagcccaagaccagccugggcaacaugguaaaaccccaucucuacaaaaaaauacaacaaaaguuagcuggguguaguggcccgugccuggagucccagcuacuugggaggcuaaggcaggagaaucgcuugagcccaggagguggagauugcagugaaccaagauugcgccauugugcuccagccugggcaacgggagugaaacucuuaucuuaaaaaaaacaaacaaacaaaaaaaaaaaacaaaaaaaaacuggcagggcgcgguggcucaagccuguaaucccagcacuuugggaggccgaggcggguggaucaugaggucaggagaucgagaccauccuggcuaacacggugaaaccccaucucuacuaaaaaauacaaaaaaacuuagccagguaugguggcgggcgccuguagucccagcuacuccggaggcugaagcaggagaauggcgugaacccgggagguggagcuugcagugagccgagaucacaccacugcacuccagccugggggacagagcgagacuccgucucaaaaaaaaaaaaaacaaaacugauuuccuuuuuuggccagggaaguggggagacagggucucgcuguguuacccaggcuggagugcagugaugcagucuaaguucacugcagccuucaaccuuccaggcucaagugguucucccaccucagccuuccaaguaucuagaaugcgccacuguacuuggcugauuuuuguauuuuuuuguagagacacugccucacuacauugcccaggcugagcucaagcaauccuccugccuuggacucccaaagugcugggauaaaagacgugagccaccacgguggccuggcacauuuugguuucauguuugacuuuuuuuuuuuuuuuugagacggagucucgcucugucacccaggcuggaaugcaauggugcgaucucagcucacugcaacugcccccucccggguucaagcgauucuccugccucagccucccaaguagcugggauuauuccaccacgcccagcuaacuuuuuuuuguauuuuuaguagauuuaggguuucaccauguuggucaggcuggucaugaacuccugaccucagguaaucuacccaccucggccuccccaaggguugguauuacaggcgugagccaccacacccggccacguaugacauuuuaaaaaguauacagacuguuaccuuuaguugaacaaaaauuaaaccaaauuaaacuaauuuuacuaauuaucuuuuggaauaaauacagauuuuuauccuucaagaaaaccuguuuuuccucacuaaaucagcaaaauaaaagacaaacauauguaacacauagcacacauaagaaaaaaaaagaaaggaccaggcacaguggcucgugcccauaaucccagcacuuugggaugccuaagugagaggaucacuuaggccaugaguuugagaccagccugggcaacacagcaagauccaucuuuacaaaauaaacaacuuagccaggcauggugguacaugccuguagucccagcuacuugggaggcugagguaguaggaucacuugagcccaaggguuugaugcuacaaugaguuacaaucucaccacuacacuccagccugggugauagagcaagacccagucucuaaacaaagauuuaaaaaagaaaaagaaaaaaaaauuagaaaaaagaccaaauuaaaccuaaaacaagcaaaaggacacaauaaagugaaaauuaaugaaauagaggaggaaagucaacaaacccaaaaccuggcucuuuagaucaagaaaauuggcaaaccuuuagcuagacugacaaaguaaaaaauagagaacacucaaaauauuaaaaccaaaaacaguaagaggggauauuaccacugacuuuauagaaauaacagacuaugacacgcauaugccaaugcuguauaacauagacgaaauagacaaauaucuaaaaccaugaauuuccaaaagccagucaagaagaaauagaaaaucugaauaaaccaguaaugaagaguuugaauacauaauaaaaaacuacccacaaagaaaaguccaggcccauaugacuucacugguaaaugguaaguucuaccacacauuuaaagaaauaauaauaccaauucuucacaaacucuucccgcccccccaaaaaaagaggagagaacauuucccaauucauuaugaggccaguaucacccugauagcaaaaucugauaaagacaugaaaagaaaacuagaccuuuaucucuuaggaauauaaaugcaauauccuaaacaaaacacuagcaaaucgaacccaucaauauggaaaaagaauuacccaccaugaccaaguaggcuuucacccagcaaugcaagacugguuuaacaucagccaggagugguggcucacaccuguaaucccagcacuuugaaaggugggugcaucaccugaggucaggaguucaagaccagccugugcaacauagugaaaucccguuucuacuaaaaaauagaagaacuggcuggguaugguggugcacgccgguagucccagcuacuugggagaccgaggcaggagaauagcuugaacccgcgagguggagguugcagugagccgagauugugccacugcacuccagcccgggugacagagugagauugcaucuugaaaaaaaaaauaaaaauugguuuaacaucugaaaucaauuaauguaaauauaccauauaucaauagauuuuuuuuaaaaaaaaaccuacauaaucaucuuaacacagaaaaagcaugugacagaacucaguaacagacuuucgugauaaaaaugcacaauaaacuaggaguugaagggaacuuccuugacauuacaaaggacauauaugaaaaacccacagcuaacacaguacuuaauggugaaaaaucuagaugcuuuuccucuaagagcaggaacaagacaaagaacucucaccacuuccagucaauauuguacugaagguacccagggcaauuagucaagaaaaugaaauaaaaaggguauggauuggaaagaaagaaguaaaacgaucuauuugcagaugacaugauguugcacauagaaaauccuaaggaaucuauuaaaacaucuauagcaacgaauaaacaaguucagcaagguuucagaagacaaaaucaacauacaaaaaucaacuguauuuccauauacuagcaaagaauaauccaaaaaugaaauuauaaaaacaauuucaucuagacuaccaucaaaaagaauggcaugcuuaggaacaaauuuaacauaagaugcacaagacuuguacaauaauuacaaaacauugguugaaagaaaucaaagaccuaaauacaaagaaagacaucccauguucgaagauugacuuaauauuguuaaguugaggauacuuccaaaaugaucugcagauucaacaaaaucccuaucaaaaucccagauggcugcuuugcagaaauagaaaagccaauccuaaaauucaaauggaaauaaaaggaacccugaauaaccaaaauagucuugaaaaacaaacauaauaaaaaaauagucuugaagaacaaaguaggaggagucacacuuccugauuucuuuuuuuguuuuuguuuuuguuuuuuuuuuuuugagacggagucucgcucugucgccacgcuggaguguaguggcucaaucucggcucacugcaaacuccgccuccuggguucaagugauucuccugccucagccucccgagcagcugggaguguagaugccugccaccacgccagcuaauuuuuguauuuuuaguagagaugggguuucaccauguuggccaggauggucuugaucucuugaccucgugauccacccaccucagccucccaaagugcugggauuacaggcgugagccaccgcgcccggcucacacuuccuaauuucaaaacuuaccacacugcuacaguaagcaagacaguauggcacuggcacagauggacuuuuagcuuuucuuguauacugauguuuaacauguuaaagaaccuuucuagcuauuugagaaacugucccuccaaggucuagccaauucuuaaagauaacaaagggcccagcuaggaguaugucuuuaauaugcaagcuauucaaaauccagagccauaucuccucuaucuggcccuuauaccccaagaggcacuacuccucuaccuaaucaucccagagccaggugccaggcaacgagaccaccccgccagucuaaaguaugccaaaauuauucaaacuaaacuguucgcccugcccuacccuaaggaaaccucgaugaaggcaguagccuaauccuuccccucccuccuaaccacccuagcgucuuccccaaguggcccagcauggcauggcacagcaugccucgucucuaggaccugugugauaaacuguguuuuuuccugagccucuccagugucuccuauuguggcugcaccugaauaacaaucucauaaaagaauaauagaaaacaauaaagacagucauacacaucaguggaacagacuugagaguccagaggugaacccucgcauuuaugguuaaucuuuuuuagacaaggcugccaagaucguucaacagggaaagaagagucucuucaacgaauggugcuggaaaacuggauagucacacacaaaagaaugaaucuggacuccuaccacaccauauacaaaaugaacucagagugaaugccucaaugcaaacucuuacaaguaaacauguuuauaaaucuucaugacguuggacuuggaaaugguuuuuagauaagaccagaaagcaugaguaacaaaaggaaaaaaaagauaagcuggacuucauccaaauuaaaaauuuuuagugcaucaaaugacaccauuaagaaaaugaaaagacaacccguagcagaacagaaaauauuuucacauaauguaucugaugagagacuuguaucuagaauauauuuuuaaaacuucuggcccggcgugcuggcucacgccuguaaucccaacacuuuggaagggugaggcgaacagauugcuugaguccaggaauuuaagaccagccugggcaaauggugaaacccugucucuauaaaaaaugagccaggcacgguagcgcaugccuguagucccagauacucaggaaguggaggugggaggaucaccugagcccaggaggucaagguugcagugaggugagaucgcaccacuguacuccagccugggugacaagagugagaccuugccucaaaaacacaaacaacgaaaaaaccuaaaaaaaccccacaaaaacaaaacuuccuuaaacugaacaauaaaaagagaaauaacccaaucuaaaaaugggcaaagaaaauuaaugacauuuccccaaagaacauauacaaaggccaauaagcacauaaaagauaauaccaacgguaaucaggaaaugcaaagcaaaaccucaagaaauuaccauuucacacccacuaugauggcuaucaucaauaauaacaaguguuaaugaggaugugcagaaaucagaacccucauauacugcuugugagaauguaaaaugguggaggaacuuuggaaaaagagucugacaguuccuuaaaaguuuaaacauagaguuaccauuugacucagcaauuccauucccagauacacaccuaagagaaauggaagcaugucuacacaaaaacuuguacaccaaaguucacagcagcauuauucaaaauaaccaaaagguagaaacaaucaaugugguauauccauaaaauggaauguuacauggucauaaaagggaaugaaguacugauucaugcuacaauugcggauaaaaauauuaaguaaaagaagccagacccaaaaagacuauauauuagauaaguccauuuauauaaaagguccagacugggaaauccauagacagaaaguaggcuaaugguugccuauagcugagagggacgugaagguugugagagaauuacagcuaaaggauauggagucucuuugggggaugacaaaacauuacauugcagugaugauugcacaacucugugaauauacauugaacuguauacuuuuaauagguaaauuuuaugauauauuaauuauaucucaauaaagcuguuaccaaaacaaaaauagguggggaagcuacugacaucucgaugguagaggccagggaguuugcuaaacauccuacaaugcauaggacagcccuacauuacaaagaauuaucuagcccaacacgucaacaguagaauccuuuguuaggaaggcuguccuguaccuuguggaauguuuagcagcaucccuggccuccacacacuggaugccaguagcacaccucaccucacugcagcgacaaucaaaaaccucuccagacaucguaaaaugucccaaggggaaaaaauccacuccccaacacccucauuaagaaguacugcucuaaagaggacuuuccaagaugguuuuaaaacaacagaugaacuuccacaacagaaauaaaaaucaccaaaucugguuccacuaaauuuuuaacauuuccaugugaaaacaaaaacagaaaaacaaacacaagacaggaaauauuucaggcacacugcuaguggcaauacaaauugauguuuacaaccuugugaaaaacgaauuuaucuguguuuaucaagaaccacaaaaauguucauauccuuuacccacugaaugacucugagagaagaaaauaugagaagaaaauaauccuaagcaaagcuaguauaaagauauuuaauaauaacuugaaaaaccaaacaauggagggaugguucuaaaagguuauguaauaacuaaaaaggauaaugaagauuauauaacaacacaguaaaagcuuaugaaacugcuggggcagggagguggguguagguucacaccuacaaucucagcacuuugggaggccaaggcaggcaaaucucucgaguccaagauuuugagaccagccugggcaacagugagaccccaccucuauaaaaaaaauuucuaggccgggugcaguggcucacgccuguaauccuagcacuuugggaggccaaggcgggcagacugccugagcucaggaguucgagaccagccugggcaacaugguaaaaccccgucucuacuaaaauacaaaaaaauaaaauaaaauuagccggguguggcggugugcgccuguagucccagcuacucgggaggcugaggcaggagaaucacuugaacccagagguggaggcugcagugagccgagauggugccacugcacuccagccuggugacagagcgagacuccaaacaaaaaaaccaaaaacaaaaacaaauuuuuaaaaagaaacugcuagggggaaaacaaagaacaaaauuuauggucaaaaugacuacagcugcauagauacaucacaauuaaauucacaguaaaaaaaaacugugaaaggaauuacauuuaaaaugcucuuagagcuaggcgugguggcucacaccuguaaucgcagugcacugggauucuaaggcaggagaaucacuugagcccagaaguuugagaucagcgugaacaauacagcaagaccccaucucuacaaauuaaaaaauuaacuaggcaucguggcacgcgucuacucaagaggcugagacggaaggaucacuugaacccaggaagucaaggcuacagugagcuacgauugggccauucauugcucuccagccugagagacagaucaagaugcuauuucacuuauuuauaaaauaaauaaauaaauguguaaaugcucuuaaauuguauagucauguggcaguuuauaauuggauuuuguuugggcuucccucccauuuuuuaagaucuuuccucuguuuuccaaauuuucuauauuguaauuauagcacuuuuuugaugaaaaauuacuucuaaacuuuugugccaaguuacucagcacuuuuacuauuugagaacacggaaacugauggaagagugcuacaaacuuacacaaaugccaacagaaaagugaggagauaagauuccuuauaaauaucaucaaugugaaaugguaauacacaacacacauuaguuguguaccauaugaaauggcuggucaaacaucucacucacugucccacuggacaacuuaucuaugggcguuacagaaauaauuuguuggcauuaugacucagaccaccagcagacuaugguacauauaaaaucuucucauuaagcugcuacagauguugugaauacuauguuaguuguuuguuucuaguuuugauuuuuuauuauugcuguuaugccaacucgggaacagaaggauugagacccaaucaaaaagauuacuaggcaagguucuuuauucacacuuagaagaaauggacacuauuuuauagagccaguaagcaauuauucauaauaaaaguuuggucugggccaggcgcgaugguucacgucuguaacccuggaacuuugggaggccaaggauggcggauugcuugcgcucaggaguucgagaccagccugggcaacacgaggaaacccugucucuacuaaacuacaaaaaauuagccaggcauggcagugugcgccuguagucccagcuacucgggaggcugaggcaggaggcucgcuugaaccugggaggcggaaguugcagugagccgagagcgugccacugcacuccagccugggcggcagagcaagacucugucucaaaaaaaaaaaagagagagagagaggcccggugcgguggcucacgccuguaaucccugcacuuugggaggccgaggcgggcggaucacgaggucaggagaucgagaccauccuggcgaacacagugaaaccccgucucuacuaaaaguacaaaaaaauuagccgggcaugguagcgggcgccuguagucccagcuacucgggaggcugaggcaggagaauggcgcgaacccaggagguggagcuugcagugagcagagauugcgccacugcacuccagccugggcgacagagugagacuccgucucaaaaaaaaaaaaagguuuggucugauauaauaugugaaagacuacaauacaaagugacagaugaaaacaucugugcacuucaaguacuuaacaguuauucucuaaaaguaggagauguucuuauuuuuuucuuagauagggucucaagucuguggcacaggcuggagugcaguggccugaucacaggucacugcaaccuugaccuccaaagcucaagagauccucccaccucagccuuccaaguagcugggagugcagguacaugccacuaugaccaacuaauugucuucauuuuuuguagagacggaguccuguuauguugccaggcuugucuugaacuccugaucucaagcgauccucccaccucagccucccaaagugcuggauuacaggcaugagccaccacggcuggcaaguuguccccuuuuucuuguaaucacuuguaagaagaaaacaguacauauuaccagaacauuuaaaguugguuauuaccuauaaauacacaacugauauuuucaaugagaugauauccacaaaaaauuaaguuagaaauauucuuaucauuaucuucaguaaaaaugauacuauuucaguaaagcaugaaagauacugaaaucucuaugcuauauacagcaaccuaaauauccaggacuugaacucaucgcuguaccaagcagaccuaauagacaucuacagaacuccccaccccaaaucaacagaauauacacucuucucagcaccacaucgcacuuauucuaaaauugaccgcauaacuggaaguaaagcacucuucagcauuucguaaaagaaaacauaucacaacaaacugucucucagaccacagugcaaucaaauuagaacucaggauuaagaaacucacucaagcugggcgcgguggcucacgccuguaaucccagcacuuugggaggccgaggcggguguaucacgaggucaggagaucgagaccacggugaaaccccaucucuacuaaaaaauacaaaaaaaauuagccgggcacgguggcaggcgccugcagucccggcugaucuggagacugaggcaggagaauggcgugaacccgggaggcggagcuugcagugagccgagaucgcaccacugcacuccagccugggcgcaaugagagagacuccgucucggaaaaaaaaaaaaaaaaaaaaaaaaaaaaaaaaaaaaaaaaaaaacucacucaaaaccgcacaacuauauggaaacugaacaaccugcuccugaaugacuacuggguaaauaacaaaaugaaggcagaaauaaagauguucuuugaaaccaacgagaacaaagacaaaacauaccacgaucucugggacacauuuaaagcaguguguagagggaaauuuauagcacuaaauacccacaagaaaagcaggaaagaucuaaaaucgacaccuuaacaucgcaauuaaaagaacuagagaagcaagggcaaacaaauucaaaagcuagcagaaggcaauaacuaacuaagaucagaggagaacugaaggaaauacagacacaaaaaacccuucaaaaaaaucaaugaauccaagagcugguuuuuugaaaagaucaacaaaauggagagaccccaaagccucacucaaagacuggcaauuuuuuuuaaguacuuuucaaaacaaguaagcaaauguauaucaucucagcaaguuaucuguuauggacaggacaccuauauaauggauaauaagaaacaaaacaauauuaacuuuaacaaaaucuaacuuaaaagggauauaaauauauuuuuaguaauauuuuauucuuauuuauaaaagacaagaacaccuugauaucagaguuuauagaagauucuauuucaacauuaaagaaagcugggaaaaugagaauuucuccuuuucuucaccaaagauuucuccaaaaccucacugacaaaaguaaaaugagugccauuucaaauaccuaccuauguuuuuaaaaaccuuaugcaacuuagucgggcacaguggcucacaccuguaaucccagcacuuuaggaggccaaagugggugaaucacuuaaggccagaguuugagaccacccuggucaacaucaugaaacccugucucuacuaaaaauacaaaaaauuagcugggcauggugacaggcaccuguauucccaagcuacuugggagacugaggcaggagaaucguuugaacccggaaggcggagguugcagugagccgagauugcaccacugcacucuagccugggcgacagagugggacuccaucucaaaaaaacaaaaacaaaacaaacaaacaaaaaaaaguuauggaauuugucugacaaccacucauugccuuccacucuacccaaacucuaguuugccaaaaaaauuuaaaugcuggagacauuuaagaaauacauuucggccaggcgcgguggcucacgccuguaaucccagcacuuugggaggccgaggugggcagaucaccugaggucaggaguucaagaccaaccugaccaacguggagaaaccucgucuuuacuaaaaauacaaaauuagccgggcgugguggcacaugccuguaaucccagcuacucgggaggcugaggcaggagauuugcuugaauugggaggcagagguuucggugaggcgagauuaugccauugcacuccagccugggcaacaagagcgaaacucugacucaaaaacaaacaaacaaacaaacaaacaacaacaacaaaaacaagaaauacauuucuugcaacuguacuacauucuaaacuaacuucaaaagacaauuucauuuucaugauaccaacaugaauuacucuuuaauauuuggaaacuuacaaacaauagcuguuugucauacuucaccuccuugaaauccuuccucgaaaguuaaaaauccagcuaacuacuaaaaacaggucuuacugcugcuuagaaaugugcaguuuuuaaaauggcuuccuggggugcagugcacacugcucaggcgauggguguaccaaaaaucucagaaaucaccacuaaagaacuuaucuguguaaccaaacaccaccuacuccccaaaaucuauugaaauaauuuuuuugaaacuacaaaaaaagucaaacacaaaacuuacaaaauuuaauugaaaaauaaauauuaaaaaauaaaauaaauaaaauggucucaugaguaaaucacagauacauguggccaaaauuauuugagaaacaguucuuagacuugcaaauuuuuucucacuauacuaaauucagauaacuggagcucaauuuucugcaguuuaauucauuuugcaaacacacuugguguucuggcauuucuaauaauauagcauuccuguugcuugcuuuaaaauuaacacuaaagagaugguuccuguaugaauuaguguauucucagugccuuauucaaaaacauaauuuucaugcuuuauauaaaauaccaaaaaaaaaguuuagcauuuuuguaauggcaacuuuggaucaauauuagaagaauuuuuaaaaaguaaaaagccuaugccuaugaacaacacccugugaaagccccgugauagcuuaagagaaacaaauccuuuaauguccacuguagucaguagcugcugcaauacuguuauaaaagaaguacucuaauucacauacauaagauuucuuuuuauuucuggcauuucaucuaaccuuucuucucugucacccucaccaaaaagaacaaaagaauuuuacccaauguuaaauaaucuagagaaauuauuggcaggcaccggguacauguuuacacagaaaucaaucacuaucucucaaaaaacugacaacagaaacacugcagucaaauagaccauacaacagacauuaaggaauuguaaggguuuuuuggguuuuuuuguuuuuuuuaacauaaaugauguuuuuuucuaacuggguacuagauaucaucaguuguuucuuuuguuuaugaaaccugcugccacagguaggaaaaugccaaucagcuauaucuauaacugauguuuccaacauuguauuauucacaauuacugcaaauuuacaaauuauuaugaaucaaagcuaaauaaauaugacagaagcuuaacuaaaauuuuuuuggcauuucuaauaaaaucuuuuccuuauccaguaguaacuuuaaaaaacugacuauagaaaagacaacaagauuuuagacuuuaauaagaagcaacacuuggaaauaaaaguauaacuugcuuucuauuaacuuuuaauuaucuuucuaauuuaagaccaagauuuaagugccuauuuucgaaauuuuuuuuuuuuuuuuugagacggagucucgcucugucacucaggcuggagugcaguggcgcgaucucggcucacuucaagcucugccucccagguucacaccauucuccugccucaagcuuccggguagcugggacuacaggcgcccaccaccacgcccggcuaauuuuuuguauucuuacuagagaugggguuucaccguguucgccaggauagucucaauuuccugaccucgcgaucugccuaccucagccucccaaagugcuaggauuacaggcaugagccaccacaccuggccuauuuucuaauuuuaaaaagcagaaagacaauucuuuauucaagaacuagcuaaaccuguauuuauuaaaauguagccuacugauuaaaccuaguaauuuguaccaguaauuugaccaaauugcauuuuacuguugcacuaacucaauuauccaagcucuaacuuuaaaagcaugcauaacuaauuuaaaaauccauaacuguaccauaaaauaauaaucacaaaauaaauauauaccuuugguaacaaugucaaauuuaaaauccuacuaaaaaaaaguauaccuauuaaaaauaaacaaccuuuauaaucuuagugcuuucauaaacccuuuacuuugauauuacuuauacuacaggcauguaauuucaguacaugacugaaaguaagguaacauuacugaaacaaagaaaaugauuaaguaauagcacauuauuuacauggacaucuuucuacaguuuaguaaaaaagacuauagcaaaucugaauaaauaccaaauuuuaccuuuucuguauuguaauauaaagauuucaaaguaguaaacaagggugggcagccuuuacugaaguuaacccucaggaacuuauccauuaguucucuaaaucuuucaccuagaaacaaaagcguacuuuguuauucuuugguucacgcaaacaauucuuaaaaugauuuucuaaauaaaaauaaagcucccucagaagcaauuaugcuccuauccaauuuauaaacccaaaaagucauaguuuuaaguaaaaguuaucaacuauccauucugaauuuagcacaauaucaaauaucuuuccuaaucucucacugacuagcacacucagucuacagcucaaaacccugcagauaugcauaaagcacucugcagcagacuaccagcacuauauucaagugauagccaaaagaucuuuuuaaacacuaagcugguguuuacaaauguuuucccaaaucaacuugucauuuacuucaacacucauucauucauucauucauuccacaauaaugugucaagcacuuacuacaugccagguacuguucuagguauugaggauauagcagugauuaaaauuuaaaaaaaaaaaauuuuuuuuuaaauagaacuuaacaucucagugagugagaccaacaauaaaaguaaaguaaauuuauguuagacauuagacugagccaugggcauucuaacauuacaacuaaauaaauacccuauuugcaacaucaagucaauaauucuuucauugcuaaaccccagaaaugauuuuugucaucaccuuuugaaagcagagaauauucaaagaauuuuaauuuuaaauacaaagauacaagaauuuuuugacaguauggacuaauacauaaggacauggauuuaccuaaucauuugggggaaaaaaaaaaaaacacauguaugucaugaaugauuuagccucaaguaagaugacugaaaugaccuccuaugguuucuuaaugaaucacaacacugcacaacaaaaucuaacaacccaaaaugguuauuuuuauuuguugugacuauguugaacaaaacaugcaugcauacucaauauaauuagaugucauaaaaaaauuuaacuccauuaacuauaaagauuguauucagauaaucucuaaucucuuauuagaucauacacaaaauacuggucuuuugaaaaaucacagauuacgaagacaacauaaaacuucauccuggguuaaauuauacaccacugcuucuuuaaaaaucaaaaauaguuucagagaccgaaccuuuccaguaauuccucugguauacaacgaaauuaacaauauugugguagacaauaagagacgcuguuucuuagaggaaugcagacuucuccacguauuugugugcaaccuugggcaaauaacuuguccauuaaaaaccuuaguuuuaucacuguaaaaugaaggcaauaccaucacugaccucaagaguacauuuguauggcucaaacgagauaagaauauaacaguaaacaaugucuugcacguaguaaucacucaauaaaugucucuucucugauaucugacaguuuuuauauuuucgaguuaauauuuuguuuucuauucuugcaaucacccgcugaggaaacaagccuuuuaucuucauggcagaagccacucugaacuccuccuuggucaacuuucucagucuauucagaucauauugacaaauuugauuagauugugcagguaugaaaaagaauggggaagcucuugaagugcugauccaggacuaaucuccaaauacgagguuaagugaaaagaaaacccaggugcgcagcaauccaucaauccauguuacugcacuuuugcaaaaagcacaguggggggggugaccuuaaacaaaucucccacacauauuuuggcucacacaugcacaauguauuuguagaagaauacaccaucagcugaucacaauggaugucuucaggaaaguaaacuuaguugccaggggacagacaagaaaaagacuucacuuauaaacucuuuuuaccuaauuugcaacugugugaauacaucaccuaaacaagaagccuacacagcuacccaacugcucagucacauaccauauccccagauuacuuauuauuuauccaucucauuuuuuccaucaauuauuaugugccuguuuaguauuacugcucacaaaacagguuaccugaauaauucucaucuagauacauuagcaugauguccccaaaacaugauguccauauuuacaugaauuccuaaaauaaucaguguaaacagcaagaauagacuguuucuuauucacuggaaauccguucuaaauaauggagcaaaauauaauuaguauucuauguuuaauacucuggauuauuuccuucccucucucuacccuucagccagugcauaauggaacaugaugaacugauuauuuugaaaagcagcuuuaucccuucauuauuuuuagagugcuuaauauuuucagguguuagaaaauuuccuuauuguucuguagguaugaagcccuuuuaccuaaaaaguggaaaggcuuuuucaaaacuuucaccuugcauucucaagaugcaucauguuucuugaggaagaucuuacugcuuuugauaaugccaagacggcuuucuaauugcacauaaaagcacuucuagacaggcaaaaaaaucaugaaauauucggcuuugcacagagaaaauuaaguauuugcauaauuuuauauauauucacuggagcuuuguaaauacacauuugucagaaccucaaagcgaugaugaccuugaaagccuaugccaucagaccccuccacugagaccuguuuuguaaaaagauuuuuauggcauuucaaagacagcauguccuagagagucuaggaugguuccacuuuaaccuaaaucacacuuuacaauaaaaaaaaaaacucuaagcucuuccaguaaaaauauauuuccuacccuauacugccacauauugagggcuuuuaguaaacuuauauugucuauggaaauaaauuuaggcaguauaaaccugaagccccauguuccaaaugagaaaaagagaacaaagaagucuuguucguaaucuuaaagcuaagcgagguuucuuucuuuccuaagaagcauaugaauguauuuuaaagcuccuaaggaaauaucccccccacacacaauauauugugaaacacaaaauauaccuugagaccaauaaaaggaggagaagucagaaacuaaagaccacauaugguaugauuccauuuauuucaaauguccaaaaacagacaaauccauagguacagaaaguagauuugugguugccaggugcugugguugaggggugacagggagugaaauagguaugggguuucuuuuuggggucaugaaaaauuucugaaagcagacagagaugaugguugcacaacaugauuaauauacuaaaacacugaauugcacacacuuuuuaaaagugaguuuuacgguauauggauuauauuucaaaaagcuauuauuuuuuaaaacaaagaggagaaggaagaaauacagaaauguaagccuaagcaucuuccacaagacacuuuuauuagggaaaauacuccucacuacgcauauacucccaucuuugaaauucacaaaguguauauuaaaagcucugagaaguccuauagaaaccugauagcugugucuaacccaguuucccaaacuuacuuggcugaagaacagcaaaagcacacuaacacccuccccaccaagccuauuaauauccacuuggacuuaauguucccuggaaaacauuagagaaaucugcucucuguauucuacaaaaacaaaaccaaaaaaauggaggaucagaagaacacuacucuucauauguggaauugaaaugcaauaguauaaaaugaauuuuuaaaaucaauuucuaucuacugucuaaucaaauacauuucuaaaagguauuucacaagucagucaacuaaaaauuuuuaauuuucaucaauauuuugguaaaaauaaacuuauaacccaaguauuuaaacaaauauuugccacuaugagaauagaaaauaaacuccucgccucuccagaauacuuuuaaguuguauuagcuuucuagacucugacuugugucaaaagaaauaccagaagucccaauauacaauucauaaucuauagcacuuacaacuaaaaauaaagacuucaacaaaaacacauaauuuuuuaaaaacucaacaaagauauuagcuaccugaagagcuaauauacugucuacguccuauguagcucaaaaguaaaugaguucagcuacauacaauaacucgacucaaggucaugaauauacuauuguacaauaaaagcaaaucacagaauauauaccggaguacuccuauuuauauaaaguacaaaagcuguuuuuguuuucaggaauacaaaauacauggagcucuaaaaauaaaaguaauggcaaaagaaaaagcaaaacucgggaaagugguuaacucugagggaaugaugauguucuguucuuaaaacaccauagugggugcaaacagcucacaacuauuucuuugaauuuaugcucaaaaaagaagacaaaaacuucaaaacuauagcuugagcccagggguuugaggcuacagugauugcgccacugcacuccagcuccagccugguaacagagcaagaucuugucucggaaacaaaaacaaaaacacaaaaacuucaaaacuuuuaccacucaaaucaugauaccacauauaauuugucacuaauuauagggaauuuaccuucuaaauacggugcuuuuuaaaaagucacauuaagaaaagcaguuuuucuaccaauacauauuauuuauauauauuuaggcaguacaugauauuuuguuacauacagagaacguguaacgaucaagucaggguauuuaggguaccuaucgccucgauuacuuaucauuucuaugugcugcgaacauuucaaguccucucuuuugcuauccugaaauauacaguauauuguuguuaacuacaguccccuuacucugcaaacacugaaacuuauuccuucuaucuaacuguauguuuguacccauuaaccaaccucucuucaucucucccccacacuccccuugccagcucugauaucuaucauucuuucuaccucuaugagaucaacuuaagaaaagcaguuuuauauuuauauagauaacuucaaauauuaaaaucaacauuuaacuacacauugaaguaucacacucuuaacauauaaacucauaacuguucacucccaacuccaagacugcuguaaacauaaacucuauaccagaaacacguuucuaaaauauaaauaacauugaguaauucugacaaauaauuaauauuauaaaagacaucuuaauauuaccugggacaagagucaaagguaaucuucuggguguaauugcuuuggggugcugcuuacuaauuucuucauaaauuugaagccucucuucuaaagugccuauuaucaguaaauaugggugagauucauagcaucaaaacuuuuaucuaugguaaaaugcuaacaaacuucuaaaauuuuguuauaaauaaaacugcauuaacaauauuaaagcugcuuucaauuuugguaaaaaugacauuuaaaacucugugguggcaaaauacuauaaucaguuaagucacuguuuuaaacucaucuccagaaaaauccaaaacuucucucauugcaagauucuaaauacaacccaaaucacauauacaagccaucacagacucaagauaugcugcacuucucuauauuccuuuagcauacaacucauggaaaagaaaaucuuuuuauaacguaggucuaauaacauaaccuacguaaacacgcugaaucaaagaaaccuacauauauccccauaaaagccucaaaggagcaacaguuuuaggauuacgauugcaaauguuuaaaauauaagaagauaaacuaaacuuccauguuaacuuuaacacuuaaaaucuucaaugaaacuccauuauccuuccaaaagauauaaauuacacuucuaacagaaaguuguaucuucccacccaagagacaccuaauuuuauaguaccacauaaaggauguaucuauacauaaacuacauguuacucugaaacaacaauaagcaagcaaauaggaucuggguauaguuuaucuuucuaaaauaauauccugcauaauucacaaagagauuuauaagcaauaagauaauuuauaguggaauuuuaagaaaaagcaaacaaaccuguuuuugaacuauaaaguuuuaaguagauuuuaauccaaauucuguggucuaaaccacagaaaaauaacuauccuaagaauaacccugggugcuagcagacaagguaucucuguaguaaauguaguuuauaaguauugauauucaagauuaauaucaagcaucaagauuguaaacaccacauuugaagaggugugaucucguuuagacgcauuccuucccccaguaauauguuuuggagcuccaaugugguuggauuuuaagaccaaggauaugugugggggguaaaaaaacaaaaacaaaaaaacaaaaaaaaaccucgcucucuguuaaugauuuggagacuucacaaaauauuaaagacccuuauacuaacacauaaaugaacugcauauaaguauuuuaaaaauacucucauguucgugccuaaucguagagaacaacaagcgccaaguaugaaaaaaaaaaauuauccacuacccuagauauaacaagccguauaaauccuacuuaaagucacaaguuggagcuccagaacuuaccacggggaaggaaaggucauaaguuaccuaaaacaauaguguaauuaguuuuguaaucaauacauuuuauaguaaccaagaauccugacauauggaacauauuauucauuuuaguaaaacaugaaaauauuuuuauaaaucguaauguuacuaguuuaaagaaaaaucguaguuaacccauguuuucagccuucacacauaugagcuuugcuguuuucuucagauuauuacuuuaaucaauauugugauuuuaaucauuuucuuaaacuaaauuuuuaacaauuuguaguguuaaauuuuaaacauaaaaagaacaccagaauuaauaccagugaggauacaacaauuaaacuuuucuuguagcuuauacuacuauaaaugaauguggguagcuaccuauuuaccaaacuuuuuaaauuuaaaaauucuaaaaaaaaaaaaaaaaaauucugcuguuucaacaucuuugagccaacuucauaauuauuucaggaauauauuuauucaugaguaaauaugauuuuaggaauauuaacaguuccugccaacacuuaauuaugaaaauauuacaaaaaucuuggacugacacuagaguucugaaaagggucaaaguuaccaaauuucaaaggaagauauguaacauuuugcucuacacaaauuagccuaguuugaaaucaaagcaaauauccucaacaauaauuauuuggcccaauucuuauauuuagagguugaggguaaugaaucucuaaugauuuuaaaauauuaaauaguuacaacacuucccagaaagggaaugcucauuuucuuucccaugucccuacucuaaauugguaugguuuuuuuuguuuugguuuggcuuuguuuuauuuuugccucaccuuccaauacuaucacagguaagggucaaggaaccuaacauaucugcaaucacuuacacuuaaguguaacuauuugaauucauuuuuacucccauguuuaaccuauaauuuuacuaaauggaaaaaugaguacuaaugcuaaaauuauuuguucccaaguauuauuacaacuuuacauuuuauuauacuucaaucaguaguuaugagaaagaggagaaaaaucauuacauacuaauuuguagagcuuuuuccaagccuucauaauaacaccaauuuucugcauuucgaucaaucaaguuuuugaacacuucacuggcuucuuuuaaucuucccaauuucaacaguauuuccccugaaauuaaguuuaaagacauauucauuuuaaacauuaaauaucuaucugaccccagggacuucacuaaacauuaucagugaacagaugguuaaaaagacagaacucuguaugcuuccccuuugggcauguugcaguucauguaacuaagcauagcuugccuucagaagugaaccuucauuuguaccuuuauuuuuggcucccucuuacacuccaaacaaauacauaggacauuaauuuguuaguaaaaaaacuuuugcauuacacacaucuuauacucuuugaaauaaguaaagacacacacaaacacaucaaaauuagauuggcaaauaaugcuagugaaacauuccuaucuuccuacuacaagauuuaaauauaucuuuccuaucaguucauauauuaauucuccacucaauucucauuguuucaaggucacuaaaacuggagaaguuuaacucagugaaauuauaacacuaaacaccacuuuguaacaggaaaccacacaagccauguucauguacaggucagcucagcggguugguaaaaggucaaauccuuuuacuaagccacacaaauuaagaggugguguggaaaaugaggucccagaccucucaaauacgauggaaacacaccuaauccaagauaaaggggagauucucaaaaaagaacauaccucagcuuccugcccucaagauuacccauuccccaaacaaucuauuucaaauaacccuuuaaaaugucuucaagucauacuauuucugcuuucaucauguuggaggaggcaguauauuauagcaggucuuauguacuauuuuuuuuacuauuuuuauaucauauaucacucaaacucuagaauaagacugaacuaggaauaauuaccaacuccaccacuaacuaguuuugugacguggagaaagugccuuugugacagcacacugccugucacaaaaugaauacauauaaaugucugcuacuuaaaacuuuaaacaugccccauuccuccaugauuaucuucuggccaauuuuuacccugcuuaucccagauauaauagacaacagcguauuuuucauuucaaaaaacaucuguuaucugcuacuaccaugaagcaaagguuauuacuagaggaaugcauucacgguguauacuaacuugaauuaauuucacuguaccauauuuacuuuucaaaaacugcauucccuauuugcuuuuauuuugaagauuaaauaaucuaaccuaacugcauucccuauuuguuuuuuuuuuuaagauuaaauaaucucacauauggauuauauugaaugcauuuccuauugaugcuacaggacaaauaccaaaaaagagaaacagcaaccugaguuaagauuuaaucaggaaaugacaauaauauuucagaaaggaaaauaauugccuuuuuuccucuuugcuaccaucaauaaguaacagaacaagauagaaaccagaauauuuaauuauuuacccauauuuuaucaauaacuuuuaaaagugucauuaauaugaauuacaauaaaaacuaaaucacucauguacuauacauuaaccagaaagaguauaguaguuaaaaguaagacgcucaugaaaagguaugggaaaaaaaacauacacuacuaagugaaaaaagccaaucuuucucaggcaagagaugauuuggcaaaaauaaagccaaucugaaaaggcuacauaccguaugauuccaacuauaugauauuuuggaaauggcaaaacuauguagaggguaaaaagaucagugguugccagggguuugcaggagugagggauggaaaggugaaacaaaggauguuuagggcagugaaacuacuuuguauaauacuacaguggugaauacaugucauuauacauuugucaaaacccauagagcaugacagugggaaaggcuguggguauacagggauauaugggaacucucugcaccuuuuucuagauuuuacugugaaccuaaaacuguccugaaaaugucuauuuuuuagaaaaaaguaagggcucugaagucagggaauguguugaugugcuuggaaacuauaacucuaccacuuaaaaagcuggaugacuuugggcaaguccuuaaccucucuaagccucagucucuuccacuauaaaaugggguuaauaaauagcauccaucuuaaaagugcuaaaaaauuaaaugaaauaaagcaauuuaagcaauuaccauacucaaauagaagaagaguuuuaaaaucuauauuagcuauuauuuuuauuaagagcuucagacuucagagguucuacaauuguauggaacuuuaguucuaaacuauuauuuuagcuggacauucaauuuaauacauuauugcucagggaaagggaauuaaugagcaaagcucugugaaaauuuuuguuugaccccuuguugaugaaugcuguuaaaacuauagggauccugucuucauaauuagcccauaaugaaaauaaaugaccuuuguguucaugaugaucccaguaucaucaguuaugguucucacuguauuuaauuaacuauauauggauauacagagauacauauucaauaugaaggcaguguaauauacugcuuaagggaaugaaaucuggauucaaauccagcacucuccaguuuacuaaacuguaugauuuggggcuacucaaucucucaguucccccaucuccaaaauagauauaauaacuacaacauaggguuguuaugaggauuaaacuaguuaauaauggcuuaauaaucguguuuggaaccuugccagauacauaacaacuguuacguaagacuuaggagagaauaaaauauauaguuuuuuuguuuucuguuugaggcuauuaaaaaaaggcaagccaacuuaccuuuaauuucuuccaccaaaaguuuaucacauauuuguuucucauacauuucuauauguuccaaagauuccugcaacagaucugccucucucaucacuugauucugguauaauaucaauucacuauauucauaaucuauuuuguuuggaggaaccugaaaaaaaaugaccaaauuacuuuauuuguauaauuauauaaagcaguuacagaccuuuaauuaaacugccuucucaggagagucauucacauaaacaagaaagcaacccacaagcagauacaaacagaagagugauuaauaacacaaaaaaugaaugcauuauuuaaaacaaauaauagggugggacuucugucuauucccaagugacacaggucaagaaauccuacauacaaauauaaaaaugguugaaauacuauagaaucuacaaaaaaaaaacuacuagaguuaauaaaaguguuuaccaaagucacagaauaaaauaucaaugaagacaaaucaauuacagguauaccuuggagauauuguggguuugguuccagaccaccacaauaaagugagugacacaauuuuaugguuucccagugcauguaaguuccguuggccaggcacgguggcgcacaucuguaaccccaggucuuugggaggcugagguggguggauuaccugaggucaggaauucaaaacaaccuguccaacauggugaaaccccgucucuacuaaaauacaaaauuagccuggcgugguggcacaugccuguaaucccagcuacucaggaagcugaggcagaagaaucgcuuaagcccggaaguggagguugcagugagcuaagauugcgccacugcacuccagccugagcaacaagagugaaacucagucucaaaaaaaaaaaaaaaaaacuaaacuaaaaaaguuauauuaacacuacacuauagucuauuaaccaugcagcagcauuaugucuuaaaaaaaaaaaacacaacauugucaggcacagugguauaccuguagucccagcuagccuccugccucagucucuggagcaguccuagcuaggaguucaaguccuagucguagccuaagaguucaagacuguagugcauagccacagcacuucugccugggcaacacagucagauccugucucuagaaaaaaaguaaaggaaaaaaaaaaacagaaauuggccgggcacgguggcucacaccuguaaucccagcacuuugggaggcagaggcacguggaucacaaggucaggaguuugagaccagccuggccaacaugaugaaaccccgucucuacuaaaaauacaaaacuuagccagacccaguggugggggccuguaaucccagcuacucgggaagcugaggcaggguaauugcuugaaccugguaggcggagguugcagugagccgagauugcaccacugaacucuagccugggcgacagaucaagacucugucucaaaaaaaaaaaaaaaaaaaaaaaaaaaaaagaaagaaagaaauugcaaacaccuaaaucuaaccaucaaaaugucauaauuuuguguucaaaggaaaguuuuuuaucaaguccaccaaaugugauacaguacuaucuuuuggucagaacuugauucuuggauaaaaacaaagaaccagucuaaucaauucucuggugugacguaaaaagcuaaaaaccuaaguaaagacgguggccuuacuacaaaguuuauuuccucccuuaagagaguaaaaauagcagauuaaaaaauauaaaaacccauaaauagaagauacuauuuaagauuucaacaaauuucuagaaaacagaaugcaaaggaggaguaagugaaauaggauggaagaagcucaagucuagaguauccauaaagaggaaauuacuacagagaaugccuaucuguccuggaaaacuccagacagggucaagauuaugaaaugacagauaaacagaggaguggaaaagagacucaagguugguggauuaacucuaagugaagugacucaauccacaccaucuccaucaacuugcagcugaauccacauguagaauauucuccauugaaacguggaggcaggcgugguggcucaugccuguaaucccagcacuuuaggaagacgaggcaggaugaucauuugagcccaggaguucgagaccagccuggacaacaucgcaagaccccgucucuuaaaaaaaaaaaaaauggccgggcgcgguggcucacgccuguaaucccagcacuuugggaggccgaggugggcggaucacgaggucggaagaucgagaccauccuggcuaacacggugaaacccugucucuacuuaaaaaauagaaaaaauuagccgggcgugguggcgagugccuguagucccagcuacucuggaggcugaggcaggagaauggcuugaacccgggaggcagagcuugcagcaagccgagaucgugccacugcacuccagccugggggacagagcgagacuccgucucggaaaaaaaaaaaaagagagagaaaaauaauccuacauuuuaacuguuuccaauuacgucaaaaaguuuucccguuuuccauagguuucaaauacuuuaauucacauuugagagcagggacaauuuagaagucaacuacuccauuuaugaagguagaaggaaacauuaaaauucuuacuugcugaguuugucuaaauucuuccaacaguuuuagggccauaucauaaucuuucagcaaaugguaugcaauagcauauccaauccaggaggcacgcuguguggggcgcaacugaagaagcugguaucuugucuccuaaaaaaaaaguuuuaacuugcuaaauauucucuaaaacauuauuucaucaguuuuaagaaaacaaucuaaccuuuaacacauuucuaaugaacuauaucaacaaagaucaguuucagaauaaaauagaaguacuuuuuauguuuccuaccuaaaauacuaaaguucuacaauacccuguaauacucacugugaggcugucauugaaacaucuuuggggcccaugccuuuggacugccuuauuaaauuacauuuaaauaaugagaauuuuuuuuuuuugguaacuaaauauucuguaagaagacuaagaugguuuuuuauuaaacuacauuuugcuacuuauaaaacuauuauaugaauuacauguauuuacaguguaaauacauuguaauaauuggccagacacaggacagacacagccaggcgaaacacccaaacaucuaauuaucccuuauuuuuacuguugcuucucugucauucccaaauccuuuauuaaagucuaggucaguauuauuuucucugccaacucuuggcguuacccugggcaaaugcaacacuaacguguaucacccaucccacaaccuauccucuaaaucccaagauuuucuaaucuuuaaugauuuucuccuccaccccauucagaggcccacucccacagccacacccuagaaguuacugccacccagaaaucauaaauuuagguaucucacucucuacccacagcucccaugcugccaacacuaucauuugaugacacuccuacccuuguucuuugaccaccagugucuguacuuccuggguccuucacacuuucaccaccagcucuccuuuuuuucuuuagagacagagucucccuauguugcccaggcuggacuaaacuccugggcucaagcaauccuucuacaucagccucucaaguagccaggacuaagacacguaauaccaagccuagcucucuuuuaacuuaauuuacuucacaauccacuuuagcagccauuguuuugccaauauucuuaauuucuaugccucauuccuaaagauaacugauuuuaacuccaaccacaucuaagcugcuaaacacagcugaagaaaaaaauacacgcuuugaagaguggugccauuauuauuauaguaaguucagcagagcccuuaaaguggcugcaaaaaucuaggcaugggguaugagggcuuauauggcaguagagggcaaaaguaagaaguauauaaauaauguauuuaaagaaaacuguuagaaccuaguggccuccuucucauaaguaaguaagagaauuccauguuggacauacugauucuaggauacgaaguggacuaagcacauggagauguccaggagagaguugaagaugcaaaucugaagaggucucaacuacagaaagacugauuuauggcaacccuucucacguuuuuaaaauauuuacuaaccaauaauuuuuaaaagcuacuuuuauguuuagguuuccauuauaaaagccuuauuaguuuaucaaauuuguaaauaucaaacccacaaauaaucuaguacagcagcugcacauagauauuccaguuaaacaguuauggccaggcguaguggcucaugccuguaaucccagaacuuugggagggugaggugggaagaucacuggagccuaggaguucaagacuagccuugguaacauagcaagaccuugucucuaauuuuuaaauaauuaaugaauuaagaauguuuuaaaaaccaguuuuuuuuguuuuguuuuuugagaaaaagucuugcucucuugcccaggcuggagugcaguagcauaaucauggcucacugcagccucaacucuuagguucaagggauccuccugccucaacauccuggauagcugggacugcagguguaaacuaccauaccgggcuaauuuucuuauuuguagagacggagucuggccuauguugcccaggcugguuucuaacucccagccucaagcgauccucccaucucaaccucccaaacugcugggauuacaggcgugggccaccacaccccaccaguuauucuuuuugaauacucaaguacaaagugccacaacuaugacugagaaggaaggucccaagcgacauacaccuucuaaugaacaaucaaaucuacuugauuuuggcuuaugcucaccucauucugaaaugacacgcucuuaaauuuugucuacuguaaaaucauguacauuuaagaaugaaguacuuacucgguaaccuucaaggucucucauuuggaucugcaacagugagagaucccucaaaauuugcagguuaucuuuaucuaauuugagggcauuucgguaacauuuuauagcuucaucauauuuuuuaucagaacgcugcaagaguccauauacaugccaaccuauuaaguuaaggaaacaaagacauacacagacacuagaauauucuaugauacauaucuaauauaaaaguuacauuaaggaaaugguauuuugccugggauuuguucagaaugaucuggagucugggggaggggaauggugaggggaaguuaaagacgaaaccagagcaggcuggguugauaauugucaaauugcugaaccuggguaauggccacaugggaaaggggucauuauucuguucucucuacuuguguacauguuugaaauuuucuguaauauuuuaaguaaccuuaaagaauucuuagcaaaaauucuucacauuuucuacccucuaucccaucacuuuccuaccccagcaacuucaacauucaccuauucuucaucaugaugucuugaaacagaauauauacaaaaacugcaacuacuuuuugaaacaaauuuagucaaccaauucuaaaguaauguguaacuaucaccuacuucccuaguuauauuaaaggccacaaaaaauaaguuguauuucuuauaaauuaaaguauuagcauaucuuggagccaaaagccccacaaaacuaucauacuuacaugcccuucucuucacucugggguaagcacugggauaaagaaauaaguauuuaguaauuugagaaaacucuaagcuaaauaugugaaaacacuacuaagauuauucguguucaauaccaguacguggcuaagugaauuacauguuaacaaacuaaaaugcaagggcaauaugugaaaaaaaaugcagauaaacauacagauaagcaaaaaaaaaaaaaugaaaaucaauuucaaugcuccacccuuuaaaaaaaaauuuuuuuuuggccaggcaugguggcucacaccuguaaucccagcacuuugggaggccgaggaggguggaucaccugaggucaggaguucgagaucagccugaccaacauggcgaaacuccaucucuacugaaaguacaaaaaguagccaggcaugguggcacacaccuguagucccagcuaccugggaggcugaggugggagaaucgcuuaaacccaagagguggagguugcaguaagccuagaucaugccacugcacucuagccugggugacagagugagacucccuccccccaaaaaacaaaaaaaaauuuuuuuuuacacacugggauauuacccaaagaaaaacacaauuauaaagaucaaauuaaguaacagcuaugucucuguguuaacagaaaccaagcucaagaaccaauaucauacuuauauauuaaguaaaaucuguuuuaaaauaaguuuaaguuuuucuucucaaaugucuaaaagaaaguuuaagacacacaaauuuuaacauaugauuaacuaaaagucaguauuuggaauaacaggaaaguauuacccaguuaauuauguuuaagaaaaaaauggguuucaagucacaauuaccaaaguaacuuuucuccaacacuaagcacaacagaaguaagcacauuuuauagagauuuccuuuaaaauauuccaauaaauaaacacgggguagggaacaaaugaaacuaauauaggaggaggggcacaagcaaaaaagaaacuaguauuacaaaauguugauaaugauuauaguugaguaauggauacacagaguucauuaaauucucucuucuacguagguuuggaauuuucauaguacaaauuuaauuugaauuaggaaaaaacuagcuaaaacauaaacuauuuaacuacugcaaaaggauacagacaugacucuugacaucauuacgaaguccuuuacgaacaaacucauaagcuucuucuuuuuuuccuaaacaguucaguguuaauccuuucauagccaaagucucugaaaaauaauuuuuaaacucuauuuacaaaugacacaaaauuauucucuuauucucuuaauaguacuuuaauaguugagaucugaaggauuacuauggcuccaauucaucuuuuuaaucucacaguuugaacuucucuccaaguagaaaaaguaaaacuacauuuaaauauuuacuuaaagcuuagcagcccaaguccuuuucugaaauuccuuaguuucagaguugcuaaaaugguuucugcccuucacaagacucuguaaaagugguugauauuauucugcugaaaaaauuaacaaagcaggccaggugcaauggcucacgccuguaaucccagcacucagggaggcugaggcggguggaucaucugaggucaagaguucgagaccagccuggccaacacagcaaaaccccgucucuacuaaacaaaaauuagcuaggcaugguggcaugugccuguaaucccagcuacuuggaaggcugaggcaggagcacugcuugaacccaggaggcagagguugcagugagccaagauugugccacuguacuccagccugggcaacaagagcgagacucugucuuaaaaaaaaaaaaaaaaauuacaaagcagacaugagucuuaauggaauuaaaucuaccauagcaguuccacagcucuuaccuaaggucaauucuaaucaaucaucaaucugauuuacaaccacacaaaaacacucaaucuaccuuaauaaagacaaauacauaauuuaaaaaucacuaaucacuuuauucaauauuggaacagacuucauuuuugauagcaaguuuauuccaacaaauuauacuuaggcuaauuaacaucaguucacauuucaacagcacaacacuggaugaugguaguggcaacaaaaaacauguaaggaaguuaauaaaagaugguuuaggaugaaauaauucucugaauuauccacaagaagggaauuacacaagaagaaugauuuucaaacucuaugguauucagaacauggugauccuguggcccaaaccccgcuccaacaccuuuuaucuguuuuacauauugaacuuucccacaggcaccauuuggauaaagcuuccacagcuaaaaagcuugaaaacaagcuuuaaaauuaauucuaugaaaugaagauuucuuuccauuuccuucaaagaaucuuuuaaauguuguuggaaaagugagcaaggucagccuauuuucccaauaagaugaucucaaccauuauccaagucugauacugaguaaucucaaccagcuuugcuaugcuacaggaucauuauuuucaugucuauccugauccacccuucuaacacuggcuguuacugaaaaaggacacaaccagaaaauacaaacuuuauuaacaccaguguuagaaaacaacucaaaauauacaaucuaaugguaaauuaguaauaucauauguaaacgucagcacauacuaaaaaaaaacaaaacaaaacacaucuaccaaagaauaaagugcaggugaccauaucuucauacuucuauauugcaaauuuuguccuaauuuuacacacaggaaaccaagguauaaacuuuaaauucuauucaaaguaauaaaggaaaucagguccauaaaaauacugauacauacuuucuccaauuuuuuccccaauagauaaacgaaccauccuaaucuuauccuuaaguauacauacuuaaggauaauacagguaaucuagaagacucauauaaagcauuaaaaaaaugcugaacauuuaugcacucuaauagagaacugcaaggcccuggaaucggggaaauacucuucuuucacuguuaaugccugguuuuagaauuugauuucccuaaagcaaucucucacaugagacaauaccuccauguucagcaaauuuuggguucgacagaaucaucuugcaaaacuugaggccauuuuuguacugcuucuguucauaacauuucuguaaagaaauaugaacaaaaguuauuuuaucaaaugaauacauaauggagcaacuucucacagcaucauauauucuaaacucaagauccaaaauuaggucuaaaaugugauagaaaggauaucacuuacaaacaugcaguguacuuuuguuaccuauucuugucaaauuguucuaaaaucuacauauuuucauuuuuauaaaagaccaugaaaaaagacauuuaaaaaacaggaaauguggcucagcaagguggcucacgcuuguaauuccagcacuuugggaggcaaaggugggcggaucgcuugagcucaggaguucgagaccaaccuggccaacauggugaaaccgucucuacuaaaaauacaaaaauuagcugggugugguggugcgugccuguaaucccagcuacucaggaggcuuaggcaggagaaucgcuugaacgcaggaggcagagguugcagugagcagagaucacaccacugcacuccagccugggaaacagagcgagacucugucucaaaaaaaaaaaaaaaaaaauuacaaaaauuagccagacgugguggcgcaugccuguaaucccagcuacuuggguggcugaggcaggagaaucaccugaacccaggagcuggaagcugcagugagccgagaucaugccacugcacuccagccugggcgacugaaugagacccugucucaaaacaaacaaacagaaaaaaaugacaauucaccaaucaauacugccacagaauuuuuuauuuuguuucccuuuccuaguacacagaauuuuuuaauucaaaauaauuccaaugcuuugggaggccaaggcgagaggacugcuugagcccagaaguucaagaccagccuggggaauaaagcaagaucucaucucuacaaaaaaauuaaaaauuccucaggcgugguggugcacaucugugguccuaacugcuugggaggcugaggugggaggaucacuugagcccacgaggcugaggcugcaguaaggcaugacugugccacugcacucagccugggcaguagagcaagacaccaucucaaaaaaaaaauuuaagcaaaaacauauguggcaacagaaaaauaccagaaacugcacuaaaagccuuugcuaccgcaagaaugaaaccaaagugcaugggugugugcacgcauacacacacacacacaaauacuaccacuuauugagcagcuaugauaugucuguaaaaaauuuguaaucucuuacuuaauaccaauucuuuaauguaggugucauuacuuccacuucagagauguggaaacugaaacuccagagguucaaaaacuuguuuauaagcugcucagcuuagcugcaaacucugaucuuacuccaaagaccaucauuaguccaaugcaaggauaagcaacaucuuuauuuccgaaugccaccagccaggguacacaauuaacaucucucccuggcagccacugaugcgaagaacaccccauugcuuuccacucuucccuggcuuacauuguucagucacacuggguguuaaauuacucaacaugccaagcuuauccccaccucaggccuccuacacuuguguuccuucugccugaauugcuuuccuagaucuucccauggaugguuccucauuauccaagucucacauguccccuacuugcccacuuuaucaaauacucccauccuccuuccuuccccaacauauucucuaccauguuacucuauuuuccacacagugcuaucauuuccugaaaucuuauuuaugcuauuauuuagugucugucuuccccaccaucauauaauggauccuuagaacaaugaucucaccuaucuuucuuauuuauuuuuuagagacagucucacucuguugcccaagcuggugugcagugacacaaucaccauaaccucaaacugcugagcucaagugaucuucccaccuuagccuccugaguggauaggaaggacuacaggugugugccaucaugccuggcuaaauuuuuuuuuauuuuuuuauuuuugguagagaugaagucucacuauguuggucuuuugcuccugggcucaagugauccuagcucccaccucagccucccaaagugcugggauuacaggcaugagccacugcgccggccuuagccuauuuuacauacugcugcauugccauggcuaaacaaauaagaaacugcuccauaaauacagccuacuaaguucaaagcaaaaugccacuagcaauggaugagaccaucuuuaagccuugcagcaggggcuggauguggaaggaauuagaaaagucuucauggaaaaaaaguuuauauugaggccucuugacagccucuggggaagggaacuaggugauucugcgauaaggauaggagagaaaccuaaauuuugaaccaugugaauauacugccuauuccaaaaauauuuuaaaauaaaaaaugacaaucugaguuugacuacaagucugucucacaaaugacaagaaaaaaacaagagaaaggaacuacugagaaagacaaauagaaauacuaguuuuucugacuuaccagguuaucugaaaauaauaauaaucauacugccaauaacaguaauaauaguuaacaccuauuggaagcauuuacuauacguccagacacuguuauuuuuuuccuucaucccaugacagcuuauuuacucuuuauuuaaaucccaggaaagccuaugagaugcaugauauccccauuuagauagagaaacugaggcauaguuauagaguuuauauaacuauuaagugccagagccacaacucuuaaccagguagucuguccccagaguccaaguacucggguaaagacaagucaaccuguaaucucagcuacucaggaggcugaggcacgagaaucgcuugaaucugggaggcagagguugcagugagaucuugccacugcacuccagccugggcgacaaagcgauacacucucgcaaaaaaaaaaaaaagacaaaucuacauucacucaggaaccauuauauacuaagcagaaaugauagauucuagucucaacuuugcuacuaaccagacagagaaccuuagccacuuggucauuuaccaucuuuagguuugucucuuucuaaaagagggcauggaauaccuccaaaauucaacaaacuguaaugcuaauuaauauccagucuggggaauaagacaugcagauacaagccacguggaacacguaaaaaaccagcuggucaguuuguguggauguguuugaauuuuuucaauagaaaaaauuuuacuguugguggcaaagcacuuuaauccacuaaacuuuaaagauaauuuuauuacagagacuucuguuugcuauggaauuuguuguagccaaauuuuacccacauuuauugcaauugugaaaugauaaaaucauucguuuaugcagaauccuccuaaauucacgcaaccuugucagaaacauuacauaccuagauuuaaaaauguuuagcuuggcugagcacaguagcucacaucuguaaucccagcaauuugggaggcugaggugggaagaucgcuucaagccaggaauucgacaguagccuggccaacaaaccgagacuuccaucucaaaauaauugauuuuuuuuuagugguuaccauuucccaauuuauuuggggauaaacccuaccuuuuuuguaauuuaagaauaauaauguaacuuuuuccuuaugacacugauccaugauuugaacuacaaaaaacucguauaaagagaaaagaagugcugucaucuuuaaaguaugaugccaaauguccugaaauccaacuagcgauuuauaaaugauauuaucauuaauguuucagauucccagggcaaaaaaaaauuaaaaauaaaaauaaauaaauuacuucuccaauuccaugcuguguaaaauaaaagggcaugagaaguaaaauaaaaaaauacaaagcccaaugaagcaaccugccacgugcuuuaauuauucguauuuuuaauguucucacauuuguaucuuauuauugguucaaaacuaagcaccacauaauauuuaaaauuuuuaucccaucuacuauguauccuaaucugaagacuaagugugaaguuucuaucgucuugaaacagaacagcuacuaugaauuaucugccgcuguucauacuuaaaauuacucuaaaauuaguauuuuauuuauaguaaaguuaagcaacaacuaacagccauauagccaacccagcuuucaauaaauucaccuuuaaaccuaaaugcauguuuagcaaauaaaagcuuuuuuucaggugaaaagauaaacuagaaaagacaguuaccuacuaacaauauuaguuuaaaaccuaggguagccagaggauacugaggaaagcaaaggaaugcugccucuucuccuuggaagaacagaaccuggaaagcuaccagggacgcuggcacacagcccacagaaaacugcccacccggcuccgcagcggucaucacuacggggccauuauucaggcuucugcuccgcgauaaaguaaaaaugcuccccucaaaugcaaaaccagccaguccacgcggcuuuaauuacucaagcaaggccugugcgacuaaaaagcaaacagcuguuuugaaguuggugacaacucagaaacgcacuucaagucaaauauucacuuccaaagagguaaauaagguacauuacaaacaggcaaacuuuuucccaaagggagguggugccaggccuggcuuccuaaaguugccgguuuuauuuccucguaaccaggaaaaauuccaccaucgcaucgaucccgcuuuaauagguaugcgggugugcugugcaaucuaacuaaacgcaaagcagagaaugcagaacgcaaaacaccuagccgaggagagacuggcaaaauaaaccaccgggggaggaucccugaggggcugcugcgagcccggcgcggcagagagcacggcagccacuaccggccgaggcggcugugcccgggcacugcggagagcggcgugaaguuucuggaaagagcgcggcgggggugaggcgagccgcagaagaccgcggaaaggaagcgcacggaggagcggcucggcagcccccgugggccggccggagcgggaaaguggggucccgcgaccuccgagguaaacaaagagcggugggcagcggaggccaagccuggcccgcgccggccgccgccagaccgcuugcccuuaaggcccgaggacccggggaccggggggcggcagcgcggccuacggccacucaccaagaugcguuugaagagguugcucuccuugggcggcagcagcacguucggcaucguggccggcagggaggcuagguggccggcagggaggcuaggugcccgggcgcuccgcuucgcgggggugggcaccgggacgaaccgcugcugagagucgggcugcgggcgauggauuaguucauuggucuacaguugcaauugggcagccuggcuguucggcacggguggcaauggagaaggaaggcggucugagcaggacacgcuuccccugggcuccgcuuuuuggccagcggcggcggcggcgguucccgcgcacugcaagauggcagccaggguccgccucccgagccggauccugugcgcaugcgcggagcgcccuuu

SEQ ID NO: 192517 - RNA, 47198 nt, Homo sapiens
uaucagcuuauuguuuauauaguguggaauucauacagcaaucaaagggcuuuacugucuguacccagaugcucauuguuauugaaugacucauauucuucauaauuuuuauuuaaaaguugcagucuaagucuuaacuuuaacaugauuaacaguauuaugguuuuucuuuauguuuugaguuuuuuuguagacauggggucuauuuugcccaggcuggucucaaauucuuaccucaagagaucuucccccuuuggcccuucaaagcacugggauuacaggcauaagcauccacuauaggccaagguacuuuguauuuaaauaaaagguuuauaaggaagucuaaaauucauauuuuacuaaauuuuaccauauuuuccugaaguaguagauuaaaaauauauuuaaauuaauucauagauggcuggggaaaaaaggcauauaaagagaacaagugacuuguccuaaaugacacaaucaauucucaauacuuucucuuuucaaugaugcaugcuuauuuucuacuugaugaguuggauuguacuuuacaggaaaccuaaaauaaauucuuaggucaggaaaugugacuucgauuaauuacaaaacauauauuuauguguaauguguucuuaaagcuguaauuuacaaauauucauaaugauuuccaagcuucagucugccucuugauauagguccauuucauuuauauaaucauaaauaauaauaaguuaguauuuauuuugcugauuuaagguguucauccaaaaguucagcaauggcuucuucaucugcugauugaagcagucucugaauuagcugauccaggcccuucccaccacauaaaaauuccugguaaaagagagagcuauuaugaaaccuaaugauuagaaauauaagcaaagacuuuaguguuuauuuauuuaauuucuuugcagucauuauuuaauaacaauaaaggauuacuaauguucuguaauacaaugaacacaaucgcuaacuugggaagauccccacucuguagaagaauucaguuagcauuuuauuuuaaaauaaaucuucugagauuuggauuuuccuaacaacuccagagacaacaaaacaaagagaucuagauggacuuuugaaacugaccaccucccucccuuuaaaauuccacugauuggcuuuuaugacaacaccauucuaggcucucaaaccaucuuuaggagaacggguuugcuggauuuucucuuauuguacccuaaaaaaaaaaugcuuuuauucuuguccugaaaauucuacccuuuucacucacauuauguuauuucccagaggaaaaagacugaaaggucucaauuccacaagcaauuuguuccacaagcauuuugugcauuaaugcacauacugcuccuugccaacuccucuggaucugacugagaggaagccucccccgaccauucaagcucacccuucugcuaauccucaaaguuuagauuauuucaucuguaagugguuuaugauaguuuuuuauuuuuaaaccgaaaacaugaugaucuagaaguccuguguaacugaaaaauauuuuuguugaaauauuuaggggugaagugucuuugaggucugcaauuugcuuucaaaugguucaagagcaacacagguuuauagagagacagaggaaaugguggggggaaagagaaggaaaauacaguaaaauauuaacaacuguugaaucuagguauagucuauauugugcugauugacuaaucuuuuuuuuugagacuggcucuugcucugucgcccaggcuggaguauaguggugugaucucggcucacugcaaccucugccuccugggcucaagcaauccucccaccuuagcuucccgaguagcugggacuacaggcacaugcuacacacccagcuaauuuuuuuuuuuuuuuuuuuuuuuuuuuuuguagagauaggauuuugccaugcugcccaggauggucuccugagcucaagcgauccucccaccucugccucucaaagugcugggauuacaggugugagccacugugcccagcugacccaaucuuuaaacauuauguaaacuugaaaaaguuugaaauaaaaaguugagaaaaaaaauuuucauguuuaccacuaaauaacuccacugggugaaaacuguuuugaguugacuucccugaagucucgucuacaguucucugaaaaaugacuaaauuaaugacuucaagaacuuuuccuguauaacagaaauucuguguaguaaaguuguugggauuaaugaauuuguacauugccauuuuagaaaugcuugaaauuuagacacuggcuuaaugaaaauacuuuaauguuggcaucuggaacacaaaacauuuaguuuugauauaguuaugaacuaaucuuauaguuaagucuuucuugaauggucuuaaaguugaacuuuaggaaguguacacacacaucucucaaauuaagguaaaggauauaucuuacuauuucuguauuccccaaaguaccagcauauaguaaaaccucaaacucugaaauuaaacagaaagcaaaaacacuaugauauaacuuuaaaauuaagguuuauaucacuuugagcaaaauaugaaauugcuuuuaaaaucagugugacuaggccaggagcaguggcucaugccuguaaucccagcauuucgcaaggcugacgcgggcagaucaccugaggucaggagauugagaccagccuggccaacauggugaaaccccgucucuacuaaaaauacaaaaauuagccaggcgugguggugugugccuguagucccagcuacucaggaggcugaggcuggagaauugcuugaacccgggaggcagagguugcagugagccgagauugcgccgcugcacuccagccugggcaacagagcaagacucugucucaaaaaaaaaaaaaaaaauguaccugguacucaaauuauuauaguauugccaagguaaucaucuuuggaauugauguaaaaggauuaucccucuacugggagucaaacacauuagauucaacuggauuaaccagagugcaggagauacaaaggucaaagaugaaugagucauaguuccuaacuuucagaggcuaacagucuaaguagaacagcuagacaaauacauaagcaucacaaaacaauauaauaaauuaaaaaaugaaggagaagaaaggaaggauuguaaggaaccaugaauuuugaagaaagguggcaucagggaaagauucaggaagccagaaaguuuugaauuugguuuuacaaagagaauaguauuuucccgaauagaaaugagcugggcauuuccaucaaaagaaggaguauuagaggcugggugugguggcucacgccucuaaucucagcacuuugggaggccaagacaggcagaucacuugaggucgggaauucaagaacagccugaccaacauggggaaaccccguuucuacuaaaaauacaaaauuagcugggcaugguggugcaugccuguaaucccagcuauuccagaggcugaggcaggagaaucgcuugaacccagcagguggagguuguagcgagcugagaucacaccauugcacuccagccugggcaacaagagcaaaccucugucucaaaaaaaaaaaaaaaaaaaaaagaaugaguauuaggacaggaaaacugcugggggcgcgguggcucaggcuauaaacccagcacuuugggaggccaagguggguggaucacuugaggccaggaguucgagacuagccuggccaacauggugaaacuccuucucuauuaaaaacacagaaaaauuagccaggcauggugguacacaccuguaaucccagcuacucaggaggcugaggcaggagaaucacuugaacccaggaagcagaggcugcagagauuccaccacugcacuccagucugggcaacagagugagaaucugucucggaaaaaaaaaaaaaaaaaaaaaacaggaaaacaaaguacauuuaaaucucuaaggccaggggaaauuuccaguguaacuggaauauagagcaggagauaaggcugaugucaagaaaucugcacaaggacauugagaaacaauaaaaaugugaaacaauacauuauaugguagucugugcuuauuagcucgauaaauaaaaguaagaaaguuaccuaacagaagaagucauaaugagaauaccaggugaucucacagaauccaaggauaggaauguggaaugugcagggucacgacuaccacccguggaaugagacugagccuugggaauaaauaaauguagggacucauaucaucaggguucuuucugucuauuucucauuuuugcuuuucucuguguaucaauuucauucucuucucacugaagaugcuuucucuugguggcugaaaauguggccucuaaccucuuacaugcuuuauauauugcaguuucagccaccaagagagagaauaauccucuccaucucugaucuuaaaauccugggaagaaacucacuggcuaggacuuauuuggguguccacuccaaacaaauccacuuuuguccugggucaggaucacgaucauguaagaaugcagcagcucugucagaaacuguggaugugguacgaagggcaaguucuagaauaagggaggaaagcuaggcaaaaaguuccaaaaacgcucacauucuuuccuaucuaccccuuccauuuguccaacagcuguugcccugggguuaagauccuuaucacuuuuccagcuucaucuaugauuugguuccuaaguuauucacucuuuuuuuuuuuuuuuucugagacagagucuugcucugucgcccaggcuggagugcgguggugcgaucuuggcucacuacaaguuccaccucccggguucaugccauucuccugccucaaccuccccaguagcugggacuacaggugcccaccaccaugcccggcuaauuuuuuuuuguauuuuuaguagagaugggguuucaccguguuagccaggauggucucgauuccugaccucgugaucugcccaccucggccucccaaagugcggggauuacaggcgugagccaccgugcccagccaauuauucacucuuacuagucucuuuacuguccuucacacagauuuuaauguuuuacuacagcuaccuuuuuucaugcuguuuucaaacuuuguuccuuucacuacuauggaaugucuucuuccaguagacuaguuagugauuauuagagcuuaccaguguuauuuuccuuauuacuucugagucuggcaugcuaguuugguuagugauauauuauuauuuaggccaaagucagauauuuuauaacuacagaagccaguuaguuaccuucccuuuguuucacaaccgaauacuauacuaugcaccuauggucccaucuaaaagauauuacuggucauaagaauguggcugucuccgaaaaaauugucacuacuagaaaaacaacugaaagaacauaguguaauuagaacaauauggccaaacacguuucguuaauacuguguguuuccggaggaaagggaaauuagcaaauauuuuccuccuuuucaacauggcuauguuccuaagcaagauagccuuauccugcugaggagacagaggauguggcauaagacauacagaaauugacaaacauauuaaccuuguauaacuaggacuuuuuuacaagguauauuucccuuguaaaacuaggacuuuaauuuugagaauaggaugggacagagucaagugaaagaagccuuagguaucacauggcaccaaggaaaaacaucaaagauuucugucugcugccuuuuccacauaguccuuuaugggaccaguucacuuucuccuucaguggcaacaaaaaagacauuuuucugugcuucaucauuaauauauuuauauauuuaugucaguggucuuugcuggaugcgauuuagauagguuaauguucaaacaaucuugaccgagucuuuuccccaacagccuaacuguaacaccucaaucuaaugaagacacauugugguagggagaauucuaagaugcccccugguguacacacugugaauaacucccucucagugcagacaggaccugugaaaaugauggaguaucauucuagugccuaggugacuaagcagcugacuuugaguuaaucaaaaggaacauuauccaggugagcuugaccuaaacaggugagcccuuaaaaaggcccgagucauuccugcaagaagagauucaaagugggagagagucucuggagguagccacugggaaacaacuuccaacaguauuuacgcgcugaaaagcagccuccagcugacugucagcaagggaaugggggcuucaguccuacaaucgaaggcaauggcauucugcuggcaaccacauaaacuuggaagaggaccccaagcuccagaagaguauggagccuggccaugccuugauuucagccuugugagauccugagaagauaacuaagcucaguugucccuagauuucugaccuacagaaaucaugagauaauacuuuaaucauggguacugcuuuaaguugcuauauucgugguaauuuguuaccugucaauagaaaaccaauacccauguauauaugcagacugaauauacguucaugcauugugauugcauaacgaagaauuuggaauuuagaaaagaccauuguuucaaaauggcauaaagaucauuauuuuuuuaaccagcaaacuaauaaaaguguuuguaaauuuuaggguggcuuaaugauuuaaauuacuugguaauauuuuagauauacuugguaauaucuacauauauguucuagaauuugacuauauuuucuucugaaaucaaagguaggcaaagcauacucaguaguauuaccuuaauaucacgaacuucauaugcuauccuguggucacugacucuauccugggugaaauuauauguccgaauucgcucugacugggcucuuguucccaccugugccauaacaaaaagcaauuuauauuuuaccuuuauaaaugucuucauuacaauggaaaaagcacuuggcaaaugaccauuucaacaauuuagauacuuucuaaaagacauauauacaaaaugacaaagaaaaagaaugggcagaacuuaauguuuaauacuacagguuuguagagcucgguuauagaauaagaaggaauguuucuuugauauuucaaacuccaaauccuuaaaaucaaauuaaucaucuuuccacuccaaucaguucccccuccugguuucuauaaaugacaguaccauguauucucuuuuauccaaguagaaaauucugacauucugcaauuuaucaaacauuuugugggucugaguuuacuaugccaggcuuugacaaagaugcacacggcgggagagaccaucuucaguucaucccauucuccaacugcccauuuccaauugguuucaugggucucuuauuauauccugcccuuuccauuucuccucucacucauggacucauuacuuucaccuacaauucugcaaaaaucuccugauuaaucuccaauuuuuuugcucacauugugcugcccugcuuacucuuccuacaguacaguuuucugauaaauuuucuuugguuccuucuugucuacugagcagacacaacucaacucagcauucaagguacuuuguaacguggccaaucuucccaguguuauuucugaaaauuacguuaaucuccauaaugccacuaauaauacuaugucauuauuaugugugugucgguuaucucugcuauaaaacaucaucucaagggaugcccuucucuaauacucuccuaccauuucugccuuucuggccccagcaauugaaauacauucucuucuucccugaaauccacuguacuuggaauguucuucauggcacaccacaguuugucucaugcuacaguuauuugcauucuucuuagucugcucaucuccuccaccuccccaacacccgauauacacagcacccugugucaauugcugucacuuuuuaaaauaagauauuucuauaacuuauugucuuaaacccuaaggcaagugauaugaaacuaaacuccugaccauuagaagaauuuuuuuaaauuauggauuccuaagcccaaccucagauauaauggaucagaauuauguauuuugagaacaucccagaucaucucuucugacaaucagccaaguuuggaaaccacugucccaaagcaccauauuaauggccaggaccucacuccagaucaguuacaucagaaucucugggguggggccugggcaucuacgaaagcuuguuaggugaucaguggaaccaggauugggaauguggcauaaugccuucuguauaaaagccaaguguauaucuugguugaagaaaaaaacuucuaagccuuagaaaucccuauuaaaacauuucagguagguggauaaguuauucaagaggcagugacgucuuuuuuggcuugucaaucagacuacugaagaagacacaugaacaauuugcauaaagccaaucuugaauaccuauuuuaaaaauuacuuugugggcugggugcaguggcucacaccuguaaucccagcacuuuaggaggcucaggcgggcagaucacaugaggccaggaguucgacaccagccuggccaacaugacaaaaacccaucucuguaaaaaauacaaaaaugagccaggcaugguggugcaugucuguaaucccagccacucgggaagcugaggcacaagaaucgcuugaacccgggaggcagagguugcagugagccaagaucgugccacugcacucuagccugggugacagagagaaucugucucaaaaaaaaaaaaaaaaaaacuuugugcaacgccuggugccaaaauguuaaacggcaaguaaauccaaaugucuuuuuaaaauucaaauguggcagaguucauagugucugugguuaucacuuauuugccaagaagugaugguguguacccaggguauauuguuugcuuguuaaaagcaaaaauaaguuaugguuuguaaaugagcauuccuaucugcaaguguauacacugaugaugcacuacaaucugggauuaccacuaauaguguuaauauuauuuauccugucacuuuuauuaccugcaaguuagcguguagguaaagaaagcuagaaacgugaaagugugaaaaagcuaggauacaucuagaugaaaaguauaacuaaugcuuagguuuagacaauucauuauccuaaaaggccacaaaaucuuccaaauuuaaauuacuguagcauagccagguguaguggcacgugccuguaaucccagcuacucaggaggcugaggcaggagaaucgcuugaaccagggagguagaggcugcagugagccaagauuacgccacugcacuccagccuggugacagagcgagacucugucauuaaaaaaaaaaaaaaaaaaagaauuuaaauuauauauuagguuuacuuaaaauaaugacauuuauucauuuugcuuagaauucaucuauuuaucuauuugaaaaaguaacacuauaucauauauauuguacaaaauucaaaaaguaccaaaugguacauaaugaaaaauaaauuuccuuucuaccccuugucccuagucuccaucaguaguauucacuguucccaguuuuuugcagugccauuuguauuugaucucacauagaguuauaguacaagcauagguuuuaauuuuuagaaauaaaaaacguucuuaauucucaaagaauuauuugucuuuuaaaccguuuucuucuuaagacaguaaugauauaaacacaagagggaaacaacuaggaaauaauuuuuaguuuauacaucuuacauuuacuaacuugcaaacugguaugcccaaguuuagccauaacccaucaguucauuuguacugaguuacugcuuauuuacaaaggagcacauuucucuaugcucuaaaacauucccauuuaagcaagaacaaacacugcauucucuacagaaaaugacuuuucuuuaaacagucacuaaauuauuauaccaaguaaaucuuaccugcaguuuucuagcacuuuguugcugacgcuugucuuucucaauaaucugcugguagagucuagcucucaacacacgaaaggcuauuucuuuauuuuuuaucugugaucuuucuuguuggcauucuacuacuagcccugaaaaauaacagggaucagaagguaaacuguagcuuccaccaaauuaagauagaaccaaggaacaguuaaaugagacagguuaaucaggaaaagaucacaaaagauacaaacauuuuagguuuagcacacuucagaaacuagcuggguuaugauuauagcuguaguuggcucuuuagauucugauauguaaaugagaacuccguaugagcacccagaaagcagcagcauccacagaugauuaccuguccuuucaguccccgagcuuggccucuuccuccuagcucauccgggcauuucugcagcucaacaaacagcaaacuacugcuacucccuauacugcgcugcuccauucucuguccaacucaagaagaacuugccuuuuccccuuucagucacaaauauacacagagcugagguuuuaaaaauaccuuuauaauggcugggcgcaguggcucacaccuguaauccgaggauuuugggaaggcaaggcggguggaucacaaggucaggagaucacgaccauacuggauaacacagugaaaccccaucucuaaaaauacaaaaaauuagccaggcgugguggcaugugccuguagucccagcuacuugggaggcugaggcaggagaaucgcuugaaccugggaggcggagguugcagucagccgagauuaugccuggugacagagcgagacuccguuaaaaacaaaaacaaacacaacaacaaaaaccaaaaaaaaaaaaacuuuauagaaaaaagccaaugaaaagacgcuacucagagucuuuaaaaagaagaauuuauagugaauguuucugaguuuucugaguucuaaauuucuaaguuguucugcguagucuaaguuagcugggguccagcuaaucaauacaucuaaccucacacaaguuuuggcuagccagcuucugcauuuggguggguuuggcccacuguguaguccaguuccugguccaaauccagcucugaaacgaucacuucuugaggcuguguuguucuuaacuuugcagcuaccacucugagguccgugucaaauccugcuccucaguacauuagaggagaaagggauuuucuuucugaaucacagaaacuaaaaaccaaaagccccauuagcuuagccuaucugcaccgauacagugguaaauauuuugcuggagauguaaagaauuucuauaaaguucuauucucugaacuauguuuucucccugucuaaauaagcuacagucacuaccugcuaauacuuuuaguagggcacugagguuucaccucuacuaguuuaaucacuuccugacugcuuuacugcagccaucugguuggacugggggcacuggcuggcccccaucuuccagguauuugucuggaguuuucuugacucucguauccuuuuuguacuacccaaaagaauaugaacauuuccauuuuaagacggccaggcuuucaugagcucuccuccacauuccucuucuugucagcugaucuguacugauuuuugccuaagcaccuguauuauuccuaucuacucacucagguuagaacuuuuagaucaaaacuauuacuuuccagcucaguaauuccuaagggaaucacuuuauuauguauuuuauuauaauguacuuucuauagaggaguauuuaauaaugaguacucccuuaagaauagaagauguagagggagggaagguguacugaauaauagaagggggcugggcacgauggcucacaccggcaaccccagcacuuugggaggcaaaggcggguggauuauuugaggccagaaguucugagaccagccuggacaacacagcaagauuucgucucuacuaaaaauacaaaaacuagccagcgugguagcugcaccuauagucccagcuacucagggggcugagguaggaggaugacuugagccaagaguucgagguuacagucagugagcuaugaucaugccacugcacucuagccuggacaacagagcaagacccagucucaaaagaaagaaagaaagaaaaacaaagaauuacagaggccaucuuuuacucaccaacugguaauaaacuaaaaaaagcccacuuuaaugcacaaaauauucauuugucuucauccuuaucuugggauaaauuuucccaagaaagguaauauuccccuguauaaacauuuaaccauaccccuaugaauaacucuuccaaugguggaaaaugaaauuaucuagaagcagugguuagaaaaaaaauacgauucuuccaugacauggagaaaauagaagaaugagcuauauaguucucacuuugaauucuagcagggacgguuccuagucuaaggucuuaguauggaagaaagaaugggagaaauggaagaaaggcugaguuuuccuugaagcagaugcugaaaccauggcaauccucaaaauauggaagaaguaggcugaagaaaucacuuggucauaacugcauggcuucauaaggguuaggucuugacaugccuugcuugccuaaagggaagguuugaggguaggccuucaggccucuuugaaaccaaagacucagaucuaaguggcuaaaaaauaauuggcccaagguaagucuggcagcacaaugauaagucacuuucuuuucccuuuauuguuaguugacauguaauaauuguacauauuuaugggauauagagugguauuucgauacaauguggaaugaucaaaucaggguaauuagcacauccaucaccucaaaauuuauuuaucauuuauuuguguugugaacauucaaaaucuucucuucuagcuuucugaaaauaugcaauaaauaaaucuauauuaaccauauucaugcuauagugcuacagaacaccaggacuaauuccuccuauccagcuguaauucuguauccuuuacccaaccucucucuauccuccucucccccuuacccuuccuagucucuaauaaccacaguucuacucucuguaagucacuuuuuguaaagucagcaauuuauggcuacauagggugguuuuacaacuuguaaguuuuaaaguauucugguuugucagaguuuugaucaccuuuuacccaauuuuuuacccauuuuaauuuuuaauucaucuuaagcuaauuauuacuguucuggacuguguauaauauagaaugauauccaacaauacaggguuuaggugaaacacauuaaguauucaacaauuuauggacuguugaaauaaauuauggcaaguuacaaaaaguauaaccucaggacgggcaugguggcucaugccuguaaucccagcacuuugggaggccgaggugggcagaucacucuaggucaggaguucgagaccagccuggccaacauggugaaacuacgucucuacuaaaaauacaaaaauuagccaggugugguggugcacacccauagucccagcuaccugggaggcugaugcaggagaauagcuugaacacuggaggcagagguugcagugaaccaagguucacuggccacugcaugccagccugagugacagagcuagacuccaucuaagaaaaaaaaaaaaguauaacuucauuuuuggggaaaaaauggcauauuuuuauauguacagaaaagaauuugaaaggauguauaccaaagauauaugccaacaaugguuacuggguuauuauuacggauguuuuauguucuuuugcucaugcauauauucuuuucuuuuuuuuuuuugagacggaguuucacucuuguugcccaggcuggagugcaauggcgugaucucaguucacugcaaccucugccucccagguucaagcaauucuccugccucagccucccgaggagcugggauuacaugcaugcgccaccaggcccagcuaauuuuguauuuuuaguagagcugggguuucuccauguuggucaggcuggucuugaacucccgaccucaggugaucugucugccuuggccucccaaagugcugggauuacaggcgugagccacugcaccgggccuuuuuuuuuuuuuuuuuaacaguuuccuauggaauaaaaaucaauaaaggaaacaagagaaaguaugaaauuauccuauuuuggauauuuagguuguuuuaacuuuucauacaacaaacaauacaagcaaucauaaucaugucugacuucaagaugguuucccuuuuuuuuuuuuugagacugaguuuugcucuuguugcccaggcugaagugcaauggcaugaucucggcucacugcaaccucugcuuccuggguucaacugauucuccugccucagccuccccaguagcugggacuacaggcauacacuacuacacccagcuaauuuuuuuguauuuuuaguagagacaggguuucaccauuuuggccaggcuagucucaaacuccugacccucaggugaucugccugcaucagccucccaaagugcugggauuacaggcgugagccacugcaccuggcccccaccccgcuuuuuuuaaaucacacuacaacaagaacaaagaacagaaacacaaacuccaucugaaauaaaacuaggugauauauauaauccccaaacaugaucuauuaaagacagaaaguggauggaagaaugguaaaugacuuagcagcuggaaggaaggugagacuuaauucccuguagagggagaugcugaccagaaacuggccacuuugcccugcuaagugccagaaaggcucagaaauagagacaccagguauuucagaagucaggcuugaggagcuagggcuaaauacagaaagccuauaauaacaaauagauccucaagucuccuuccucaaucugcagaaggcaggagguauauuucuggauaauuaaaucaggaaaauuccagaccugggacuaguuauaagggagggcaaguauggaguaugggcgggaagacaagaggauuaaguaaacaacugcuauugaaaggugagaccuugacuuuacucucagcuguauccuggaagauccuucucaggagaaaacaaacucacaagagaaaaggucuacagauauagacaucugggggucccuaauaaaaaagcugauuaauccucuaacugcuccacaguggaacucacuaauggguauguggauaagugcacucagagcuucagaaucuggcucuuaaauauguacagacagccaagaauuccuagaaauuuccaacaugaaaguaagaaugggcugaguguaguggcucaugucuguuaucccaacacuuugggaugcugaggcaggcagaucacuugagccgaggaguuggagaccagcuugggcaauguggagaaaccuggugucuaccaaaaaaaaaaaaaaaaaaagcaaaaauuagccaggcaugguggcaagcgccuauaguuccagcuaccaggaagcugggacgggggaguggugcugaggugggagggucaccugagccugggaaagucacagcugcagugagcugugaucacaccacuguacuccagccugggcaacaggccaaggccuugucucaaaaagaaaaaaaagaaaaguaaagcaagaaugaaacaaaaauaaacucagaagaaacagagacacugcagaaagcagaagagaacuucagggaaacuaaaauuaauauccuucaguaauaaaaaaaagaaauaaguaucaacaaaauaagaaaaggaugcuaugagaaaacaauucugagaacaagaaagagcucucaaaaguuaaaaaaauaauuuuuuuacaaucagaaaaaaggguaggaaaaagaacuaaaaaacaaagugacagacaauaugaggaaaaaacaaauucaagaggucuaauaucuaacuaauagaaaucccaggaagaauaaauaaaauguuaugcaagaaaguauugaagaaaguauuucagagcugaaaggcaugagucucuaaacugaaagcaacaaauacaaggaaugaaaaagacuuucaauguucuaaggggaaauuauuuccaugaaaugaucgaugaagugugaaguuagaauaaagcuauuuucagaucuacaaagccuugaaauauuuacaugucacaaaucuuuucucaggaagccacuuaaagaugagcuuuguuaaaaugacagaguagcaaagagaaaagaugauauagaacccaagaaacgggaggauccaacacagaacagagaugaaaggaacuccccaacugcugaugaccaggacaaccccugugcaauguccuggggagcagcugguccacacugaagcaagaugauggagugcucugucauggagucuccagagagcacuggagugacuucauuuuacacaacuuuuggaagauguaagcagacucagagucaaagaaaaguaggcaaaugaaaaaucaaugagguaauuauuaacucuaggaaaugaaaucacaggacuguauacuaaugggcucagcgucuaacacuaucuguucauuauaugaacacagugaaaauuaauuuugccaaaagauaaauauuuggaagaagaaaagguauauaagaagggcaaaauucucaucuaccacauuaagauguaaauauauaaucuuuauaguuggucagaagagcaauauuugccuauuauuuagaaauacugagguaauuaccagaagaaauagcuaaaagagguucauuuguuuguuuuuugcagcuagagaagugaguaaaaagaauuuaaagugguugucuuuaggaaaugggaacugagaguagaggaaguaggaagagggugggaacaaguccagagagcuguugguuuuuuuguuauaggacuuugccauuagacuuuuaaaaccauauacaugaaauguaaaaauuaauuuaaaaaaauuaaggaguuaaauaaaauuuuaauuugaaaaacgguaggaauauuuaaaaucacauuacggacagcaaaacuaccucagaguauaccaaaauuaccaauauucaaaauaaaagcauuagugcagcaaagccuaauggaguuagcugucaugcuacaaggugacagaauauccacggugguggccugugcaaggcugcuucuguguuucaucuguauuuaggcuggggcaccucuguuugcucacucccauccagcauaccugggaagcuucccugaauaggucugcucaccgucugcaucuuuucagaaaggaaucuuuccaaacagaagggaaauaugaacacaauagccauccugauccacaaccccagugacauuuuuaaagagcugugcaaggaaccagacacucauauaggacuauuuccuuccaaaugcugaguaagauggaaaaaggguuaaaaguacaaagccaaggggcuugcuuaccuguggggauguggacaagucugacggcacuaucaguuuuauuaacaugcugcccuccugcuccuuuggcucgaaauguaucuauucgcaaauccuugggguccaauuucacauccaccuagaacagaaggcauggcauaauucuacacuccgugaauacuuuaauauaaaaucgauuccaagauuuuucaaauaaacuguauuguuuuaagauaaauuauagccuuuagacuaagagaaguaacuuauaccaaagaaagagcaauaaacuccccauuccaaugggaugcuauuuuuuguuuguuugagacagggucucccucuguugccuaggcuggaguauaguggcacaaucauagcucacuguaaccucaaacuccugggcuuaagugauccuccugccucagccugcugaguagcuaggacuacuggugcgcacuaccgugccauguuaauuuuaaaaauuucuuguacagauggggucuugcuauuuugcccaggcuggucuugaacuccuggccucaagcgauccucccaccuuggacuuccugaaugcugagauuacagacaugagccaccacaccuggcccugggauuccauuuuuaagcacugauuuaggauguuaugagaucacugaguuuucaaucuuucaaaaguuucaucauucaucaucccaaaguuacauguaagaaaaccccaaaaauauauaaaauacacacauauauacuauauauuguugauucucauuauugucagaaugucuauuugcaaauuugccuacucacuaaaauuuauuuguauccacaaaucaacacccgaggcacuuccacagucauuugcagacaugcauagggcagugaaaaauaugaguugcuccacauuugcccauugccagcugaaguaggacaagguaacacucugccuucuuguggcagcucuccuacagagaugaccagagaauggagguguagggggcagagcagagcagugcucugguucuggggccaauuuggacuggguuugaaucugaacucuagcaccuuuuaguggagcagcaucaggcaagucaccugacacuccugagccucguuuucucuuuuguaaaguauagagaaucuaccaggauggguuauuuuuagaauuuaagauuauaaucuaugugagcucaguguguguuuguguguguguaugaauuuagcuaauuuuuuuuuuuuuuuugagacagggucucacucuguuccccaggcuggagugcaauggugcaaucauagcucacugccaccuugaacuccuggacuuaagcaaucuuccugccucaaccuccugaguagcugggaccacaggugugugccaccacgcucagcuggauuuagcuaauauugaaccauuguuccuaacacugauuuaacaaauacugaaccauuacugccaagugguucagaaucuacuaaauuaguguuugcugcaacuuuacagaacauaacuacugggaauaaugaaaaucaacuucauucgugcauguguguguuuauuagugauugaaagguggcucccaaaaagauauguucauauucuaauucauggaaccuuauucggaaaaagguucuuugcagauguaauuaagaugaaauuauccuggauuaucaggauaggcccuaaauccaaugacaaguguccuuauaacaaacaacuaaagacaguaaaggagaagaccaugugaauuugaagaguguuaucguuucaagccgaggaacaccuggagcaaccagaagcuggaagaugcaagggaggauucuccccagagccuucagagaggcacaacucugcugacaccuugauuuuggacuucuggcugcuagaacugugaaauaauaaguuacugcuauuugaagccacuaaguuugugguaauuuguuacagcagccuuuggaaacuuauacacagacacagacacacacacacacagaaacacacacacacaaauaguuaacgaauauguuuuuauuuuguuuguuuuuuguuuuuuuuuuugagacagagucuugcuuuguugcccaggcuggaaugcaguggcgugaucucagaauucacugcaaccucugacucccagguucaagaguuuggaaacuuauacacagacacagacagacagacacacacacacagacacacgcacacacacacacaguuaacaaauauuuuuguuuuguuuuguuuuuguuuuuuuugguuuuuuuuuggagacaagagucuugcuuuauugcucaggcuggagugcaguggcgugaccucagaauucacugcaaccucugacucccagguucaagagauucuccugccucagacucccggguagcugggauuauaggugugugccaucacuaccagcuacuuuuuguauuuuuaguagagauggaguuucaccguguuggccaggcuggucucgaacuccugaucuugugauccauccaccuuggccucccaaagugcuggauuacaggcaugagccacugugcccggccuacaacaaauaugcuauuuuuuaggggagagcuaacauuuuguuccacauucaucauuuauuagugugaaugacagaaagcagaugugacuuuucucuuugaaaaguaacuaguaacugggucaaggcuggaaucuaauacacuguuuagcugauuguucuuuuguauguuuccucucaaaugacugcaacacagugaagaaaaugauuauacagcuuuuguuaauauauguuagaguuggcugccuuaagacaucaauaaauacugaagagauaagagugacuuaccauuucauguggcuauaguauauuaaguaguuacauagaaaauguguggauaucauaugucacauucucccaaauguuacagaaaugaucuaaugacuuuuggggaacucuggauacagaaauggugacuuagggcagauaaagcauuuuaaaugucaguuaagagaacauaaccuuguacuuuuagaauagugaaaugccacugaaugaguuuaauuuucaagaauauaaaaacaggcccggcacuguggcucacgccuguaaucucagcacuucggguggccaaggcaggcagaucacuugagcucaggagguucaagaccagccugagcaacauggcgaaaccucgucgcuacaaaaaauauaaaaauuagccaggcauuguggcacacaccuguagucccagcuauucaaaagguugaggugggagaaucacuugagccugggaggcagagguugcaguaagccaagauggggccacugcacucuagccugggugacagagugagaaucugucucaaaaaaaaaaaaaaaaaaaaagaauaugacaauaaaaacaggguaagugggaaugggguagaagaaauaaggauugaagcaagauaacucuaugguuuugcuuuuuuaaccauguaaauguuuaauauauaaaaauauaauuaaguaaaagagaaaagaaaaaucaaauccuaaaaugaaauaaaaacagaaauaaaugaaccaaaauauuuaucauaauaacauaaccacacagaaaaaaaucauuucagaugaucucugagcauagugcucacacuaugcauucuuuuuuuuuugaaacagagucucacucugucgcccaggcuggaauacaauggcaugaucucagcucacugcaaccuccgccucaugggcucaagcaauucuccugccucagccuccugaguagcugggacuacaggcacgcgccaccacaccuggcuaauuuuuucguauuuuuaguagagacaggguuucaccauguuggccaggcuggucuugaacuccugaccucaaaugaucccgucugcuuuggccucccaaagugcugggauuacaggcgugagccaccacacccagccugacuauacauucuugguagaauauauucuaaggggaaaaaucuuaaacauuacucaguaguuuacuguuaguaaugucgauauuauaauuuugaaacuauuuuauauauaguauauaauaaaccaaauaaacauauuaaagugauuaugaaacaagauuuuuuauauuaacggagagauguaaacacaaaaugcaagaaguugaggggugacaaaaauuucuguaauguuaaauuugaauugguaguaauaauaugaaacuuugauuucaaaacauguauuuccuggcuauagccacugaaagagucuagaaguaacgacacuaaugauaaugaacagaccuacuaucuagaucuugauuucuggauacauuccccacuaaaaugaaccaggcugacucuaagucugaggcaggauaguacaaaaugggccugggaaucuaacugugucagaaagcauagaugcacucaaaugaugguaucauuucaaaaggacaaaagagguacccuaaaaggcuacuauagaccaaaucugggacuauuugaagguaaagaagaauaguaacuauaaauaagugaauuaaaacaugaauccaugagucuauaaugagguuaauacgugaaacuugauacaugaguuuauaaugaaaucauauacuagaaaaagaaugcaagugugggguaggaggugagaagguaguagggaggaaaguucuuuacagaagaaugccaguuaauaaauguggaaggaauggcggaauuagaaaaucaccaucuugcaacuccaaaguaaagaacugauucaggcaaggaucaccaauggauguuaaaacuauggaugaaagguaauuaggaacaggauauauguacccuagaaauuacuuaguaauugcaaagggagaaauauacuuuuacaauggagauauuucuguggucaccaucuucacuaacuacuaaaacuaagguacacuaaaagugagacaaucuagcauuaugugucuucugauaagaugcaacaugacuauaacugcaccuaugaaguauucucgcucaaaauguguaaccugcacagaauggaacauguagauauaacuuucaacauaauacagaggauaaaggaacaaguuaaagaguaccacaaggaacagucagaggaauccagaaugugggacauucuucaagacaaauggucuagacuuuucaagaagucauuaucacuaaaaaaaaaaguugggagacuguucuaaacuuaaagaaacauagcaacuaauuguaaugugugaaacuugacaggauccuggauaaaaaaaaaaaaucacuauacccagguauaguggcaugccuguaguccuagcuacucaggagguuaaggcaggaggaucaccuugagcccaggaguucaaguucagccugagcaacacagcgagaccuugccuccaaaaguagauaaauaaauagcuauuaaaaaauugggggcugauuagggaaacuguuaaauguacuagauauuagauauuauacaauuauguuuaguuuucauagguaaugguagugugcuuacaucggagaaugcccuaagagaucuaugugaaagauuuggaagguaaggucucauggugucugcuguauccuuuauaguucauuuaaauaaauguauacacauauauauaggaaucaagcaaaugugagaaaauguaaacaacugaccucaggugaagguuauaaaauuuucauugugguauccuuuaaauuuucuguauguuuaaaaaaaaaagguuagggaaaagaaaaauauagagcagauggcuguauucaacuaaaaagauagauacaugguccccauacugauauuauacaacugaccuugaaauauuaucucuggaauucauuuucuuucuuaagauaaaauuuaggcagcaacauuaaaugaacuuuuuuuugaaaauaagugacuucuauuuaaaagcaaacaaaacaucuuggucaaugauaagaggggcaacuuugccuaggggagaguuaaacauuucccauuagagacuauaaaguccaaucuguagccaugaaaagaacagauuucggcugggugcgguggcucacaccuguaaucccaccacuuuggaagggcgagacaggcggacugcccgaggucaggaguucgagaccagucuggccaacauggugaaaaccugucucuacuaaaaauacaaaaaaauuagccaggcaugguggcguguaccuguaauugcagcuacucagcaggcugaggcaggagaauuguuugaaccagggagguggagguugcagugagcagagaucgcgccacuguacuccaaccugggcgacagagcgagacucugucucaaaaaaaaaaaaaaggacagauuuuccuagaagcuaaggcuuccagcacaauacccguugacauggagugaguuucccuugccuccuccugagguuaccucaucuggcugaggaaggacaauaaccgacaucguuccugugugaaugcgcugcauccuugaggacaggcccaccucggggaugcgcugaacucggugaaucccacccucauacuucaaaugcuuauagacaccgucaccggaaauucgggcggcugcaugauguaguccaccuaggggaacaacaauccagaaauaguaaugaauuauccuuugaaacagaucaggauccuaaauguccuuaaucuaaggccugaauguugaguacagagccuaagaugagaacauaaagcaugggagaacgagggccucugaagaagaagaagaaaagaggacauaaaguaugcacaaaacuacaguuuuccaauguaaauguauuaaaauacaaaaggaaacauaccaaaauguaauuaauuauaggagcuagugaugcaacaauaggaaacauaccaaaauauuauuucguuaugucuggggaauagaauaauacuuuuuuuauuuccaaauuuucuauaaugaacaaguuuuauuuuuauaauaagggaaaacuacuauuagaacaaaaaaauaauacugggauguuuucuguauugaacuacccuguguagucuuaggcuaauaggguaucauauauaaaagaaugcucaauaggagaauaauuucauacuguugaauaacucuacagauccucccaaauuuucaagaauuuauugaaagucagcucuugcuuaucuauggagugggaagaguaucacaaagaaucuuaacaccuaggcuagcuuguucuuuuuuuguuguuguugagacagagucuugcacugucacuggggcuggugugcaguggugcaaucucggcucgcuacaaccucugccuccuggguucaagugauucuccugccucguucucuugaguggcuaggauuacaggcacccaccaccacguccggcuaauuuuuuguauuuuuaguagaggcgggguuucacuauguuggccaggauggccucgaacuccugaccucaugaucugccugcguuggggucccaaagugcugggauuacaagcgugagccaccaugcccggccacuuguucuuaucuaauguuuuuuuaaaaaucuuuuuuaugauacaauaauauaugaaagacagaaaaacacacaaaucaaauaugugguuuagaguccaccacucaggucaagaaaaagaacggugcuagucacuucauaagcccucccaaaugccauuuccagacauaauccucucucuucccuaugaguaaucauuauccugacuuuuauuccuuucuuuaucauaacuucauuaccuaaacguguagcccuaggcgcuacaguuuaguccugcccauuuaaaaauguuugauguaucuuuuuagucuauuaguccacaugcucaucauccauugcuuucauuuccuacaaaugaucuggugaagaacuugggcugcugaccuguagaauuuccaacagucuguuuuugcagacugcauauucuuggugcaagucacccuguucugcugcccucuguaucggcagcaauuaggcagcuggaugcagacacuggaucagacaccagcucgagcccuuuggcaagacgacaggagguauacggugucuggaugucucucuuuuuacagucuugacaggcuuugacacugaaugcaucacugggguuacaaaauggugauaagucuaauucuaucauuccuuucucacuuauuaguuaaaauacacuaauaaagagacacuuccccuugucuaccauuugauuacauggugauacaauuacauaggaaaagcaagauaaauguuugauucugucccuuuuaucaguucuaccaagauaccaacguuuuuuuuuuguaauauacugaacugguucauuuuaauccucugaagaugaccaauuaaaaguuuaaauuaucauuaugaacucaaggauugaaacacaucuagcacguuuaaaucaagcacaauuauuauuaaagcucaacuagucccaucguuggcccauagagccucuucaaauugacuucugaauucuucugacaugccccauuuguaugggacaugccccauuuguauggcauaacaagauauuccaggauuaucuugaacauuuuuuacccuagaccuggaaucagccaugucuccaaaaagcccugguucaagagaaaaauaguauuugaaaaucacaauuugggggcuaggguuguccacuacuacuggauuugguuauaauuucuaagccuuuucaguggccagaaauaggaaauaccucaugaguucauaugauguugagacccaauuuuccaugggucuccuguguuccugcacaucuuacaaaugaagcauugcuggcuauuucgcucuaaaauaucuuuuaaaggcgguuuguguagugaacagccuuggaaauaaugugucccuccagagcaaaggacaaguuuccacagccuuggaagacagagauagugucucuuucuagagcaaugugcagcaugcuuacugcgcauuaaaaaaaauggcugggcgcagugguucaugccuguaauccuggcacugugcaaagcugaggggggcagacagcgggagcccaggaguucaagaccauccugggcaacacagucaaacuccaucucuacaaaaaauacaaaaauuauggucaggcgcuguggcucacaccuguagucccagcacuuugggaggccgaggcgggcagaucacaaggucaggaguucgagaccagccugaccaauaugaugaaaccaugucucuacuaaaaauacaauaauuagcugggcgugguggcgcgcaccugucaucccagcuacuuaggaugcugaggcagaagaaucgcuugaaccugagaggcggaggucgcagugagccaagaucgugccacugcacuccagccuggaugacagagcaagacuccaucucaaaauaaauaaauaaaauuaaaaaaaauaaaaauaaaaaaauuagccaggugugguggcacgugucuguagucccagcuacuugggaggcugacaugagaagauggcuugagcccaguugaggcugcagcgagcugugauggugccauugcccuccagccugggagacagagugagacccugucucaaaaaaaaaaaaaaaaaaaaagacucaauuuccuuaaguucagugcucuucuccuauaaugcaaccuacugugugggcagguaucaucuggucuucuuaguuguugcccugugggacucugggcucagggaacuggcacaaaaaugcuaauacucuggcuacugcuauaacccugaguaauaaacuguccuucacugcugacccaugaaacagcagcaggcuaacuuguuagcuugcaaguaggguaaaaucucagaccuuucagaguuuuuacaacugacacuuccaauuuaaauucaacuucaaccucuuuucuaccacacuuuuauuguauuucuucccauaccaagaaucuugguucucaaagagagggcauuagaauuaaaauaucccaaaauuacuuaucuguuuuuauauuacacuacacaccuaacagucucagaauacuaauacuaguucuaccaauacaauuacuaaaaacauuaaaacuuuuuugcauaugcucuugccauuugccucccauuuuucaaaugauuguacuauaucuauacugucagaucauacaguccuuauguaacaaauuuauuccccuuagcccucaauuagucccaguucuucagguaacugcauauuuaauguucaccccuacuccuuauuuugcuaucucucauuucaguugucugaagcuuguuuucuaguagauuccucagaaagggaucaugggaagaguauuucuugaauucuugcauaaugauaacaaauuguucccuucacauuuauaagucaguuuugcuuauuauaaaauccuuaacucaacuuucuuucuuucagugaacucucucucuggcacaaaguguuguuacugaaaagucugaaggaaaucuaauccuugccuuauaagucucaaggucuuuguuucuacgugccuaaugggucuuuucccuuuuuuguaaguccaaacauuuuauuagccuaugucuuaguguuggucguucuagcuggguauuuucagaugugcacaugguuucaaaucuuuuauuucuauuucagaagaguucucuggaaauauagauguuaguauuugucacaggcagccucaaggguggccccccaggaucccugccugcugguauucauacccuuacaguucccucccagcuggucuguaugaucaauagcauaugguaugacagaggugauacuaugucaccuuccgagguuagauuauaaagaaccauggccuccaucuugcaucacuuacuugggagaaacaggucgcuauguugggaauagcccuguggagaggcccucguggugaaaagcugguaucugcuuacaacuacaugagugagcuugcaagcaggcccugacaccccagucauguguugagaugacaacaaccccacccaacagcuuaacugcaaccucaugagacacccugugccacucaaaaaagcagcugauuccugacccucauaaauugugagauaaaaaauguuuguucuuuaaaauugcuaagcuuuggguaauuuguuacacagcaauaaauaacaaauauaguaucugcucugacuuuuaucaucuaaucaaucuuuuugccuaucaacaauauuugucauuuucuucacuccuuuauuaucuuucuucauuucuucuugauuucaaaaaaauuuuccuuuuuaacuacuacuuucuuaaggcauuaaauguucuguuuaucugcucauauguuccuucugauuuauucauuucuaaaaugauuuuucuuugcuuucuaauuauuuccugagucugucauuucauuucuaauccugauuuaucagauucuuugacacuucauauugcuuuuuuuuuuugaagacauggucucacucuguccucuaggcuggagugcagugucacaaucuuggcucacuucagccuugaccuccugggcucaagccaucccaccucagccacuggagcagcugggacuacagacgugugccaccaugcucagcuaauuuuuaaaauuuuuuguagagacaagaucucaccaugugggacccaggcuggucucaaacuccugggcucaagcgauccucccacuuuggccucccaaagugcuggggaauauaggugugagccaccaugcucagccucuuaauuacuuauuuugaaauagcagaugauaguuuugaccuauuuuguagucauaucuuucuaaugugcuuucauugucuguagggaucuuauucuacucuuuacucucuugugucucauaaaacuuuguauggaauuuaaccuuaauacuuuucuaugguuuauuuuucugugagauuacuuuuccauauauuuuagaaugaguccaggaaggcuuuucuaacuucacagaguucucuuuucuguggcuuuguguaauguucaaauaaauagcaaccugcuuucugggacuuccuggcuguucucccuggcuuuggauuagaucuucuuuucccuuccucccucuuuaucccuguccugcucaacuuugauucuccucccagcaguccuuccucagugugggggccuguuuuggaagggcgcccuaguggaucuguuuugagaggucaugcaggcuagacugcucuggccucuuuaaaucuccuuaccuacagcccgaacacuuuacucauuauuggagagcguaaaccuccucccagcuccagcucauguucauaacuggcucccaaauuccagagaauaaccaugaguuaugagaggguucuccaguuuucagauccggcagaugccaccccauugcuuccuucuuccuccugcacagaugcuuagaccaugcagguucuauggcaauuggugguuuguuuugggguuuuguggguauacccugcaacugaaugcugucaaugcuauccauggguuuuugguuuugauaucuaguugcuauauguguuuuugcauggggauucagagagacugaaaacuaugcugcuacugcagcugccaucuuccuaaugcauuucuaaugaagauauaaccauuugguuucuaaagucagcauguuagacaaaaauugaguauaguuuuagauuacccuugaaaaugccuuaggaaggugucuuaugagagacuggcauacugucucuuaauaaguccaacauagcugaucuuccuccagcaauaaaacauauuacuggauaauaaucuucauaccaaauaaagaagcugacaugcauuuagggcacagaugauaugaaaaaucaaaugguuuaacauucauacucagugugguaggacggacauacuaugaaagauuauucaggaacuaaaacagagugaugccacaaauuuaaauuccccaucucauacucacacuguacuucaaaauuaccccuccauccccuuuacuucaugucaugugcaaauacuugaauauuauaagagaagacugugacuuauuuggcauagauuaaaacagccagucuuaggcuaucugaguucaaauuucaagcuucucuucuuccuagcugucuguccacaggcaaguuaguuccacgcuuugguuuccuuauguguaaauaauaauaguauauaacuagggcuacagcaccgcacaccugaagggagaaacauucacacugaagaguauaugaguagugccucaaggcauaugcaggcauacaacacagccuugaaauucaaucuacucuccaaggguuuuugugaggaauaacugagauaaauacaugcagaacauuucguacaguguugacaugcagcugucgagagguaucaguaguaacuggaacuaugccauuggcuuuccuggaucggugugaaaucuuguggaagacaaaggcugucaagcucccuaugagcuaaacugugacaaagggcuagagagcugauauacccuaacggaggacaaugaagguguauuguggccuugcuggaugaaagcaaacugcuucugcuggcuuucauugacagggauggagaaaaaggcauuugccacaucaacagcuguauaccagguaccagggauuauguuaauuugcucaacugaugaaaccacaucugguauagcagcugcaauuggauucacugccugguuaagcuuucgauaauccaucauuucuccaggauccaccugucuucuguacaggcgaaauaggagagcuaaauggggauguggcgggaaucaccacuccugcauuuuucagguccuuggugguagcacuaaucuccacaaucccuccagaacugcaguauugcuuucaguuugcuauuuuuccuagaggcaguucugguggcuuccgcuuggucuuucccaccauaauagccuuugcuccauaggucagggaaccaguguggggauucuaccagcugcugaguaugucuacuccaauuuugcauucuggaacuggggaaaaaaccacaaaauaaccacagaauugguuauuuucacauugggcccacugugagaugggcaugagcuaaaacucauugaucaucugaccuccacacaagccccuauccugacuaguagaucacagugacauuuuugaauguccuagaauuaguguuggcuuacagacagugacuagaaguccucaaaaguucugauuauuuucuuuucuccaaagcauaguuaccguauuaaaaggcuguaagucccuuugcggaggcugggggaaaguucuggcgguauccuggggugucuccucaaggggaccuacacacuccccuucacucgagguacugugggucuggaaauuggcucaagucuggaaacuggugcgauguugacucacugcaaccuccaccucccggguucaagugauucuccuaucucagccuccugaguaacugagguuacagccacgcaccaccacacucagcuaauuuuuguauuuuuaguagaaacgggguuuugccauguuggccaagauggucucgaccuccugaccucaggugauccaccugccucagucucccaaagugcugugauuacaggcguaagccacuacgcccagccucugcuuucuauuuugacucugcugucugaugguaacucugccuacuacuugguguuuggcagugggguaccaccaguuggccccugccacccugggaucgaauuacuccuacuacauuuagguuucccaauucagugaccaaaguucccacuguauggucugaccuacagagaagagugaucacagagcucuugaaggaugcuggggcuucccgacaaauauguuucucgcaguuguggugaaaggugagucauguggacacauaaaauucacaauuacauuaccguaagucaccccaccccaaauuaacucgugaguagagaauaacaaaacauaauuauaaacauucaucagucgagggcuggggagauaaugcaauauauuucauagaaucccuuuaauguggaaaauauuucaauucauuugauaccagguuuacagaucaauagugucagacuuacacuacauaucuagagccauuacccuccacugcuuccauagacuaucuuguuaucauuuaguuugaacuauuucugaaaugguuaaauauugucucuaucuguaccuauugccacaaaaugacaugacuuugaaagucacuuaauguaugaauuuguacaugaaacuguuucuuuucaacuuuagcuuuuagugcuaugugaaucucugugcuuaucuaugaguuccucuccauuucaauuaaacauuaaaaaaaaauuugugugcacauauauguaauuuaacauguauauauuauaagguaggugcuuuuugcccuuucuuuauccacacccuuuucuucuccuaacugcuucuaauaaagaaaucaauuuuuuaggccgggcgcgguggcucacgccuguaaucccaguacuuugggaggccgagguggguggaucacaagaucaggagauggagaccauccuggcuaacacagugaaaccccgucucuacuaaaaauacaaaaaauuagccgggcguaguggcgggugccuguagucccagcuacucaggaggcugaggcaggagaauggugugaaccugggaggcggagcuugcagugagcugauaucacgccacugcacuccagccuaggugacagagugaaacucugccucaaaaaagaaagaaaucaauuuuuuagaaauuauaauuucaaugaauaaagguuuauucuuagucuuugauuuuuuuuucuuuuuuuuuuuuuuuuuuuuuuuuuggagaugggagucauucugucgcccaggcuggagugcaguggcaugaucuuggcccacugcaaccucugccuccuggguucaagugauucccaugccucagccucccaagaagcugggauuacaaguacgcacugccacgccuggccaauuuuuguauuuguaguagacaugguggccaggcuggccucaaacuccuggccucaaaugauccacccgccuuggucucccagagugcugagauuacaggcaugagccaccacacccagcccuuagucuuuaacuuuaaagauauaugaguaaaauauuuguaauguuuuuuuuuuaaagagggcuuuuagcuuuucaaaauauuuuuauuuuauuuugccagugacuuagugugucuaaaggaaagguuucccaaucauuguuuaggcugcuauacaaaccuggaacagaaucucucuuccuguuauugagguuaucucccuuuuauucuugaaagucucauucgaaauacaccuaucagaguucacucaggauauuuucuacuacucuccuuuucauaaugcugcuguuucuucuuacauucuccuugaaacucucuccucuuuugcuuccauaauauuuuacuguccucauccuuuuucugauuaucuugaauccucuuuuuauuuugcuaacuggucuauccuucuaaacauggccauucuccaaagcuuguugcccugaaugcucucucucuauagacucucccucacuuauucucucaguaucagacauuaucucugagcugacagguaucaaauagcuugccugaguucuguugucucaccaaagaucugguuacucaauuucaauauuuacuccaaauuuuuuuuuuuuuuugagacugagucuuacucuaucgcccaggcugagugcaguggugugaucucgacucacugcaacccgugccuccuggguucaaaugauucucgugccucagccucccgaguagcugagauuacaggugugcaccaccacacccagcuaauuuuuguauuguuaguacagacgggguuuuaccauguuggucaggcuggucucgaacugucucccgaagugcugggauuauaggcgugagccacugugcccagccuauuuacugacuauuucuaaguggaugcucacuauaaccucaaacuuaaugauucaaaaaccauucaucauuauucuuuccaaaugguuucugccuuccaacuucuauuccauucaauggcaugaaugaguaucacagucuucucagcuagaaagauuagacucccuguggcucaucuccuuugugucagaauagaauaaugggauauagugcagcucuggaucaaacagacuaaaauguaaucccaggauugccauuacuuauuguguggucuuggauuaguuacuuacucucugagccuagauccucaucuguaaaaugagauuaguaauaucuauuucacaagggugugaaguugugcacacaagacauacuggauaaacaacagccccucucacaucuaguuacuuagcaaauuaugccuauucauccuuugcaggucucugacagauaauucuacuccccauucuaacucuuagucauaucuggauuacucuaauaaccucuuugcagucugcacuaaaucuagccuuuccauccauccauccauccauccaucacuauugucaaaauaaucuccuuaaaauauauaucuuaucaaaucauauucuuauuaaugcaauuuucaacagcuuccuauugcccaucaaucaaagcuguucaaaaucuauccacucaaaccuacuucagcgauuacuucccugacaagcuauggguaaacuggccuccccaccacucccuuccccacacaccaagaccucucccaccagcaugcugcugcucagguuguuucuucucucugcucucauggauaauccccuuuccugaccacugguuguaucugaaaucuguaccagguacaacuuccuuaugcuguaggcugguucuuauuucccuuuacugcucaacuuacaugaauccucucuccccacuuugauaguuugugguuuauuacugaugacuccucugucuacuacaauguaucacuguguaaccaagcagaggaaaacuuucagauggauuaaaagaaugagacaaaugagagaauuauuaucauguuuucaaucaauauacuugaguauuuaaagguaaagaacugcacuguuugucuauguuguaucauuuuuuuuuuuugagacagucucacuuuguugcccaggcuggaguguacuggugugaucuuggcucacugcaaccuccccaucccggguucaagcgauucuccugccucagccucucgaguauuugggacuacaggcacgugccaccaugcccaguuaauuuuuguauuuuuaguacagucaggguuuugccauguuggccaggcuggucucaaacuccugaccucaggugauccacccaucuuggccucccagagugcugggauuacaggcgugaaccauagugcccagccauuauaaauuuuuaucagccaaaagagaaguuucuugaaaauaaagacaaaugauuaacuuuuuccgcauucucauaaaaaucaaacacauuagccacuuagucuaauuaguaauacuuauauuauuuuauaaaguuauuuaaaguaaaaaccuuaauauaccuuugcuuucaauaauagagaaaaaugauuuugaggcaagauacguaucuaaguuccucaggggaauuuucucuaauucacauauuucucccuaagcaaaugcuucccuccuuucuacugucuucuccuagcuaacaacucugcuauaauaguaagccacugugauugaugagccuaugccacaguguuuaguagauauacaccaaaaguuucaaaaaaaaaugggacaauaugguucuaaucaagaucagagguaaaauaauuuucaguaucuccuacaggcaaauuccucaauaugccuaccauaaucugcugguguauaauucagaaguucaaauugccaguguuuauagcacgaauaauucugguacaugucaaauauuucucggguaaauuguuggcagaugucaccuaaaacaaaauacgaaaaauauuuagucaggacaaauuucggaaagccacccuuaagacuaaguccuuuaggaaauaaagaauaacuauuuccaaauuuaaauacauuuaauggacuuuuaaaguuaguguuaucaaauaagguaaaauucaaggacuuuuuagaucauuuaaauaauaaaguaaguuuacugaccuccaguaguccuuccagcugucaccucuaaaauaacaucauuuuugucauauuucuccuuuggcacaaggcucuggaaaagcuggaauaaaaaucagcauuuguguguauauuuuccccgguacacuauuacugaauuaaauaaaggcccgaaaaacauugaaaaaaaucaauaauuggcaaaaucauauaguaucccaaacaggguauuccaaaaaugcuauaauaaguagaacuaauuagaccuaaaauaggugaucaauucauguuaacaauggaguuacuugucaguauauuuucugcacuguuaucagauuaucuuaauuuucuagaaugcagaaguucagaucaaaguccaggguguuccauucaauuuucuucagauuuuggcgcuuauaauuaguucugaacaguagcuucuuucaucuaaugaaugaagcaaggcuuugaaagucuucacuuugagaaaugauuucauauuaucuucugcuauaacugacagcagacaccagccaugcugugccuucucagcagagacgcucuaauuaaagacuauguugagggcucccaagauaaggcucaaaaugaguuucucagcugugaccagaaagaaaaagggcuuccuaauaaagaaaguaaccgacauuccucuuaggaagaaaagggaaguaauuucauuauuacuaaaagguuuuucaaaucaaaguaaaaguaccuaugugucaugacugucccuacugccaauuucugaaauacuccaucucugcuagaaaugauauagucuaugggagagaauaugagacagacugagagucagacaucuucugccuuugauuaacugguucaauuuguaauaaaaauaacugauaucccauguaaccucccccuuaacuuuucaaaaagccccucuauuggauucccagaguaagaaacacugaagguaggaggacggcaaacgugacagagggaaacaugguauacaguaguguguucuucauugucuuuguagacaaaccauccauuaagcaagaaugaaaagagaccacuauggaagggaaaucuuccauuuccaugucuaggagauaucagcugaugcugauacaguaucaucaacccugagaagcuccaguaugccacacccuuacuagaccuaacuaaagauguguguuaaccaacuauuuuuacaccuuuggauucauuccauucuauccagagugcaaauuuccaauccuuaauuaacagccaccaugaacuccuccuccucuucucacucuuaaaauccucugacucuucccuguggugaacuaaauuucuuuaccagcacguauucucuugcuuaacaaguuaacagacucaacuuugaauuuuuuuuuuuuuacccugggagucuuuauuauuugacaucguaauuucuucauucucauucugcagcaaauuacaggagaccagcuugaucacuuaucauaagagaacacuuaaaacaguguuuggaaaccacuaugagcaccgaagcagagucuagcaaaaacagcauuccuuuauacagcacuauugaaacuagucgaccucugaaaaccuaccucauuguacaacauguugauuuuuugaucaaugguuugccuuucuuccagugcaaguucuuguaacugcuuuucaucuuguuuauuuaggccuaaaagccagaaacagaaauaaugauaaaguuuuuaaauacuuacagagaaacuccuaaguagccauguuccucuuuggcuacuaaguuuuauuucaguugcaaaggcaagggauuauacaaaggaacauuuagaauauuuggagaaugucaauuaacaaguauuugcuaagcauuuccaaaaaacucaaugugaaaagcaauauaaucgugcuucccaaaaccuuguguuuuuuuuuuuaaagguaaaauagcuuaaaacauuucaucucuaaucaaucuauuaacaguaguaacaaaaauaugcuuaauauagaaacccacauuuacaaagcucguuauuugaaugucuauaauuauauaaauuggugauuaaucaaacagguuuaaaaagcuacuagcuaauuaaauauaaacccaaauaagauaagauuuggagcaaacuggagugagcauuuccuguccaaagguagcagcuguaacucagcauacugugacaugguccagcacagcuacaacuuccauauuauccaagagaagucagaaauaagaauucuuaaaaucucuugauacauucauacucaguucacauuguuuuuuuuuuaagagagaugaggacucacuauguugcccaggcuggaguagcuauucucagaugugaucaugguacacuacagccucaaacuccuggacucaagcgaucuuccugcuucagccucccagguagcugagauuacaggugcgugccacugugccuggcuuaguacgguacuuuaaaauacauaucauggccaggugcggugacuaaugccuguaaucccagcacuuugggaggccaaggcaggcggaucacuugaggucagaaguucgagaccagccuggccaaaguggugaaaucccaucucuacuaaaaaugcaaaaauuauacaggcaugguggugcacgcguguaccccuagcuacucgggaggcugaggcaggagaauugcuugaacccaggagguagagguugcggugagccaaggucaugccacugcacuccagccugggugacagagaaagacucugucuuuaaaaaaauaaaauacauaucacgugugucagacaaaacauacauuuuuguaaccuguccuguauggagaaaaugggccuuuuucuguuauuuccaaaggagaaaguuaaaucauggaacucuagcaaaacaagauaacaaugaucuaguuauugaccaaggaugguagaccucaugaccuuugacuccacugcuuuagaggcuuggagacuuuauuugucaguggccauugcugcaaauugagguaaaaaauuccgacccuuaauaauaaagaaaauagaaaugaagaaucacaauuauaaagaagagaagacucuuuuaaauuauucucuagucauggaagucauuaagcucuggugggauucugugccucauucaagcuuucaacauuuaacauuuugcuagacacucugcuaguugcuggggagacaacgaagaaaaaaacauggcuucaggccucaaguggcccagucugguggcaaacacauacacaugauuacaauaugagaugggggagugccagugugccauaggggcauaaaugaaggggacuaaaccagacuuuagcaguuaaugagagcuuccuggcuaaggugucaucagaacuaauucuaauuacagaccaucuguuguagaauuuuuuuuuuuuuuuugagauggagucuugcucuguugcccaggcuggagugcaguggugugaucucgacucauugcaaccuccgccuccuggguucaagcaauucuccugccucagccucccgaguaguugagauuacaggcgcgcaccaccacacccagcuaauuuuuguauuuuuaguagagacgggguuucaccauguuggcaggcuggucuucaucuccugaccuccugauccacccgccccggccucccaaaguacugggauuacaggcaugagccaccgcacccggccuguuguagaauuuuaaugucaccacuaguaccacauugugcacauaugccacaaauggaaaccaggcugacauuacuuaauagagaucugcugauucaaagguaucagaaaaaccuucugauuugcaaucauauaaaauuauuuuuguguucucuuauuauuugcuguaaaccuguagaauccgucuaauucaauuuuauuauaucaacaaagauuugagaaccuauuaugucccauguuucaugcugcagaagauagaaaaaugaguaagacacaggaccugaccuugaagaacagacaaugggguuaggggcugagguuaagacaguuacauaaaggauuauaauacaaaacagagaaagguaaccacacuuguuuugcaaaggguacugaagccaaaguaugacaucucagccaagcuuuguaagaggacuggcuuuuaacaaggugaaccaggcauguuaacaacgugggcaaagauacagacaugggacagcacgaauauauccagagaauggcaaguugucuauuuugguuggaaggcagaauaugcaaagagaauuaacauaguacauggagaggcugggguuaaucugcaggggcuuuuaaauaccaaaccaagaaaucucuacuuauagacaaugggaacaggugaguaacaugaauaagauuguacuugaacuagaacgccuagagguagggcuacaaguuaggaauugauugcaaucagcuaagucagagauguaaugaagauauaaauuaguggaaggaauagaacaggacucaugcaagcuacaucacaaagguagacccugcuggacuuugaaucauccaucaagcaguggauaagagcagaggcuuuggaaucucauugcuuggguucaaauccuugcuucuccccucgcuggcugagugaucuuugcaaauuuaaccuuucaauguccucaucuauaaaauguauaaaaugagggaaaacacaggcugggcaacacagugagaccucaucuuuacuaaaaauaaaaaaaauagcugggaaugguugcacacaccuguagucccagcuacuugggaggcugagguuggaggauugcuugaguccaggaguucaagguuaaagugagcuaugauuacacuacugcauuccagccugggccacagagcaagacucugucucuuaaaagaaacaaaaagggggagggggaauaaucauauauccuaccucauaagguuaccugagcauucaaaugagauaauauuuguaaagcacugagcuuagugccuagcacauaagaggacuuuguaaauguagcuauuauuacuauuauuauagaaaaauuguagagguaguagagccuuuagaaaugauguaauccaaucuaauauuauacaugauacaaccaaggcugaaagaaguuaugccaauuuaauuagaaugcauuucauaaacuucuacuauacacaagcaaccuucucaaaacuaauuaacuacaaaucuguguggcauuaugcaaaagaguaaaaaauaucuccauuaaacguacguaagagacuugugguaccaucaauagaaggcagaaaaauggaaggcuucaaaaauccaggacuuuacagguauaacagugacuggccuguguaucacauaauacugcuaaggcuaaaugaaacaaaaugaagcacagaagaaaaucuagaaacuaaaaguuaauagccaaaucuggauaaauguugaaucauagguuaguucauuaaacuuuucucucaacuucuguauaaaaauuuucgaaaauuuucauaagagaaaaaauguagaggcaauagcaguauugagaaauacuaaaauaaaaaacuaagauaaaaaauagccgguagucccagcuacucagaaggcugaggcaggaggauuguuugagccccggaguuugagugagggaccaucucuuaaaaaaaaaaacaaaaaaaaaaaacauaaaaaauaaauacaccauauacaaaaauaacuaaaauagaucaaagaccuaaaugcaugggauaaaaauaaaaaauacgucagucuuguaagaaaacacagauguaaaccuuugugcccuuagauuaggcaauuuucuuagauacgacucccaaaacucaagcaacaagagaaaaaaagauaaauuggacaucaucaaaauuuaaaaauaucaugcuucaaaagacaguaucaaaaaagugaagagaaaaccacagaaugggaaauuuuugcaaaucauauaucugaucauggacuuuuaccuagaagauaaagaccacucacaacucaauaaugaaaagacaauuaaauuuaaaaacuggcaaaggaucugaacagugauuucucccaagaugauacacaaauggccaaauaagcaccagaaaagaugcucaacaucauuaaucuucaggaaaaugcaaaucaaaaccacaauaacacaccacuucacauucauaggauggcaauaauugaaagggcggauaauaaguguuggcaaguacguggagaaauaugaacccucauacacuguguguagagcuguaaaaucguuauagucacuuuggaaaacagucuagcacuuccucaaaagguuaaacauagaguuaccacaugaaccagcaaucuauguccacaaaacaacuuguacacaaaaguucacaguaucguuauuuauaauaaccaaaaaguggaaacaacucaauguucaucaacugaugaauggauaaauaaaaugugguauauccauacaauggaauauaauucaguaaugaaaagaaauaaaguacuggcugggcaugguggcucaugccuguaaucccagcacauugggaggccaagguggguggaucacuugagaucaggaguuugagaccagccuggccaacauggugaaaccccgucucuacugaaauacaaaaaaaauuagcugggcaugguggcaggggccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaacauaaaaauaaaaaauaaaagcuuccuuccugguuccacuaaugcgcaguccccuccaggaagauuuacccaaucaauccaggcugguuugagugcccucuccucuuugcucccaugaaacugugccucccucuaguagagcaggucucacauuauaaacaauacuuaaauaaguuucucucacuggaccauagaagcccacugaugggguaggaacuguauguguagcccuaguauguagguacaguguucaauaaaggucugcucaauaaaauaaagcuucugaaaagaccaacauuuugucucccagaccuugagaccacgggaaguaccacgaggagccuguuuacuuaguacauugaucuuuaguagcuaaagugugucaaauacucuggguacagaguccuguucuuuccaaguguugagcuuauuacuuguagguuuuuuuaaaagacugaguucaggccagccucaguggcucgguggcuauaaucauaucgcuuuggaaagcccuggcacaauaguccuagcuacucaggaugcugaaguggggggccaggacuuacagguuacagugagcuacgauugagucacugcacuccugccugggcaacaagugagaaccugcuucugugggaaaaaaaaaacaaagacuaaguucaauaaagcuuuaacuuagaaaaucaaaucuguacuuacacacacgcauauaagugugugguuuuuuuuuucauagcccuuaugcaggacacauaaguaucuuuuaccuacuuuuacacauugauucuaauucuucaauugcuuguucagucuccugaauuucuugguaaauggcugcaagaggugccaacucagcaugccuucuguucaaggaccuucgguuuuccucauucacagggauaugcugcagacauugcucaaguguuugguacuccuuacucagguucuccauauauuucuguagugcuuuaugcuuccagagcaucuuggugucuugauggcaauaucuccuggaccaauucuuacuuaacagaugaagaaugcaauuccuguuuugucuaaaaacuugcagccuuguaucaagauguaucugucuaaauugaugagaauggagcuggaugugacacuggagguaaccauuaagagauggaugucuaaaaagccaaacacacaggugacgauucaucucagcaucugaaauacaauaaacacagucuuuaaaaaaaaaucaucucuaaagauacaugcauaauaaaccuggaaggaacaucaagaaaucuuguuucaucuacugccucagccagcuccacagucuuaaaauucaacugccggcuggcagcaguggcucacgccaguaaucccagcacuuugggaggcugaggcaggcggaucaccugagggcaggaguucgagaccagcccagccaacauagugaaacacugucucuacuaaaaauacaaaaauuauccgggcgugguggcaggcgccuguaaucccagcuacucaggagucugaggcaggagaauugccugaacccaggaggcagagguugcagugagccgagaucaugccauugcacuccagcaagggggacaauaccaagacuucgucucaaaaaaaaaaaaaauucagcugccuacagaaagaacauaauucuucaaauguaugaauaacauauuaaaauaaauaaaaacagcacugcuuccuaccuguucaacauauauaauuaacugaagcauaugaguaggaguacaacuaacaaauauaucaauugaaugaguuaagucaguuauuuucuagaaaguaucuagaaucuagaauugaguguguaaacaagcucuugaaagcuaugaaaacauacaaacuuaaggcgguucauaaagucauuuucuaaaguuugaagaaaauauuauuaucuuguauaauucuuuaacuuuaaggaucuagauauccaaggaagucaaguaacuuaaucacgacuauucagucggcuggauggagacagagcugguauuagaauguaaguugccuguucaggacucaguaauuuucacucucaauugugcaaucacuuuucaaaaaugcuucccguuuagcugagauccuaaaggaagaaaaguucaaguauuaauagaccaagaaaguagggcuggugaaaagcucuacaguuauauuaaauggugacaauuauauuaagcaagaaaggcaaggaacaaaauagaaucucaauuacauuuaaaaaauauucuacaauauaagguauacauguaaaaaaaaaaaagcacauagaguauuuuuuaaaaagaaaguuaaauaagaaacauaccaaaaugugccgagcacaguggcucacgccuguaauccuaccacuuugggaggccgaggcgggcagaucaucugaggucaggaguucgagaccagccuggccaacaugggaaaaccccaucucuacuaaaaauaccaaaaaaauuagcugagcgugauggcacacaccuguaguccuagcugcucgggaagcugaggcaggauaaucgcuugaaccugggaggcgaagguugcagugaacugagaucgcaccacugcaaccagcgugggcgacaaagcaacacgcugucucaaaaaaaaaaaaaaaaaaagaaacauaccaaaauguuaauaaaaugaucucuaguugugagauuaugaauaccuuuugcuugcuauuuuuucuacuuuucaguguuuuccaaguuucuugcacauguagcauggaauacuuuccuaaucauaaaaaaagauuaguuuaaaaaauuacagguuaggugaaauuggcuguguacaauaauuuucuguucuccuccccuccaacagagauaaucaagagcuaacaaaaguacacaauggucuuacugaguaagaaagggagaauauaaaguguucuaagaaaacucuaagguucaaaguugaaauaagggucaagccacgcacaguagcaugcaccuauugucccagcuacccaggagacugaggcaggaggaucacuugagccaaggaguucaaggccagccugggcaacacagugagacucaacucaaaaaaagaaggaucaacauuuaucaaaaucaaacuuuacugucuccagugauccuacuaugcuaggaggugcauugauauauuagcucauuuguucacuauaagucuguuaacuuagcauuaucaccuaggaaauaaaauagucagaauggucuuuaaaauauucaguuuccagaguucuacugauagauuuuaggauacugcaucacauuauuaaaagaacuguugaagaaagcaccaauggccagcugucacaaacguuacacuccaccacccccguauuucaagcacguuagagaaaguguauccauuugcuaacagacagaauaaaaggaugacaaauauauguuuguacgaauacuuauugcuaaaauuuccauuuuaggaacaguaguagaaugcauaauuuucaaggucaugaaucucaacauuaaggaaaacaaaacaaaacaagauguuuacucuccaagguuaacuacaccugagaacagcacgacuucuccauuacccaucacaguaacaguauuacucugaugcuuuggggaaaguucugaguguaggcaggucagaagcgacagcccgcggggcagcagcacgggcaaaccaugcuguguaacucaguauauggagugauuccauaaagaggcaauacaggaggcggcggggaagaucaggaaagaacugugaguaccuaagaaaaagaagaauacacguuagcucucuuuacugaggucggaaccuuccgagacccgccacauuucagcccgacaaacccgagaucacg

SEQ ID NO: 192518 - RNA, 50364 nt, Homo sapiens
gccaagaagcuugagagaagaaaaauuucagaaaaauugucucaauuugacuagaauaucaaugaaccaggaaaacugaagcaccuucccuaaagaaaacuuggguauacaauuacuccacagacagagcugaggguuuuuuacccaaaucagucacuggauuuugcugccugauacgugaaucuucuuggaauuuuucucauguggaucuaaggggaaugcuuuauuauggcugcuguuguccaacagaacgaccuaguauuugaauuugcuaguaacgucauggaggaugaacgacagguaugagauucagagaaaauuucauuuuaaugacuuuauuaugauuuuucuauucauaucagaaaauuauuuccuuuaaaagacaaugagagaaacuuuauugaaaguaaaaauuuauagaugaaauauuuggaggaaauauuauacuauguuuuaagcaccaguuaauucaugaagaauaagucuuauccuuagcuuugauaugguaacaaggaaguaauaccuuugggauucagcuuguuuuuuuguaaaaugagacuuaacacuaaaugccuuaaguaauuauuuuuaaguacuuugaaaaguucuagagaauauacugccuuuuaauguaugugguuaauuaauguuuguaaucaugggcuacuucuucaaguagaugagacaacguuagcggucccauaaucauacaucauuucaguccaaagcaugugacucugaggaaguuacuuaacuucucuagaucuagauuucaucaucugcagaaugaggggauugaacugaagaauuucuaaaucggcuuucagugaauuuauauaagaugugcaaauuacuguuuucaguacauaaaaaagaucuaggagauacugaguaaaggaucuaagauuaauuuuagucuccuuccccccuccccacaacacacacacacacaaaagaacuggaacgaggcuagaguuucuugggacuuuacaauuaacuucauuuuaaacaaguuauauagggaauguaagacaugauaugggagaaauaguguacguguuggagagacucagacaggguacuaggaaaaauauuuugagaaccaaccuaaaguugauuuaucacugaaauaagccuaaugcucaacaccuaauuuuaauaggccaauuauaauauguaaugccuuuauucuggaaacauaguuacuacaaauaauaaaauucuuacuuuuggcagagugaauuuaaugauuuuuauaaaauuaaaauuuuuuuagcuguguuguccauugaagugacagaacaaaaaguuuauaaauaaaccuacaaaaggugaggauuuggauuaaguugccuuaacagcaggaugagcuuugacuagggaggauaacagguucagggagagaauugcuuagucuugauuaaaaauauauuaauagugauauggauuuaaucuagagacaauacaaaauauauuuuaggaagaaagguguuuugaauuugguuuaagacaggauguuuguguguauauuaagguuugaaacaguguguuuacuaugcagcccucuuaaaugaaagaugcuguauauagaugcuaggcuugauguggugagguuugaucucaggauguagcagcagaggacaaagcccuaagccacucacuaauaugcucuaguuauaguggauuugacacucuuuggaacaugagagaagugaauuuuacauuaugguaccauauucauacaugugucuacauagccuaaaaagaguuuugcaaaacaacacuuauacacuuacuauguaugauauacuuaguuuguuuugcagagguuauuuauguuuuuggaaagggagaugguacuguuagcuuaacaucagcauguacauauauguauuuucuuaaguuauuuguuuuugucuaacaaaaugaaucuauauuuugugcagguguuauaaggauuuuauaaguauuaaccauguaagguaaauacugauccccauuuuauaaugaggaaauugagauaucaagagguuaagucacuuuccuggaaucauacagccaguaaauaguagagccacaauuugaacucagccaguuugauucucacuaaugauguuuuauauauucuugcaauaaugugugacaaucuuacuguguuauaaucagcaucaaaauguuuacaacucuuggugaguuuuggcgucuucagucuguggccaucagcauagcaaauguaacugcuuugcaggaggguagauccagugcuguuggugauauuagcaucuuaccuaaccuggggcucuaccucccuguuugcuuauuagguuaauuuguuuuuaauggaaaagcaauaacgugccauuuguauuaauaaaagaagucaccuaauaaaaagauacauaaaauaacuagugaaaaaucucucuucacccuuaguccuaaucuuguuuuccuucccagaagaaacuaguauuaaguauuaauauuuuguguguaauuuuuuuagaaaaaugucugaacaaaugaacauacauauauacaaaacugcauacagagguugcuuuuaagacacaaaugaaguuaugcuaaaucuuuuuugugucucauuuguuuccacuuuauuauaaauauuuguguguauguugauucuacaucauuuauauuuuacaucaugagcagcccauuauuuauuuuacaguuccugacauggcuguuaccagcauuuugcuaugauguacaauauugcagugaacauccuuguuuggaaggcaguagaucuaccuaguaguagcggugguuaagagcucagguacugaaguugaaaugccuggguugaaucuuggcuccgcugcuuauuaucucugugacuuugggcaaguuacucaaccuuucuguuccuugguuuccucaucugcaaaauggggaugaaaauaauagaaccuaaguuauaggauugcugugagaauuaaaugaguugauguuucuaaagcuuuuagaacuaugucuggcucauagcuaauauuuacggagcacuauaauuuugucauuauguguguguguguguaguguaucuuuguacacuuaugugauuauaucuguaggguuauuaaaaacagaauuacugagcuuacuaaaaauauaaauacaaauauucuuuuaaaaggcuguguuacguggacauaaagauggacaagucuguguuacguggacauaaagagggacuacuagaugggggaaggaaggaagcaggcaaggguugaaaaacuaacuauugggugcugugcccacugccugggugauaggaucaaucauaccucaaaucucagccucaccuauguaacaagcaauauacucauguaacaaaccugcacauguacccccugaaucuaaaauaaaaguugcgggggguaagaggagcuguauuaauuucuacuacuacuaauaguguauuucccaaaccauuaucaacagaaguccuuuuuuuuuuuuuggccagucuuuaggguggaaaugacauuuuacuauuuuaauuuguauuuccuugacuacuaguggugaagugguuuauuuguaaauuuuauuuauuuucaauuagaguuuucuuugauuuacuuauuaauauauccuuuugcccagugggaauuuuuuaaguauuauggucacuacauuagaaucauugacauuuucucccagucuaguguugucuuuuaacaaugugauaucuugugcgcuauagaaauuuuaaauguuuuuaauaaaauaugucaauauuacaaauuaauaauauuaguuuugggggcuuuucuugccuucugcuuaggaaagcuuuauucucuucacuccugucacuccuaaaauuaguauauacucucuuuacauuuucuuuucuuuuuuguuuuuuuuuugagacugagucuugccucgucacccaggcuggagugccguggugugaucuugacucacugcaaccuccaccucccagguucaagcaauucuucugccucagcuucccaaguagcugggacuacagacacgcaccaccacgcccagcuaauuuuuguauuuuuaguaaagacaggcuuucaccauguugcccaggauggucuccaucucuugaccucgggaucugccugccucggccucccaaagugcugggauuucaggcaugagccaccgcccccggccuacauuuucuucuaguaucuuucauauguuuggcuccucaguccaucugcaguuuauuuuuguaugaugugagguauucaugauuugaagauucuucccccacucccacaaauagugguguuagcccuucaccauuuauugaauguuuuauguuuuucacacuuaaacugccaccuuuguuaauacuaaauuaccauguguacaggcuucaguuuugaacuuccuaguguauucuccuucguugaacuguuuuuauauugugccaguaucacauuguuuucauuagaaucauuuuauagauuugauauccgauaggauauccuccuccccccaaauuggaauaggauuuugaaugaauuuuagaguuagcuuguuaagcuacaugaaaacccuguugggauuuuuaacuuuuuaaaguuaaaaaguauuuaugacuuuuaaaauaauguauucuguuuuggcuguuuauaaaaucacugaaggcaccagauuagaauauauuuuuuguuuucaguuauggucuagguuauaaauauauauuagucuaaagaaacugacacuauuaauaggguugccagcauuuugaucaucuucccuuauucaguucauauuuuccagaauugcuuggcacucuugaguggagauggcaggggucauggcggggguguuggaaaggaaauaucaaugcuguugaugcugacaauuuaaaacucuguuguugcugucuguucuaaacugggaauauuuguagcugagaaugaagcacuucuaugggagagcaaccccaucaguauugaaugcaauaucccuuuaugcaauggugcuuugguuugaucuuaacaagcguguuagcauggugaauguaugagaagaagaagcaagcagaagucuauggauacaaguuucuaaagagaaggaaaccuauuuacuuaaauguuccaggaguuaauuuaaugaagaacagccggcauaguuuaaugcuuuuuauaauuuugauauauuauaugaaaaaaacacuguauuuuuuuuucagucauugguuuuaaaaguagaauuucuggcaaaucauauuuguguuuaauagacuuaagucacuagagagaaguuuggugacauggaaaaaaugaacauguggaacaacaaauuuuuauagaaucucaucacaauauaagaagguagucuuagcacuuuccucucuaggguguaaauuggcuuccuccgacugcuaauuccuggagguuaaagaguaacagugccgggugcaguggcucaugccuguaaucccagcacuuugggaggccaaagcgggugguguauaucacaugagagcaggaguucgagaccagccugaccaacauggagaaaccccaucucuacuaaaaauacaaaauuagcaggcgugauggugcaugccuguaaucccagcuauucaggaggcugaggcaagagaauugcuugaacccgguagguggagguugcagugagcugagaucgcaccauugcacuccagccugggcaacaagagugaaacuccgucuaaaacaaaacaaaacaaaaagaauaacagugccuugcugucuuuuauacaagcugcccagugauuuuuucaugcaguguuugggaaacacuauucaauguaacacagauaaaugcaaagugcuguggauacugagaauggagccauugacugcacugcaacuuugggaaugcuucaccauggaaguugaacuggaucucaaaggaggaucuaguuuaucugacagaugaagaagaggagguguucuagagcaguagaguguaccaaaacuuuuaacagauucucuugacuucauuaucaguccaaacaucuuaauuuaugguuagaaacuuuucacagugugccuguuucacacuauguaauuuuccagaaugcuuuccugcuuccccacuguuugcucagaaaugaucuccaacauucauaccuguugcauauuuaagucuaauaaucuuucaagauuuuagaacaaagcauacuuuuuccaggaacucauccuaaaauaauuccuucaagaauuaacaacuuuauucuguuauuucuauguugcuuauuaucagucucacguuugccaucuuaaauuuucauauacacauuacuaauuuuuucaaauguguuaaauuauuugaaguaagacauugucuuuuuuccccuuaauauuaccaaagccuuuaauaucacugaguccucuuaaagauuuuuuuucuuuuuaaaaucuguugaauaagugaucucuucuauaaaauagguaaaacuuaccuguugcuagaugaucugggauauauaaguguucaguuaugguucuuaucauaucagagcaucucugaauaaugagagggugauaccuugcccacagcugucuugaccacagaauacauuuucccaggaccuauuguccacauucucauuuggugcagggacaauguagccaugucacuacaguucuaagaccagaaacagaugcucauggaaucuuuuuucugaaguauuuggaacugaucuguuguacauuuaguggaaaacacuucaaauaacuuuuaaagauugucauugaaauuguaaauaaauaaaauguguuaaaugacaguuguucacauuuauuaaaucugguuguaggcauguggaugcuuuuguuuuucccucuacucuguuguauauuaaaauuguuuuucaaaaaaaaaaucagagaaacuaacauucauauagaacuuuccuuuuuccuuauaugcuauuuccuguauguaagaggauaagucacaccaaccugccauuuuucaacuggaauggcaagauucuguuaggucagagauuagguguaccucauaaaguaagguagaaggaaugaguugauaguguuuaauguguaacuuauucagcgccagugaugagaagggcaggaagcuggaguguugcuacugaucuguacguggacuuaguggauccucuguuauuuaccuuaaaauuccagguucuaucugcuuugguugccuucuuuuuaaaucuugucauaucaaacuuaagaaauccauuaaaagcuuggccauuugugaaacuaauauacagagguugcuuguuuauuuuugguacacuuggaaaagucuuuaucaaaggaguuaugucuuagaguccccagcuacaagccugauugccuucugggggagaucugacuuugcauaaaggcugaggcccucuucagguuaagugaaggaacaacccugccuguggucuaacauuuggcuuaucucuuugcccauucuuggcagcaaggaggcugauaguuguuaugaaagaggagucaguguggagaguaggaacuuauuacucuuuuuugcaaaaucuuccuuuaacugcccccuagccaucccacagaggcccagggauaacguccugaaaaugaauaagaugagaucauuguauaggguagaacauggacuagaugggcuucagaaacuuucaguggugaauuuuaguagcuaguguuuagugagcaucuugccccaugcacugugcuuuauagggauuauccuauuuaauucuuacaacaauccuaagaaguaggugcuccuaauucucacuacaaaagagucaagugaggcucagcgaagggaagcaacuugccuguaauuucauagcuacuaagugauaaagcuaggaauuguaacccagccugugccuuuaaccacuaauugaauaauacuagccacugcaacauguaaguggugaaaaguaguuuaaaauauggaagaauuauuauauccugcauuuaugauuuuggcaaaaaaguguuacuaauuuuagcuaauuaguauaauuacagguagaugguucuuaugccuggcauaccuguauauguaccuuuuaaaaaaaacagcuuuauugcaauguaauucacauaccauauaauccaucuacuuaaaguguacaaaucaaugguuuuaaguuuauacagaauuguaugucugucuccauaaucaauuuuaggacauguuuaucaccccaaagggaaaucuguaccuguuagcagucaugaccuauucuuccccacucuuccuagcuccugggaacuacuaaucuacuuucugucucuguauguuugccuauucuggacaauucaguuauaguaaauggaaucauagaauaugugcugucuugcgacuggcuucuuuuacuuuggcauccuguuaucaagguucaucuguguugugccauguaucauuacuccauucuuuuuauuacugaauaauauuguaucauauggauauaccacauuuuauuuauccauucuguacacauuuucaaagaacacuuuuuaaaaugagguuuguguuggucaguuucuugucagaaauagaguuggcaacgucuucucccagaaaauacucaaucaccuagaauagccuuccuggguaaaaaaaaaaaaaggaaauuagcaccucuguugcuucuaaaaauaacuuaaaaaaauuuccccuaacauuugacaccuuugaugugucuuaguuuugcuaugugaucuugaaaauuuuugucuccuuuccauuucagugaacacauagcacauaaaagauaggcaguuauauaaacaguuaguguaacuggccuuuuuuaaaaaagagggucauuuucaacauauuuagagaguacugaugaaaauaauuguuuguguguguuuuagaaauaguaaccaaaauucucaauauuagagcaauucuucuuuuggaaaauugccaaggaauuguuguuagaaaugcuacauuauaauauuuugacugguaaaacauuuguaagcugacccauuuaaccuguucccacuaaaugugauguugaaaguacugaagauacgagaccaggaaacuuaucagcaggaugaugcgaagauuaaaguuaggaaagaagcuucccuccuaaaaggugaucuuuuaggugacaguuuaaugauuuauuauauuuuaugguuuuacaugauuucugcauuugcccuauucuacuuuauuuuguggcauaugcaaaauaaaaacaagaacuuuuagaacaaaauuccauuguucuguuggaaaggagcuacugggaagcccagcuaucuguaaucuccucccuccccuuuccuaccucaacacacacauucggaaauaauguauuauuuaaagacuuaggugggagaugauuuuuuaaacagugauugauuaguguguguucaguccacugcccacaacuuugacauaacauuuaaucaugaaaacugauguuugucaaucaagagucugugugauauggcauuaaaaaaacaucaauuugggagccuggcucuagcuguguaacuuuagacaaguuuuuacauaucauugagcuuuauuucuuucacaaaaauaacagaauuaccucccaagguuaugagcauuaaaugcuuaugcaaugcauuuaccuauagcaugguacauggaacaguccucauauuaaugaccugagauaaaucaagaaaaagcuuuaauagcucuugucuuacacuggauaaucucuauuauccaacuggguaagugaggugaugaaagugauuuuugugacuugcauaccaguuauacaaauucauucagaucguuuuguuuuguucuguugucacauuuuuccuuugauaauccagaauggcugucuugauucuagaauaagccaauaaacuugugacucaggauuuuaaaaaucugguggacuuaugccguaagggagcauuuuccuuuaacauuuguuucgacauaguuugcccuggcguuguucaguuuuuuuggaguaccacuaauuucucccauaccuaugagcagguaguaugaauuuuccauucugggagagacucuauuguagcuaaacugccuguauucaaggaugccuuaccucauuuuauucuuugcuguguacauauuguauaagauucuugucaaaguccaucuuuucauagcagaaauugcccuuuaugauuuuuuaaaauucuuugaguuauauggaaucugcauguuuaaaacacuuaccugucugguagugacuacucugauauuuauuaaucuacuuaguuuguaaguaaaguaaacauuuacaucugguuaaaauuuacuauacccccccccaaaaaaaaacuaccuguuuguuuaccucauaacugauucuguuuacauauacccacacauacacaacccaccaauacuauuaagcuuuuaauguggacauuccaauaagaaaacagaucauucucauugacucuuacuuuuugagauguauggccaaauuguaauuuauccuggcuacaaaaagaagaaucuaggcaaagacuaaagaaagccaauugucaugacacaguuacacuaggauuagacuuuguuaaaaaauaacuccacaaggauuugcaauggaauuucaaacauuaucuuggggaauucuggagaaaagaccauuuuacuuagaccuuuauguuuuugauggugcugugcaagagagaagccaggauuuuuucagaaacacucaaauacuggccagacgcaguggcgcaugccugcaaucacaacacucugggaagccaaggcagaaagaucgcuugagcccaggaguuugagacuagccugggcaacauagggagaccccguuucuauuaaaaaaauagcuggguguuguggugccugccuguggucccaucuacucaggaggcugaguugggaagaucacuugagccugggaggugggggcugcagugaguugugaucuugccacugcacuguagccugggugacagaguaagacccugucucaaaaaaaaagaaaaagaaaacaaacuuguuucagcuguaggucuaauacagugaucauuuagaagauaacuaucaaucuauauauaauauacauuuuuuauccaagcguuaauugaaaugagacuuucauuaugacuuaguaauaaauucuaaguaguuuaucuauaggauccuguacugguagugguuaaacuuguggacucuagagucagauugcuuggguucagauuucagcuuuuucuggcugggugacuaguaugugucaauaauauauagccuaguguuguggggauugaguggauaaagccauaugacguccuuaacauaguagcugcuuccgucaucacuacauuagggguaccacuguauucuauuuuauaguuuauuauauugaaagacucccaaagacagagacuagagaacacuuuuuacacagcgcuguagugaguuuuuuuaguugaaaguacauugaccagacacuugaauccuuuuuuccccuuaauuaaaccacauguuuaucuaugugacauuuauagcagguacauaauccauaaaaaugaggauauuagagaacaaacgccauugggaaguguaaggaggcuaauagagacaaguauguuuucuuggcacggagguuaacauccaaacauacuuggcacgaagauuaacauccaaagcagcaucuuugcauguuaaccuccaugccaagaaaacauuacuugccuuagucuugaauacaauguaaagauaacacugccuaacaucuuguacagcucuuuguaguuuacagucuuuucuguauacacuuggauucuuacaagucacuguaugauagagaucguauuuuucccguuuucuauaguauaauguuaucuugaauuuauuacuaagugacuaggagaccuguauuagaaucuuucaccugugauagauuuguagggcaagcuuacaaaggcauccagaguaauuacuguucaaaguaaccuagcugaauuacuaaauaagucuagauuccaguucugauuuaguaacacucuuuuagaguaucaacuagaggauaauuugucuuuuagcuguucguuaauuuccucauuaaucuugacgacacuugauuuguuuguuuauauuuuaagggaugaugggauaaugcagaacaguauaaggauuugcuauaucauuugagcuaaugcauugaaauauuuuaaguuuuuggaaugguaauaauguagauuuuuuuuucuuugaaaaugugccaguaacaaugaaagaaacugaggaaauugccagggaacaauccccacaugcacaaaaccuguaggcccagauaguuucgugagugagugauuuucaacuuuaccagcccgggcaacauaguaagacucuaucucuacaaaaaauuuaaaaauuagcaugauguggcagccuguaccucugaucucagcugcuugggaagcggaagugggaggaucucaagccuaggagguagaggcuacagugagccaugauugugccacugcacucuagccuggagucucacugacagagacccugucuuaaaaauuuaaugaacuaauuuaaacaguuucgguucagagagaguuuccuaauucaguuuuacaaaacugacauaacacugauaccaaaaccuggcagaauuugcauacacacauauaaacacuaggcuaaucuaaaaauuuaugugcuguuuaauaauuaaugaacacuuauugucucuuacccuugccaggcccugcacgugauaugcauuuuauauuuucaucuuuaaaagccuguauggugugacaacucuuguuauccccauuuuacaaguaaggaaaacauguauaaugaggaaucucaaagagguugaaggaaugcauguuacccagaaacacacaacuguaaagugccacuuguauugaaauugacugaccugagagagcccaaacucuuaaccauuaugcuaggguauaagagagaaaaagaaccauaaaggaaaaagagaauauggaagacuauuaaguaaauugucuuuuauacugauuauaucuaggauuagugcgauuuuuuacuuuuucccaaauacauuuauguauaacauuuuuaagaacuagacucauguacuacaccuguagucaguaaaacuaugauguucuuauaauuuagaccaauguguugagcaguggguacuacaacuacauaaacuuuucugccugguugcuaaaacugcuuuuuauuuuauaauaaggaauaggucccugggcgcaauggcucaugucuguaaucccagcacuuugggaggcugaggcagauggacugcuuaagcccaggaguuugagaccagccugggcaacaugacaaaaccccaucucuacaaaaaacacaaaaauuagcugggugugguggcacaugccuguucucccagcuauucaugucgcugagguggaaagauugcuugagccccagaggucaaggcugcaaugagcugugauugugccacuguacuacagccugggcaacggagcaagacccugucuaaaaaaaaaaaaaaaaagaauauagaaaguguuuacagggagcuugaguuaaucaacagaaauauuuggagcuguuuuaguggcauauuuuuuuaaaguauguggagaauuuggcuaugaagaauucuucacagaaaacuuuguacugggcuuuggaaaucuauuguacaauccuagcuugcuuuguguaauacaucaauuccugaaaucauuuaaaauacacuuuggaauuuagaaauaguagaaaccauugaggaggggcacuauauggaaaggaagcaaugauguuucauacucuuggaauauaaauauguucuguauuauuuauucccaaagauaauuauuaaaaaugugccauggggauuuguugaaaggauuucaacuuuucacuuuguucaccagucacccuaauuuuuuguguguguuuauccauguagauguacuguguguagcgauuuccuuuaauuuuaucaugguuuauaugagguaaugaaggaauaccaucauaguauuuugaagauguuuugaaguuuuguuucucccaucagauggaccucugcuuuuuaaacuucuuauugaaguguagcauuaauauaaaaauguaugucgguaauaagcaugcaguuuaugaauuuucacaaagugaacacacauauguaucaacauuugcuuuuaguugaagcuaaauguuguugcuaaguguggaugguuaagguuuguucaccuauguuuugaaaagacuauucucauuaaaaauaaaacaaaaucaaaucccaacaaagcuuaaagguuaaagaaagcaaaagaaauaauaaauaaagcaaaaaauaauuaauaaacaaaaaggacaaggcaugguggcucacaccuauaaucccagcacuuugggaggccgaggcaggagaggauugcuugagccuaggaguuugcgaccagccugggcaacauagagagaccucaucucuacaaaaaaaaaaaaauuagccagacaugguggcauacgccuauagucccagcuacuugggagacugaggcaggaggauugcaugagcccaggaguucacagaugcagugagcugugaucacgccacugcacuccagcgaggcgacagagcaagacccugucucaaaaaaauaaaaacaaaaccaugccuguccaugugagauuguaguaagucaguuuuugagaguguuuauuucuauccguaucaaauauugaagggcuuuaaucaucaaaacauuuuauuuauugcuuacuauaugccaugcauuaucacaaaugauuuauuuacacauuauucuuacaacaauuccagaagauacuauuauucuuauuuugaauagauguaggaacuaaagcuuagagaggcuggauaacuugcaugaguucaaauacccaggccaugguggaguccuaccuuaaauaagaaccugaguuuuuacuguuacacccuguucaccauguguguauguagugcauuugcugcaugguaagguacugucagaucguguuguaauagaguaaggugcuggguuuuuguuuuuuaaaucaaauguaaaaggaagugauuucaagaauaauucagaaguccucaaagcagugucuucauaggauaaggcuuuggggccucagucugauuugaaggcugggcacagggauuugucucaaagauguguuuucauagcaagugcaguguuuaauuugugugcuuauuggacaggcuuuggagucaggggagcuguugaagacugugggaggaguaaggcaccagaccccucuugguguuuucuugccuugaugcaaagauguugcgugaacuacucgaaggugugcucauuuugcaccugucuuuaaaaaguagugucugcuuuggaaaaaugcuagagacuaaauuuaacuugcuuuuuguuuugggaaaauauuuuguagguauuucauuuuaagcuauuuuagagaggauuuugaugggauguuucacaaucaccauauaccagauugaguucugcuauuagagaaacuugguaaacaaguuauaugaaaguucuugugcuuuuugauacccaaaaacuugaugaacaaaauuauuaaugaaguuggaauaaugauucaugguuucugaaauauccacauaggaccuuggauugugguauguggaacaagcaagccuaguuaggggagucacauaauguccugcuuacauuggucgcuuuccuucucuuuuuaacuugaugguauugccacauacgugaucaaccacaaguggaaacuauaucguggacaauguugaaauuuggggaacugugacucucuucugcuaaaacuugguuugaauuuuauuauugcuccaaaaauguuugcugaaauuuugcuuucaacauauauccuaaauuuaucuauaauuaauagaaaggggaaaucucuuuggagcuguuaagaccuucaagaaaguuaugaaacaauugaaaauuacuuuaucacugcaguaauuugcuucuagauauugaagcuuuggaaacccugaucuuugauagauuuuaguuccaggagaucuucccucucuuguucccaugguuugugguuuauuuugguucuguucaaaaaccaaaggggaaaauaaucugcaagugacaaauagcaaaagaucuaauaauauaaaaauguaauuguuugaauuacuaauaucccagaucuuagcaagaauaauuagagcugacucaacuuagggaaugcaguuuugaauguugucauucuucagagcggugguccugaagccuggaugcaaauuggacccaccuggggagcuuuaauauuaggcucuggucacacccccagauagucugauuuauuuuaucccauguggggucaaauauugauauucuuaaauguuucccacuguacagcgaaaauugauaagcaccaguagaauuuaauuagauuucaugaugcaaauaaaagaaaagaugcuuaaucuaauuauuuaaaugaugagaguuuuuagaaguguuuggaagguuuggaaggucauuuuuuaaaguagcagccagucaaauggaauguaauguuuuuguuaaggcaucaaagaagcauugaaaccuucauuucuuuuuuuuuuucuuugagaugaaaucuugcucuaucacccagguuggagugcaguggcauaaucugggcucauugcagccucugccuaccagauucaagcuucucaugccucaggcuccugaguagcuaggauuacaggugcacaccaccacacccagcuaauuuuuuuauuuuuuaguagagaugagguuucuucauguuggccaggcuggucucgaacuccugaccucaggugauccacccgcuucggccucccaaagugcugggguuacaggugugagccacugcacccggccaacaccuucauuucuuaaaaguagguaacaucuuauugcuuacuauuaggaguguggcuauuuuaugaauaucugcuaucuuccugaagcccaucuuuuaaauaaaucuugggaaagggucuguuugaaaugguguggaaaaaauugagguggguaagauuugaugaucuucagcaaagaaaccugaagaguaauauccaaucucaauuuagaaacaaugaaaagacuaguuuauacaaguuauuucgggcagagggaacaaauuguuaaaugacagacuuaaaaccaaauuaaauuaaguccuauuauugguugaauugugccugcgugcacacccacacaccaauucauauauugaaguucuaaccucuaguaccucagaguguaaccuuauuugguuguuggaaauagggucauggcagauguaauuaguaaagaaguuacacuacaggagaggggagcccuuacuccacuaccugguguccuuauaaaaaggggaaauuugggcugggugcgguggcucacaccuguaaucccaacacuaugggaggccgaguuggguggaucgcuugagcucaggaguucgagaccagccuggggaacauggagaaaccccaucugugcaaaagauccaaaaauuagccaggcguaauggugcaugccuguagucgcagcuacuugagaggcugaggugagaggaucgcuugagcccgggaggcagagguuauggugagcugagauugcaccacugcacuccagccuaggugacagagggagagcugagaucacgccacugcacuccauccugucucaauuaaaaaaagucggggggugaguggaguuggauuuggacacagagcccauguaaacaugaagaccagccaucuauaagucaaagagagagaccuggaacaguuccuucccccacagucugcaaaaggagccagcccugccaacaccuugauuucagacuuuuagccuccagaacugugagaaaauaaauuucugcugagggacccaguuuguaguacuuuguugcagcagccguagcaaacuaauauaagucccaauauuuuauuuguuuugaaaaucuaaaccuaggaaaauucagcauuugaaauuuuacuauuucuuuaaaagguagggaagcaguucucuagaaggaauuguagaaugugugguucuagaguucuuagguucuugaugacucauacuuuagccaguuacuggucaauccaguuuacaaagcaguucaucaugagcccagaucagcagcuggaguuucaggagugugcauuuuuuuucuauuuaugguaguagagugggaagaaucuuucuagucaccugagagguguuuccuaaauguauuuuguauauacagauucaagccucuuaccugacuuauucauagucuuucuuuuuuuuuuucuuuuugagacggagucuugcuccgucacccaaguuggagugcaguggugcgaucuuggcucacugcaaccucugccuccuggguuaagugauucuccugccucauccuccugaguagcugggacuauaggcucaugccaccaugcccagcuaauuuuuguauuuuuaguagaggcaggguuuuaccauguuggccaggauguucucaaucucuugaccucgugauccgcccgccucggccucccaaagugcugggauuacaggcgugagccacugcgcccagcaccuaacuauucauauucuuaugaaaaucugaaguuggucucuuucuuauauauggauuaauagcauccuggggaaacgagagaugaacaacuuugaauauacaucccaugucaguggacuagaaaagaauggaccaugccuuucaugauaaaagcaaguaccucagaaggagaaggcuguaggacuaaauuaggagugauccugggaagugcccugcugaccaagaagaacuggcuauucccaugagaaauuuuguuauagacucugauuggugaagccuuggaaauaauagugaaacucauaccuccaccucaaacacagcuccuuaauuauucugguuuucuaaacagagccaaguaaguaugccagcagaacaaaucuacuauguuuaaagcugacuacaauaguguauaaguaaaggacauggacccuggagucaguucaaguuagguuuaugacuuggaguagauuauuucccuugccucuguuuucucauguguaaaauggauaguccagugugucuccaucauagcauuuugugaugauuaaauagagugauaauucacguaaagcaaugugcaaaaugucucgugcauauuaaauguugguuaauagcaauggcagcagcuauguggccacagugcaugcuacucucccauuuuaguguguaagagugaauaaucucuucucgugaaauguuauaagcucagacaguagaauccaugaauucaaaauauuaacaaagcaaaaccuggaagggccuguaggaucaacuggugcucuucauucauuuaaagguucagaaaauaaggucaugaaaucaggguuggagaaggcccuaggucuccugguucccaguuuuucuuuucugcuacauguggcugccuucuaaaucacagaaccaugugucucuuuucauucuucuucuucuuuuuuuuuuuuuuuuugagacagucuucuucacucaggccagagugcaguggugcgaccuugguucacugcaaccuccgccucccagguucaagccauuccccugccucacccuccuaaguagcugggauugcaggugcccgucaccaugacuggcucauuuuuuguauuuuuuuaguaaagacaagguuucaccguguuggccaggcugaucucgaacuccugaccucaagugauccacccaccuugcccucccaaagugcugggauugcagacaugagccaccacuccuggccacucucuuuuuuuaaucccaaagacuucaaaacuacuuuucauucuuaauaaaccuuuugcuucaaaggaaacguuuuuuucucuugacguuuguguguuugaaauuuuccuuauuaaauaguuuaaaaauuauuaaauuuaaacugaauuuaauuaugauuguuuaaagcaauuuggaguaugccugacuguacauuuacugucuguacaguaacagaacaaagaaauugguagcagugauugccucugggaagggcacugugguagaagugacauugauuauaaaggagaauucuggagaauagaguaacuacugguuaguagaacaggacaaggaauaaaguaguaacaaguaucugugguuaaccaaaacucaagaacuguauagacucaaaaauuuggaaguaucccuuguuauguacacauuagcacucucuacccaagcuacaggagccaaauagauuugguuagggaggaauacuuugguuucauuugggugagaacugcuccugugaauugcauuuuacacgccugucucugacuuaucaguggaugaagugaugagcucuguuccuaccuuguacauggguuuuugcagcauaaaagugcuuaauucuggacuaagccuuguuagaagaccaggagcuuaauugagcuuuuagaagagaagaaaaggaaaaguguuuuaacaaguccauguuuaugcuaggugggauugcaugucuacaauuuaccugucaaaaaagggaaagggaaggcuagcuacacuuuucuuuaaggugugugaaguguauuuaugugaguuacgguauaauuuuuuucuuucuuuuuuuuucagugacaggguuuugcuguguugcccaggcugaaguacaguagguauucacagaugggauuguagcacaggacagccuugaacuccugggcucaagccauccuccuguuucagccuuccagguagcugggacuacaggcacauaccaccaggccuggcuucuauaguauaauuuuugagccuccuaguuucuguuuuaaaauuuguuuuacuauuugaagagccaguuacuuuucuagcuagcuuccucuuuucuaaaacaggaagaaagauuuugaaauaaaacgauccaaauguguuuuaggauuauuaaccauaaauuucagaacauagcauucucgaaggcaaggauauuaucuguuuagcaccuacaauguguauuuaauuuagguaauuaaauuauuaugacagaaguaaugucuaaccucaguguguaguuuuguaaacauuaauuuuaaaagauugaggcugcuuaguugcaaugaaaccauaaauaauauuuugaauauagcagacuuacuuaaggaaaauagcaaggugccuggcauuauuaucuaugagcaggaacuuuuucuuacauuuaagaagauggcuugaaccugggaggcggagguugcagugagucaagaucgccacacugcacucuagcuugggcggcaaagcaagacuccaucucaaagaaaaagagaagauucuuuauagagaaguguuuaguuaagaaacauaaaauuuacauaguuuugaguuaacuucccacaagauacauauuaguaacuugauaauagagaaaccugguagauacuaccuuaacuaagugaucaaaauuaaucuaggcauggaggcaugcacuuguagucccagcuauuugggaggcagaugcgggaggaucacuugaacccaggaguucgaguccagccugggcaacagagcaagacccugucucaauaguaugaacauaaauauauauuaaaaauuaauauccccagcaauggggggacaaauagguauuuuggacccccugacaugauauauuugaaagaacauaacauuauuucuuugguauuccuaccaaaaaugcaaacugaaucuaaucauaaggaaauauacaaacccaaauugguagacauucuacaaaacagaugaccuguacucuucaaaagugucaagauugugaaagacaaagagcaaagaacuucucagauuaaaggaaaagaaauuguuccagguuaaaggaguuauuaagaaacaugauauuuacuaaaggaaaccuauaaccaaaaaagauuuuuuuuuaacuuuuuaaaaggacauuagugggacaauuagaaauuuggauaaugucuaaagauuagauaauaguauuguauuaauguuauuuuccuaguuuugauaauuaugcugucuuuauauuagauaguauuuuuauauuuaggaaauuaacacaaaguaggauuaagaagcaauaugucuaacacuuucaaacacaucagaaaacaauauagguagagaaugauaaauagaugugguuaaauguuagaacugagggaauaugggugaagguuguaugggaauuauuugugcuguuuuugcaacuuuuauaagucugcgauuaucucaaaaugauaaaggaaguaguaucuuaaugagguuugccgcuaauuaacugaguuuuuaguagguuguuaaaaacccucucugggucaguuuccucaucuauaaaaugagguagcugacuuacauuaaauuguauggguccuuuccauucuaaaauucugugauauuauaacuagacauuaggaguaauaguuuauacucuuaauauagccauacuugaaaagaacaauaauagaaaaugaggguuaauuuucccacuuaagucaaaagcuguuguuaaaacacagccuuugugccaagcgacaguguaauauuaagcucacagauuuuuuuguuuugccaaaaaacuuuuauugagauuugauuuaauuaacauuuuauuuguaugucacuucuugguucaugcuuaugcauuaauggcaucuuauuauuauuauuuauuuuauuuauuuuuugagaaggagccucacucugucacccaggcuggagugcaguggugcgaucucggcucacugcaaccuccgccucccagguucaagugauucuccugccucagccucccuaguagcugagacuacaggugcaugccaccgugcccagcuaauuuuuguauuuuuaguagagaugggguuucaccauguuagccaggauggucuugauuuccugacccucgugaucugccugccucggccucccagagugcugggauuacaggugugagucaccgcgcccagccuucauuuuuaaauuuuaaugccauuauuugguuguaauagauacaaauuaccuaaugccuagaaagauuauagagauacagccugaugaucuaaaaauuaaauugauggcuaguauaaaauaguuuugagcauuauuuaacaaaagcaaaacuguguuaauccuuuguuuucauuuuccucucccuaacccuucccagcuuggugauccagcuauuuuuccugccguaauuguggaacauguuccuggugcugauauucucaauaguuaugccggucuagccuguguggaagagcccaaugacaugauuacugagaguucacuggauguugcugaagaagaaaucauagacgaugaugaugaugacaucacccuuacaggugcgugugucuccauccaguaggaccuugcugcagcacagcuuuaggcaguguccuaauccugaggaugugggggcauaaaacgccccuaacuugguuuuaaacuguauuaccuucagaaacuacagcccuacauggagaagaaaauuacauuuucuguuucaucugcuggauuuaguacuguuuugucaucucccauuucuccuuuccuaaauauauugagaugaaugugacaaaauaagaggcauuuaaaaggaaccaaaccucaauucaucaagucuucacugagcaguuuuuuuuuuuuuuaagagauggagucuuacuguauugcccagccuagacuuggacuccugggcucaagugauccuccugccuuagccuccugaguaacugggacaacagucaugcaccaccccacccagcucacugaguacuuucuuauaugccuuccuccguauuccugugaacaaaaugaguuguuuuguagggaaagagagaggaauguucuuuucuuaccacugccacaggaagcaaaauggugggccaugacccaaauguacgauaagguccugggauuuauagauuucuuuucugguucagucagaacuaguaagauauuuuaaacuugaagauuaggcuacauaaaugugagauuguaguaauaauacuuucaucacuuagaaauugguacaugcuuucucuuuuuguucauuuacagucauauaucuuggccagggauguuguggauauuugagaaaacuguuuggaagcaaauauuugcaucuuuauucguaaaagaaaguuuaucagaaauaggcaagaugagguauaucuguagauuucauaguggcaaguacuggggcugccuuguucucagcuuuaccuuagcauguagcacaaugccuuagaacugaauaguaagucuaaaggcggguucugaucuauuuaggaaguuaacauaugauacaguaauguuuuaaaucggggaaagguagaaugacuguauccaucuggugggggagaggccccacuguuaacauugguugucaauaccucaucuuuguguuguccucuguuuuagucacuucucacauugcuauaaagaacuaccugagacuggguaauacuuauaaagaaaagaaguuuaauuggcucaugguucugcaggcuguacaggaagcauggcuggggagaccucaggaaacuuacaaucaugguggaaggcgaaggggaagcaggcacauccuacauggcuggagcaggaggaacagaaggcagggugguagggggugcuacacacuuucuuuuuuuucuuuuuuuuuuuuuuaaaugcacaaauuuauuuuuucucaacaaacacacaucuuaaugccuuuacaacuuuuaucuccccaaauauaucuugcuuuucuuuauacaugcuguauacagaguuguuuuccuuauauuuaguaguuauugcuuuuuugugcccuuuuggguccugaauuuacacaucaggcauagaucuugggacaggaaagagcugugaagcaaauuccuggaagaucaaaccccuuccagcauggccagguagcacagcugagccagggaugauggggccauauuggguuuggcucugccuugcagcuggcaguccaaacacugaggacaugcauauuucugcaggccucacuauggucaucuguccaaaccccagaauccagagacucaaaacgaaauacagucauacaguaagauaugugcaagguuucagggagcccagcagccagaccuuacacaaaucaagcaaguuuaagaaauauuccagaaguagcaguuuuaugaccuuaaaacauguaauaggcugggcacaguggcccaugccuguaaucccagcacuuugggaggccaaggugggcagaucacuugaggucaggaguucgagaccagccuggccaacauggugaaauccuguuucuacuacaaauacaaaaauuagccaaguaugguggcauacacguguaguuuagcuauucggaaggcugaggcaggagaaucacuugaaccugggagacggaaguuguggugagcugagaucucaccacugcacuccagccugggcaaugagagcaaaacuccagcucaaaaacaaaaaacaaauuaaaaaaaaaaaaguaauagagacgauguaaaccugucaguagacccaggcaaaaacaauuauauuuaacugacaauccugaagccuuuccaacuuucuuuuuuuuuuuuuuuuuuuuuuugaucauucuuggguguuucucgcagagggggauuuggcagggucacaggacaauaguggagggaaggucagcagauaagugcagauaagugaacaaaggucuuugguuuuccuaggcagaggacccugcggccuuccacaguguuugugucccuggguacuugagauuagggaguggugaugacucuuaacgagcaugcugccuucaaauaucuguuuaacaaagccaucuugcaccacccuuaauccauucaacccugaguggacacagcacauguuucagagagcacaggguuggggguaaggucacagaucaacaggaucccaaggcagaagaauuuuucuuaguacagaacaaaaugaaaagucucccacgucuaccucuuucuacacagacacggcaaccauccgauuucucagucuuuuccccaccuuuccccccuuucuauuccacaaaaccgccauugucaucauggcccguucucaaugagcuguugaguacaccucccagacggggugguggccgggcagaggggcuccucacuucccaguaggggcggccaggcagaggcgccccucaccuccuggacggggcggcuggccgggcggggggcugacccccccgccucccucccggacggggcggcuggccgggcggggggcugaccuccccgccucccuccuggaugggguggcuggccgggcggaggggcuccucucuucccaguagggguggccgggcagaggcgccccucaccucccggacggggcggcuggccgggcggggggcugacccccccgccucccucccggacggggcggcuggccgggcggggggcugaccuccccgccucccucccggauggggcggcuggccaggccgggggcugacucccccaccucccucccggacggggcggcuggccgggcagaggggcuccucucuucccaguaggggcggccaggcagaggugccccucaccucccggacggggcggcuggccggguggggggcugacccccccaccuacuucccggacggggcggcuggccgggcagagggacuccucacuucccaguaggggcggccgggcagaggcgccccucaccucccggacggggcggcuggccgggcggggggcugacccccccaccuccuucccggaugggcagcuggccgggcagggggaugacccccccaucucccucccggauggggcggcuggccggguggggggcuaacccccccaccucccuuccggacggggcggcuggccgggcggggggcugacccccaccucccucccagacgggguggcugccaggcggagaugcuccucacuucccagacggaguggcugccgggcggaggggcuccucacuucucagaggguguggcugccgggcggaggggcuccucacuucucagacgcggcgguugccaggcagagggucuccucacuucucagacggggcagccgggcagagacgcuccucacaucccagacagggcggcagggcagaggcgcuccccacaucucagacgaugggcagccuggcagagacgcuccucacuuccuagaugggauggcggccgggcagagacgcuccucacuuuccagacugggcagccaggcagagaggcuccucacaucccagacgaugggccgccaggcagagacgcuccucacuucccagacgggguggcggccgggcagaggcugcaaucucggcacuuugcggggccaaggcaggcagcugggaaguggagguuguagcgagccgagaucacgccacugcacuccagccugggcaccauugagcacugagugaacgcgacuccgucugccaucccggcaccucgggaggccgaggcuggcggaucacucgcgguuaggagcuggagaccagcccggccaacacagcaaaaccccgccuccaccaaaaaaauacgaaaaccagucaggcguggcggcgcgcgccugcaaucgcaggcacucggcaggcugaggcaggagaaucaggcagggagguugcagugagccgagauggcagcaguacaguccagcuuuggcucggcaucagggggagaccguggaaagagagggagagggagaccguggggagagggagaccguggggagagggagagcuacacacuuucaaaccacuagaucucaugagaacucauucacugucacaagaacaguaaggggaaaauccaucuccacgauccggucaccucccaccaggccccuccuccaacauugggguuuacaauucaacaugagauuuggagcggggacaaauccaagccauaucacucccuuuuuuuuaacaaagcauuuuuugcauguauucacauuuuuuguucagagcaaaccaauaaaaguuuuuuguugaaucuagaguuacuuuucccuuaccagugagggaauuggacuaaucagguuagaaguuucuauucauugcugucugaucuguauguguaacagaauaaacaccacuaugcauguaucugggcuuguaguuaguggggguuuagcaguguauccugauauaacuuuuaaagccuuaggguaaggcuacagucuuuguaaguugaggaccaaugucuuuccggaaggaguguuucuuccuaguucuagucaucagggaaggcauuaguucucagagaggaaaccagauucucuguuuguguuuuuucuucccuuugccuuaccucccaacuuaccaaagcuuuguuuaacucuuccauccuuuucugagcaaugucaugaaaaagggaagaaccuuguaaucuucguuauuccacagugggggugacggggagccuuugagaagcucuaggggaagaaagagauaaggauaggacauuuuuguucuuacacguguuagguggcgcuucagaugauguguuaguuugcuaggacugccauaagaaaguaccacagacugaguggcucaaaugagaaauuuauuuucucacaguucuggaagcuagaagucugagaucaagauauugguagaguuaauuccuucugaggcuucuuucuggacuuauaggugacuugucuuccagugucuucacauggucuuauguuuuguaccugccaguguucauauuucaucuuagagggacacuaaccauauuggauuagggccuacacuaauaaccucauuuuaacucaguuaucucuuuaaagacauucugagguacuggggguuagcaugucaacauagaauuuugggggauaccauucagccuauaauagaugauauuaaagaauuacuguaggccgggcacgguggcugacacuuguaaucccagcacuuugggaggccgaggcgggcagaucaccugaggucgggaguucaagaccagccugaccaacauggagaaaucccgucucuacugaaaauacagaauuagcugggcaugguggcacaugccuguauucccagcuacucaagaggcugaggcaggagaaucgcuugaaucugggaggcagagguugcggugagccaagaucacaccauugcacuccagccugggcaacaagauugaaacuuugucucaaaaaaaaaaaaaaagauuuauuguuaguauauuuaagauaugauaguaguauuguguuagacaucuuuuagauacacaugcuaaaguauuuagagauaaaauaugguauuuuagauuccuucaaaauaauccuguacagaggguaaggacuugagggcagugagugggguauggaugaaagaagauuggccauuuggugauaauaguugaagcuaggaaugggcacauggggauucauuauauauacuauacuccacaauuuuuauuuuguuuaaaauuuucauaauaaaaauauuugaacagaugcagcggcucacaccuguaaucccagaacuuugggaggccaaggagggaggaucaccugagcccaggaauucaaggccuggcuugaggaauucaggccuggcuugaggaauucaagugagcaacauagcgggacccugucucuaaaaaaauuuuaaaaauuagcugggcaugguggccugagacuguaguccugucuacucgggaggcugaggugguaggauugcuugagccuaggaguuuaugguugcagugagcuauaauugagccacugcacucuagccugggagacaggguaagaccuugucucaaaaaaaaaaagcaaaaccaaaaagauuuaaugauuuuaugaaauuugaggcuuagauuauauuuugagcugucaucaaaauacauaaauuuuuuuuuagucuugccaaaaaaaauuaaaguugaauuucaucaagccuccagauaugacuacucaguuagaggggguauagaaaaacauguuaagcuacacaauaggaauauaguuggcaaaauccaaacuaugggaaauucuacaugaauaaacagccugaguucuucaacaaauaaauugcaaaguaaaaaaagcuagacagaugaauggcaacucagaaauguaaagaaaguuaagaaauguaucagucaauugcaauaugcagacuuaauuugauuuaagcaaaaaacugucuugucuuuccuugcacugccaccauuuaugauuuuuuaacacaauugaacauuugaaugcugguuggcuauuuaauauuaaggaaauauugauuuuuuaauguaauaguuucuguuuuuuuuuuuuaagacagagucucacucugucacccagacuggagugcagugguuuagucucagcucauugaaaccuccaccuucuggguucaaacgauucuccuaucucacucuccugaguagcugggacuacaggugcgugccaccacgcccagcuaauuuuuuguauuuuuaguagaaacaggguuucuccauguuggccagucucagacuccugaccucaagcaaucugcuugccucggcuucccaaagugcgggauuacaggaaugagccacugcgccagccagguuugguaugauuuuguguguuuauaguuuauauauauauauaaacuaaaauauuaaaugauguauucugguucuagagauaagcgguguaugacuuucagaguaacagaugucucguaguuaauuuaauuuucucuuuaaauguguugcaguugaagcuucuugucaugacggggaugaaacaauugaaacuauugaggcugcugaggcacuccucaauauggauuccccuggcccuaugcuggaugaaaaacgaauaagugagugauuaugauuguuuauguuuauguacuuuguuaaguuacucuugccaucuuucuuuauuaguaaaaucaagagauuagaaaugauguuauauauuuuuuguuacaaucacauuuuaagguauaguaggaauugaggugccuuugcaaaaacguagaguuaaagaugacauuuuaauuugagaaugaagccuuugggaacaaaaaaauguaauuuauuacuuaccaaauagaagaucaugcagaauuucuucucuuaacauauugaugagaguauuaggguaucaagggcccaaaugauuauaauuuagucaucucuguaguuaucagcaaauaggcaacaaucuauugaaaauuuuacugacacaucauggcauaaaauucacugccacauuauugaucugcuuuaaaauuccuguucuccuuugggcuuuucugacaagcaaucaaauucauaaaguaaauuauugcuaaaucagucuaaaauguuuauucaauauuugcuauauucacagcagcaauaauuaggcaauaacaugagauacaaaugagcagauacuguuccuuuccucaagcuuacaguuuaauuuugaagacaguuacuuauguaaauaacuacaaagccaagaauaaaggccacaagagugauagcgaauugcucuaguagcaguggguauucuagcugagaauaucagagacuggcuucauugaaggaguauucugaccugggcuguaaaugacaagcuuuuaauagguagaagagacaugaaaggucauucaagcuggagggaauggaguuaaagauacaagacacagaucuguuaaaaaaaaaaugaaugaaaucuuugagaucaagauguuuuggugugguugaaguguaagcuucauggugggugggaaaugagauuggaaagguagguuuggaacuagauuacagaagcuuuguaaggcaugcuauagagauggguugugauuauuuuuuuguuuguuuuuuguuuuuccuaugaacuauggaaagguaugucaguuuuguuuuuuauuccccuaauuuuauggucaggucagacuuagguuucagaaaauaacucucacagcaaugugaauaaucaagaggagagaugagacagacuggugauaggaagucaaguaagaaagacauugaaauagcucgccgugccuggacugguuuaggguauuugauuuugggaaggggaacuuaaacgcaggaauagauuucaagauuuuauuucuacuuuaaucuucuagucauaauagaaacaagaaauuuucucaaucguuuuuuaacuuauaauacacaguggacuauaauuaguugauuuuauuuucauuagauaauaauauauuuaguucaccugaagaugacaugguuguugccccagucacccauguguccgucacauuagaugggauuccugaagugauggaaacacagcaggugcaagaaaaauaugcagacucaccgggagccucaucaccagaacagccuaagaggaaaaaagguagguggguuacuuuguuuagggcgcauagucaagucuuggugugaaaucuagauaucacuuuuauucuacauaguucuuuccugcugcaguuaaaacuuauguaagaaaaacauugaaggcacaaaauggaaauuaugaguuauuucuuggccaggcacggagauucaugccuguaaucccagcacuuuaggaggccgaggcaggaagauuguuugaggccaggaguuugagaccagccugggcaacaaagcaagaccucaucucuacaaaaaauuuuaagaauuagcugggcacgguaggcaccuguaguccuagauacuugggaggccaagguggaggaucccuugagcucaggaguuacagguuucagcgagcuaaggucaugccacugcacuccagccugggcaacagacugagacccuaucucuaagaaauaaaauaaaauaaaaauaaauaaauaagaaaaagagguauuucuucauaguagaaucauuucuuuuaaaaaauuaaaguauugggccaggugcgguggcucaugccuuuaaucccagcacuuugggagguggggguggguggauaaccugaggucagggguuugagaccagccuggccaauaaggugaaaccccgucucuacuaaaaauaugaaaauuagccgggcauguugacaggugccuguaaucccagcuacuugggaagcugaggcaggagaaucacuugaacccaggaaguggagguuacagugagcugagaccacaacauugaacucuagccugggcaacaagagugaaacuccaucucaaaaaaauaaugauaauaauuaaauuauuuuauacuuuuaaaaaguuuggucuaucuuacagaaaagggauuuuccaacuuuuuaaagccucaaauuuuuaucuaaacccuuuuguccuuggguaaggucuagucagcuuccuucccagggguuauuguuugaaagccuccagucuguaccggugauuccaguauaagacuccaguuggaaaaauacaauggguuggaaaucagcagguaaguaacugaagaggaguauuuuaggauguguugagugggaauuuuuaacuuuuugccaauuaggaccacacuugcauucuaaagucugacaccuuuuccauuuuauugccuucugauucuacucaugcuugcuuaguauuuugaguauaaugucuugauuaauagcaucaccacccacccaguaaccuaaguucaugugaaagucagggaaauuccaagagcugaaaaugaagaggaaaauaaaaauaguaaacaugagccgacacugcagcagcucagaagggcugagaaggauaugccgaggggcucugguuuuauuguccguguugaggcagaagcuuaggucuugggcuacgcaagaugggguaucggacagagaccucagcauguaacugggacccuugaagggauauacccucuugggggaaagaaauccacccauuggcacagacagaugucaaggaagcuugggucccauucagccaggccucugaguggagaaauucugguuuaauuucuuuuggguaaauacuuaguaguggaauggcuggaucacauguuaaguguacauuaaauauuuuucagaaacacaaacugcuuuccaaaaaauuuuuucuccauguauuaagguggggcagucauaggacuugccucauuuauuuccugucucucagggaucacuggcuuuuguugaccgauguccaauuucuucaguaccauuguuucauaccuuuuuuucuguguuuuuaauuguuucaggugggaagauaaauccauguucuguuauuccaucuugacuagaagaggaaguucccaccuagucuuuuuuaauagccuuauucuucgaccauguuuuuguucuuuugcuuuaaaaccucuaaucauacuauguaaaguuucuauuuaauaauucuguuaugugugauucuuagagaacuaauccuaggguuuccuagucuacugcuucucacucagaaagugucuuccucauguauucugugauaccaaaaugugaguucagcuucaacggggcuuuaucugaggaaaucuuguauggccuagguugaauguauaacccaccugagcaauucuauaagagcuucugccuggugccccauaguuauuacaguccuggggcuacaucuguguuaauuacuuggcuggcaauuccuaauguuagugguaguuuaaaaucuaguuguaaacccagguuaagacaggcccaggauuaacuauguuuauagaaaaauuuguacauaaauggcugaucucaacucauugcauccuccaccucuuggguucaggugauucuccugccucugccucccagguagcugggauuaaaggcaugugccaccacaccuggcugauuuuuguauuuuuaguagagaugagguuucaccauguuggccaggcuggucuugaacuccugaccucaagugguccaccgccucgaccucccaagugcugggauuacauggaugagccacccugccuggccauuuauguacaaauuuuucuuaaauauguaguauuuguuuacccagucagcaguuaaugggauuuggguuguuuguaguuuggggcaacugcaaauaaugcugcuaagaacauuuguguaucuuuuuuuuuuuuuuugagauggagucucguucucucacccaggcuggagugcaguggcacuuuuaucaacacaguaaaaauaccacucaacaauaaaacaauauacgauugguacauucaacaaaaauggaugaaucucucaaaauaauugugcuaaaagagggaagccagaagaaaaaauauguuucuacaguuuacccccaaacaauguggggguuagggccgucagccucugcagccaaaaauccauguaaaacuacaggcgagccccaccauacccagcuaauuuuuaauuuuuauuuuuguagaggugggucucacuauguugccuagcuuggucuuaaacuucuaggcucaagcauuccuccugguuuggccuucccaaaugcugagauuacaggugugagccaccaugccuggccaaaggucuucaugcuuguuguguuuauguuggcuaggcugaggagggaggaggaagaaaaggguuuggucuugcugucucaggaguagcagagguggaagagauggaggaaguggaaggggaggcaggagacacaggcacacuugauguaacuuuauugaaaaaagaucccuauauaagugggccugugcaguucaaagcuguguuuuguuugagggucaguuuuauuuuuauauaaagcucuagaaacuaccaacuaaucuauaaugacaggaaacagaugagugguugccuguggauugggcagggugaggaagggcgagauguaaggauuacaaaggggcacaaaguacuuuuggggugaugaauauauucauuguuuugaauguaguggugguguuaguauacauagucaaaacuugucaaauuguaaacaucaaacauacguaguuuauuauaugucaguuauaccucaauaaagcugcuuaaaaaauaaaaggcuaauauccuacuuaauguugaaaaacuauugguaugauaaagaaccaaauggaauuuauagaaauaagaaaugaaauugggccaugcucaguggcucaugcuuguaaucccagcacuuugggagucugaggcgggcagacauccugaggucggaaauucgagagcaacauggugaaacgcaaucucugcuaaaaauauggaaaaaaauuagccaggcauggugguacgugccuguaaucccagcuacuugggaggcugaggcacgagaaucgcuugaacccaggaggcagagguugcagugagccaagaucgcaccauugcauuccagccugagcgacagagugagacugugucucaaaaacaaaaaaaugaaaugaaauugaaaacaucauguguggauuaaaacauagacuagucacugcuuaagaaagaauuaguaaacuccaguaaauuuaguguggauuaaaaaauaugaaacaguuacagacauggagaauuaaaugaaaaggucuacauguuuaaucaaaguuccagaaacagaauauaaaaagugaggaagagacaauauucaagagauagugacuaagaauuuuccagaaucacauuaauccucagcauugugaauccugaguaguucagcuacaauaaaucuaggccuaaaugcauuguugguaaaaaugcagaacaccaaagaccucucuucaaguucuccccacucaaaaaaaagaagccgaccggggagaaacuacauuacuucaagaggauugauuuuuuuuuuagauuggcaguuuagaagcucucaggagaggcuggaagaauuagacaucuucaaagggcugagaagaaaccacugccaaacaaaaauucuauaucuaaccaagcuguaauucaccugaagcuuuguacauuaccaccuugaaugauuaggaagauguuggagaggauggauacuggguugggaguuuuuacuggcagcaucuguugugacuaaagcuaguggaggaaaguaguggaaauaaagacgauaucuauuuuuuuuaagcugguauauauuaauagcauaaaauaagguggagguuacugaaguguuggcuucuaauacugguugucaugaacacagccagaagaaucugucucaugaaggguucucugcagaugucuccagugaugaaagucgagauacuuggcugacuagcauacauuuggcagucuuagagacugaagagcgggcuuuuugacacuuuucucccuuccuuucauucacccaaaugacuucagaaauguuuuccuauuccauuucuggggauaaauugucacugaccuugugauuuuuuuuuuuagcuguaaaauucugcuuuucuaaguuauugcccugcccuguguuauauuuaccuguaauucaccacaguaaucuaaaccagagcggcagccucaaggauguuuggguaggagguaguaacucuucauuguuucucacauauagaaugguaguauguucagacagcaugaucaugaucucaaccuaaauacaaggcaguggcgcugcuaggccaugguucuagauacuuggcaaaagaagaucacaaauacggcuuuagaauaguuuaucgaccccacucugaggcuauugggauggacuuauuuagacauugaugguggguaagguaacuaugaaguuuguugugaauugaaagguacagaaaaacgagauguuuuuagaaauacacaggaggauagcauuuaacuaugugguucaccaaaauuuugccucacauauuuucuguauuucuagaguuugggaaguuucuuauacuugagaacuaacuguauacagaaauuauuuaauagagaaaaaagcuaaaaauccacuucuccuaccuuaaaaagcuuguauaauuaauaggcagacaaaacuguauggcuuauuuuuggagcccacguucuaccaaugucaagagcauucuccaaaaguuuaagaaagcacuaccaguauggguacuucaaaggcaagcuauaguaauuuaaauuaacuucauuuuuacagauauaaacugaggugucaaagguaucauuucuuacauaaguguguuuaugguuuaaccugcauuaauguccaaguuuuauuaaaguuguuuuccuuuuaguaaacagcauuuuaagagaccuguauaugugacccauguauaaaaacauuuggcacuugaaauuuaggguaaacgacaaaauagcugaauuguccauuuucucucacuuuugaaggcaaauauuuaugcagagcuguuuuuauuucaggaagaaaaacuaaaccaccacgaccagauuccccagccacuacgccaaauauaucugugaagaagaaaaacaaagauggaaaggguacuacuguguaauacuuauaggucaaauaacacucagauugcuuuauagugccuaccuauuauaacuagaaaccaccagcuuucuugauauacugcaguggaucuuauugcugccacaugcuuauuagauacauuugccaaauucuuaaaacugauaguaaaguagaccaagaaacucguuugagugauuuucacuuaccugucaaaauaaucuauucuuuucauuuaauaaagagacucuuggaagaauuuaaccagguuagauuuucaguucauagacccuuuaauauguugucuugaaauucaagcauuuguauaacuguugcccaaauuugaagaaaacuguuauggccgaccugcuggcucuaaucuaaagagaacuacuguugagagaguucacaaagagacagaaaaaaauuaucucaaaguacuuucuccuaaaucaucacaaaucuuaugacaagauugcuuuguucacauauuuuauaugggacucauaaaaagaucuuuauuagaugcuaaaaauuaugaccauuauaucacccauacuaacuaaauuaugucaccaauacuaacugaauuauguaauauuuuuguauaaauauaaauggcacuucuaagacuuuuaguugucuuuuuugagguucuuuuaaaugaaauuuuggucauuuagaaagaaauuguuuuuguuucaggaaacacaauuuaucuuugggaguuuuuacuggcacugcuccaggacaaggcuacuuguccuaaauacaucaaguggacccagcgagagaaaggcauuuuuaaauugguggauucuaaagcaguguccagguugugggggaagcacaaaaacaaaccugauaugaauuaugagaccaugggaagagcacucagguaugcgaaguuuugguauuuuauuguguuaagaauaucauuuucuaaauuguaaaaaaaaauacuaagcuuaaguucagcaaagcaccaauagugguaaugcaaauacauaauaagaggguacauuuucagucaggugcgguggcucaugccuguaaucccaacacuuugggaggcugaggccgguggauugcuugaguccaggaguuuaagaccagccugggcaacauggcaaaacccugucucuacuaaaaauacaaaaaauuagccaggcguggugguaugcaccuguggucccagcuacucggcaggcugaggugggagaaucaccugagcccgggagguugaggcugcagugauccagauuguacuacugaacuccagcuugggcaacuggagugagacccugucucaaaaaaaaagagggugcauucucaaacaugaauugcaaguaugauauguuaguuauuauaguagaauaaaucagugcuucaggaguacuacuagaaaucaugagaauuuugaacaagaguaacauucuuaagcucacuuuuaguucguuuuucggugauucugucauuuauccuucaagauacgcauguauuugagaaagauguauuggaaauaagaacgaucugaaugacuuuuaggggauagacagauauagauauaaaauuuagcagucuuaaacuaaaacucuuuaauuacaguuuuuggguuuuuuuaacauacacuuuuuaaguucuugauuuuguuaaaauagaugacaaaaguuggaucacugcuauugcauaugguuaaauuuuauacacaaaagucaaucaaauuuacugaaucaaauuuaaacugauacauuugccaauuuaaauuuauugaaucaaauuuaaacugauaaaauuugccuaguaggaacauuucuagaaagccguggaggagaaacaauuucuugaggcuuuugguaguuuugauuauccuggcaaguuggcagaggggggcugagugugguggcucgcuucuauaaucccagcauuuugggagccugagaaggaaggaucguuucagccugggaguuccagaucagccugggcaacauggcaaaacccagucucugccaaaaaaugcaaaaauuagccacgugugguagcaugcgccuguggucccagcuacugaggaggcugacguggaaagauugcuuaaggccaggaguucaaggcugcagugagcugugaucaugccacugcacuccagccugggcaacagagcaagacucugucuccaaauaaauaaguaaauaaguuagcagaaagaggaagaaaagugaaagaccagaggauuccacauaguuuaucaacagucccccaaucagcauuaguuuuagauuuaguugguaauaagaacuuaucucuaucugugcauaaauguauguuuaucucauauaaaauaacagcccuuuauuuagaaauucuuuucucauuaguuugauuccaacuuuaaaguuuuguuuaugauuagggaaauuugauuuuguugaauauuuuaauugauguuugauugauugaugaaauugucugcuuugaauagguacuauuaccaaagggguauucuggcaaaaguggaaggucagcgcuugguguaucaguuuaaagaaaugccaaaagaucuuauauauauaaaugaugaggauccaaguuccagcauagagucuucagauccaucgcuaucuucaucagccacuucaaauaggaaucaaaccagccggucgagaguaucuucaaguccagggguaaaaggaggagccacuacaguucuaaaaccagggaauucuaaagcugcaaaacccaaagauccuguggaaguugcacaaccaucagaaguuuugaggacagugcagcccacgcagucuccauauccuacccagcucuuccggacuguucauguaguacagccaguacaggcugucccagagggagaagcagcuagaaccaguaccaugcaggaugaaacauuaaauucuuccguucagaguauuaggugagaaaaccaaacuacugaugcuuaucacuucaauauguuucugaccagagacauuauuuguuaagugggucaagauucagaaaugaaaauaaaaguauaaagguuucaagcuagaauucuugguuaccagauuuuucaggagcaguuacuauuaugucaguccucugauuaugccacuggucccuuuauuuacauuuugacauuacuggcauuauucugucaaauacuacaccuuuguauaacuggauugauacauauaagaaauuaucuagaugggagaaaauccaggguuucaaaucuuuauucaggccaagucagaagcuucaaaaauucaacauaaauugacauauuaggacauugagagugcauagaguuccaagcaauaaauguuauuccuuggaagauccuaucuucgaacaauucuaaaguucaaauaggaagggaggccaagaaucuaagguccucuuuuagaguggcagaaguugaaaaaguagguuuguuuuuuuuuuuuuuuuuuuuuuuuuuuuuuuucaguuaaaucagauuugccucagagccccaggaugagaugcuaaacaacaaauugacugagaggaucugucugccuuagacugaucugcagaaauuugggacuagucucagcugacuuagaaugggaguaugggaggaaggcagaaaauuauauggauauuuguagcauuuuucuguuuauacugucaugaauuucuagaacaugaaccauaauaaaaucuagcagcccuuucaaagccaauaaaaauuauuauuugauuacuuuuauuagcaaacuucagucuuacauuuuuauauuccagaauauaaauguggagguuuugcucaguugaucuuggaguaagguaacauuaccuagaaucaaggcagacuuagaagauucagucuucuuuguauagacaauuuaaaauguuugaccuugugaaaauauucucuuaaaucuucacuugauuugcaaggaguacaaagaugaccuuuacauuuuuaauuggaugcuacaucuuuuaacuguuauuaaaggaguauaucuugaguagcccuuauccaaaaugccugggaccagaaauauuuuggauuuagaauuguuucggauuuugaaucguugcauuauacuuacccggcacagcaucccaaauccaaaaaucugagauccacaaugcucccgugagcauuuccuuugagcaucuuauuggugcucaaaaaguuucauauuuuagauuucagauuuucggauuugggaugcucagugggugcuuauuuaacucuuacuguccguauucuccccuuaauguuuuauauuucccuaggcccuguggguuacaggugaugacugggugucugguugggagugugugguuccucccauugguuucuaggcuguuuguuguuuguauuuguguugauaggagaccuacaguggccacagcugauuccauggaauuuuuuuagcaucuguauucaaaauauucuuuuuagacugugagaauaaaaccaaaacaaaaaacucuagcuuugaaagauacuaaauuguagauauuauagaguagguuuuuguuuuguuuuguuuuuuugagacaaagucuagcuagcuuuguugccuaggcuggaguguaaugacaccaucauagcucacugcauccuacuuccaggacucaagcaguccucucaccucagccuuccucauagcugggacuacaggcauguccagcuaauuuuuuaauuuuuuguagaaaugggguuuuacuuuguuggucuugaaccaagaccaaccaagcaauccuaccaccuuggccuccugaagugcugggauuauaagugugagccacugcaucuggccuagaaugguuuuuuauuaggacaaguucugguuuuguuauuucuuauauuuuuuguuugcauuuuuguaauuacccaaccuuuuacuauggaaaauuucaaaguauggaaaaauucagcuaguacuaugaacacuuauuuacuauccaccuaaauucacaaauugauagcauuuugcauuauuuguuuucucuauuuauuuauaccuuuuuuucucuuugacuauaucuuucuugauuuuugaugacuuauuaauaaaaucagaggcuuuuaacuuuuuucccugugguugagagaagauggaauguauaugauuauauauauaauuagauaaauuauuaauauaacaacaagagcugacacagagcacucuuuguacuucauacacuuuacauauagugaggcauagaauccucauagcucaaugagaauagauaauauccccguuuuauagauguggaaacugaagcaaggagagaccagggaacuuggucacauguagcagaugguggagauaguauuuuaaugcuagcuguuuagcugcaagcauugaaguuaaugacuugcuacacugccuaccgauuuacauaaaucacaggaauugucaguuauuuacaguaaaacagcaacaucuuaauuuuguccuucacucauuucuuuuuauuucaugugauugcauguaucuauguugauucaguuaagcuuuucuuaauugguguacaguauauaugcucaguuuuuacaaauuuacaaaaagaagccaguuugauucuggcuucaugguagucaaagaaacaacaacagaaauaaacugcugguaaacuauuuucugaaaauugccccuugguaaacauuggagaccauuuuaccuagcauaacuuuuauuuauccaagcauuaauaauuuuucuuaggaucuuuuaaauaaauuauccuggccaggugcagugccucacaccuguaauuccaacacuuugggaggccgaggcggguggaucaccugaggucgggaguuugaaaccagccuggccaauauggcaaaaccccgucucuacuaaaaauacaaaaauuagcuggguaugguggcaggcaccuguaauccuagcuacucaggaggcugaggcaggagaauaacuugaacucaggaggggcagagguugcagugagccaagauugcaucacugcacuccagcuggggcuacagagugagaccccgucucaaguaaauaaauaaacaaaccugugaaaauguauaauguguagguuauccuaaaagcauauagaagcugggcgcgguggcucaugccuguaaucccagcacugugggaggccgaggcgggugaaucacgaggucaggaguucgagaccagccuucccaacauggugaaaacccgacucuacuaaaaauacaaaaaauuagcuaggcguaguggcgggcgccuguaaucccagcuacuugggaggcugaggcagaagaaucgcuugaaccugggaggcagagguugcagugagcugagauggcgccacugcacuccagcccaagugacagggugagacucugucucaaaaaaaauuuucagcucuucagccuugcuaauuauuagaugugaaauugaaucacguuaauuauuuugagucuguuuccuuaucuguaaagcacagaugauaauauuuaaccuuccacuuggcugugacaauuaaaugacaccugacaccugaguagauccucaacaaaugcuaaauguuauauggucuguguuaguuucagaaauuuugauaaauuguaaauuagcaauauuuuuccaguuguuuacaagcagcuuaggagauuuuuaaaaaguagucagcuguaauagaaucuguauuacauaauacaaccagacgcaacugacaguuuaaucauuaacuaagaagaaaguaauucugugguuggcaaagacuuaauaauauuuuauuuaaucucugaauuuguauuauugaaaauuguuuuagaauuuguuccaauaagccaauauauuugcaucguagaugguauagauaaguguaugcauuuucugacagauggcagucaggugucucaagaaaaggacuuuuuuuuugagacugagucucccucuguagcccaggcuggagugcaguggcacgaucucacucacacugcucccuucaccucccagcuccugguucaagcaguucuccugccucagccucccgaguugcugggauuauaggcacgcgccaccaugcccagcuaauuuuuuuuuucuuuuuuuucuuuuuuuuuuuuuuuuugagacggagucuugcucugucaaccaggcuggagugcaguggcgcgaucucggcucacugcaagcuccgccucccagguucacgccauucuccugccucagccuccccagcagcugggacuacaggcgcccgccaccacacccgacuaugcccagcuaauuuuuguauuuuuaauagagaugggguuucaccauguugaccaggccgucuugaacucuguaccuugugauccacccaccuuggacucccaaagugcuaggauuacaggcaugagccaccgugcccggccaagaaaaggacaucuuuuucuaauuuaaacagaagcagcgaaguccuagugguagcccugauuagcaauauggaaaauuuccaaguacauuauugcuugugucauaccuuacagaaggaaagaagaaugagagaggcauauauuagagaguuguaacugccuauuguuuaaggauagaauaauaaauacucaucuuuaguauuuacuaaagaugaaguugcucaggacuuaaguggcggcagucuguuguaaugguaaggcggcacaucggcucugcagucagauggccucucuucuucucuaacuggucaccuuaugcaagcuguugcaaccuguuugugcaucaguguuuucguauguaagauggggauaauauuuguaggguggcaagguuauacauauuauaagguuaugcauauugauguaaucugugugcuaacuauaugccaaguacuauuuuaucuauguguauguuauguaaacucuugucaugggaagcccuuaggccuuuuuuauuuaaaaaugguaucugggcugggcacgguggcucacgugaugccaaugaugucaggaguucaagaacagccuggccaacguggugaaacccuguuccuacuaaaaauacaaaaaaauuagcugggcaugguggcgggugccuauaaucccagcuacucgggaggcugaggcagagaauugcuugaaccuggaagguggagguugcagugagcugagaucacaccacugcacuccagccugggcaacagagcgagacuccaucucaaaaaaaaaaaaaaaaugguaucuggcuauagcgucagguacuguacccaggcucccaucucaccccagauuucccugaaucaaaugggcaagagaacuuggguggccaucuaaguuugguaaucuguauccugcgugaaugggcgggcucuagucauccugugucuuuauucccacuucuuuugaacguguccugaauugcucugggucuuuguuucaucuuuccaccaagccaauuuguuuuucuccuccacuauuuuauuucucauaugugagaaacagacugcauaacuaacuuucaaaauguagcuuuaauaaucuagugguaauauuuaacgcuugguuuauggagacuagucuagcugucagcuguuugaaauagcaaguaucuuucauuaaauaacuuuacagaauucaaaggaaacaguugacauccagauacugagauuuuucaacaccauuuguuuuauacuauauuaacaauaaccuuaacuauaaauuucagagcugugaacuuuuuaaauuagauugacucauaauaucauuuauguaacuuucucuucaaugagugggauuaacaaccuacauaaacuagauuuugcauuaaaggauuuuauguuaaacuguagcuuuaugaccaaaauuugugaaaauuauuugaaccuggaaaacugcuaaaacaugcuucuauguauuuuuccaaagcuuagccauauuuucucuaccaguccaagagcccugacagguuaauuauaaucauggcuuguuucaucuaaauaugacaugaaaugugagcuauuaaaauucuaagaauucugucauaugguuaagacugagguagguuuuuuguuuagguuaauuaagcacuucucccuuuauauguaaaaacagguugaauacaauuauaugaauuuugguaauuauuguggaugagcauguugguaacauuaucucucaaauauuaaaauagcaggccgggcacaguggcucaugccuauaaucccagcacuuugggaggccgaggcggguggaucaccugaggucaggacuuugagaccagccugaccaacauagaaaaccccaucucaauuaaaacuacaaaaauuagccgggcgugguggcacgugacuauaaucccagcuacucgggaggcugacaggagaauggcuugaacccaggaggcagaagcuacagugagccaagaucacgccacuguacuccagccugagcaacaagagugaaacuccaucuaaaaaaaaaaaaaaaaaaaaaaaagcaggaaugaaucaaacagauuugcuuuuaaauuccuaauuuuaagaagcucaugcaaacuucuugcuaagcauuuuaacauccuccuccuuccccaacaaaauuagcuccucauuuguguuaauguggcccuauguacagaccuuucuuccauagcacucagcagaugguaucauaguuaauggccugagaguuuuguguuaggcaucucuguauguaguguuuaauacaaagucuggcaugauauuggucaugcucuguugaaaauaugggaagcagcauuuugaaacacauaacugguauuuuguaaaaugacuugucaaguguuaaaguuuuaaaugauguagaauaugcuaauugucucacuuuaauuucaucaucucaauaggacuauacaggcuccaacccaaguuccagugguugugucuccuaggaaucagcaguugcauacaguaacacuccaaacagugccacucacaacaguuauagccagcacagauccaucagcagguacuggaucucagaaguuuauuuuacaagccauuccaucaucacagcccaugacaguacugaaagaaaaugucaugcugcagucacaaaaggcgggcucuccuccuucaauugucuugggcccugcccagguucagcagguccuuacuagcaauguucagaccauuugcaauggaaccgucaguguggcuuccucuccauccuucagugcuacugcaccuguggugaccuuuucuccucgcaguucacagcugguugcucacccaccuggcacuguaaucacuucaguuaucaaaacucaagaaacaaaaacucuuacacaggaaguagagaaaaaggaaucugaagaucauuugaaagagaacacugagaaaacggagcagcagccacagccuuaugugaugguaguguccaguuccaauggauuuacuucucagguagcuaugaaacaaaacgaacugcuggaacccaacucuuuuuaguuaauauaccaaagcuuaugaauaauuguuuguuaauugaacauuuucaauuauaugcagacugacugauucuaagauaaauucuaaggagguuucuaauuuuguaauuguuaaaaauagaguuaauuuugacuuuguuagaugagggaggaaaacucaacuguuucucuuuguuaucuaaauguuucagaauucaaucgugaaggaacaggcauuuuacacuaugaagacauucuuuugagauuuuuauuucaguugcuauaucauaagcauuuuuaaaguuucuuuucuaauuuuacauuguauuagauuuucugauucuuuuguaaauacagaacuuaaauagaaggcaacaggaaauuuauauaggaacuauuuucauuccacuuguguaaguuaagucuugacucuuucaaaugcaaaaaaccuauuuuaugcuuuguuaaaauuauggugucacuuagauugacuuuaguugacugcacuauauaauauagaacuaugaauauguagaauaacaugaaaaauuggaggugcuggugguauggcugacccuguuucagaagcaggauaguauaaaagcaucagccuaagaauggcacucccacuaacuagcuauguaaucuugaccucuuugggcuuuaguuccucucauaaaaggaagagauguauuggauuagacuagaugaucaccacuuucucuucuaguucuaauuuuuuuaauucuaauaccuauauuuucaaguuaugucaauuaaaucauuaucagguuauuuccuaauguaagaauagcuaaaauguugcagagaaauaagugacccaacaaaauuuauucaucuguuauggguaagaucugccauaaauucuuccuaaauaauuuguuuacuaacucuuuaggccacugugcuuugcgguccauuaguaaacuuguguugcuaagugcuaaacagaauacugcuauuuugagagagucaagacucuuucuuaagggccaagaaagcaacuugagccuugggcuaaucuggcugaguagucaguuauaaaagcauaauugcuuuauauuuuggaucauuuuuuacugggggcggacuugggggggguugcauacaaagauaacauauauauccaacuuucugaaaugaaauguuuuuagauuacuuuuucaacuguaaauaauguacauuuaaugucacaagaaaaaaaugucuucugcaaauuuucuaguauaacagaaauuuuuguagaugaaaaaaaucauuauguuuagaggucuaaugcuauguuuucauauuacagagugaauuuguauuuaaacaaaaauuuaaauuuuggaauccucuaaacauuuuuguaucuuuaauugguuuauuauuaaauaaaucauauaaaaauucucagugucuguuuucaggcaaaaguuucuuaaagaauaagugugcagagaauauuacuagaacaucagcauuacuuaauguuuauaaauaaauuucauuagucagaauugca

SEQ ID NO: 192519 - RNA, 35603 nt, Homo sapiens
cugggccggggugcggcugggaggaaucgguccuccacugucccagccggccccgcgccggcgugucgccucccgucccccuagcagcacgcugcguggcugcucgcuggcuauuuaggacggaagcucgguugguguuucuccagaaguuucccccuugggcggugguggaggugguaaccgugauaguagcagcuccggcggcagcaacagcgacuacgagggauggcggcggcugcagcaggaacugcaacaucccagaggugcauguuuuucuuucccuuugguauuuauuuuaucccccuuuccuuggcuagugagcccugcugaagucguuguuuuccugacagguuuuuccagagcuucucggaugcccuaaucgacgaggacccccaggcggcguuagaggugagagagcccauuucugcuuccuccacucuucuuaggggagcugggccacuucggguccccgcugacccgccuucuccccgcaccgccggacagggacccaggcucuuguugaugcugcgucucagcuccgguauugagauucuccgucucuuuucucuguuacacgguagccgcguuaccccagacuccugucuugcccuuuccacucccuacagcuccugagaaaaaccuccucuauuucuugggagcaugguuggcauuuguaguuuggcugaaaggauuuuuuuuuuaaugacauuuaugauuagagaaguggacucugggcucgaugaaguuaauuuuuucguuugacaauaauucuugccauucuuacguaaaagugucgguaugaagucagucuacuggagcaaaacccuuuucccucacgucccugaaacuuuccagaugucuuaucacaauucauuauucacucauuuguauauucaucaaaauuuuuuuuuggaguggcugugugcaaaggcgcugauugcuguggguuaaagucuugguuauauacucagcuaaccuagaaaucacuuuuuguaggugugcaaugaaggcaaaccauaaagcuguaaaggaauguaaaagaucaagaguuaaauaauaagaauuaaaggagaaccuaaagauaaaugaugcugcgggucacagaauuuagccaggaguuuuuguuuguuuuugcguuaaaucacagaaaagaggaaaccuguuuugcuguuacguuuaacaauuugaggcaagacagcgucuuuucuagcuaugacuuuuauaagaaaugugccacaugguacuagagccuccguugaggagaucuuugaguggagauuugaaggaacaagggaauuaacuuggaagcucuggggaaagaauauuccaggcaggaccaagagccagugcagaucuugagguaggaaugaaguuggccuguaugugaagcaacaaaaaggcccuuuuuauuagagggcccauuugauuaagagagguuggacaggaaacuaggagccagguccuauaaggccuuuuaggguccagguguguuuuuuacaccuaaauauauagaccuuuagauacugggaguaaggcuucugggaugaguuuggggauaauguuacaggaagcacugagaauuuuucuccauaauuucuuguauuagcuagacagcuaugacuuuuaauuuacauuuguuauugucguguuagaccuagugcuuccuuugggaauccaguuuauauaaaaguugcuuuuaaacaguauuaacauaaugaauuuuauugucacuuuccaucuucuuuuacuuuaaaaauuuuuauggaggcauauaugauuuauguaaauaacacagauuuuaagucuauaguuugaugaguuuucacauguuuacaccaccagauuaagauacagaguaucuccauucauaaugcuccuuaaugcgccuucucagccaguaauucuucuuacuguccugcugacuccugcuuugaccuccaucaccaucaguuaguuuuguuuguucuugacucauaaacagaaucauacaguaggugcuuuauugaauguagacacucuuuuugcuuuaaugauuacauaaguauacauucauauugugugaaguaguaguucuuucgcauugcuguguaauauuccauuguauaaauauauguuguauagccguaaguacggcgcaauuuauucuaacaguggacaucuggguuauuucuaguuauuagcuaacaaaaagcuucugugaauacucuuguacauguauuuuggugaacacaugcauuucuuuugguuguauguaccuaggagaagaauugccuaggauagucauguggcuaguauuaguaccuugguuuuuaauguauggcucuuggaccagcauuaucagcaucaccuggcaauucauuagaagugcagccgggcgcgguggcucacgccuauagucccagcacucugggaggccgaggcaggcggaucacgaggucaggaauucgagaccagccuggccaacauggugaaaccccgucucuauuaaaaauacaaaaaauuagccgggcaugguggugggcagccguaaucagcuaccugcgaggcugaggcaggagaaucacuugaacccuggagguggagguuacagugagcugagaucgcgccauugcacuccagcccaggcgacagugaggccaggccaucaaaggcauuaaaucccagcacaggguuuucaguuuuaucauaugauuauggagauccgucaagaauuuggaggaaggaaaaugaaauuuucugaauuacaaaaccuacuuuaaaagcagaguagauagcgaauuggaggaggcacaagggauaguggauagcaggaagaugguagugcagaccgggucaaagaugaauauuugcauguagggcagugauugagggcauggaggugaguuguuuuauguaaaaugcaccggacuuggugacgauuagaauauaagggaugucuccugaguuucuggcugggggaauguuguaggaacuggugccauucauuuagauagcacuuaggaugauagcacuuagaagauugccuucagcaugggggaauagguuugaggauagaaaguaguuuuagauugugaauauuuguauaugaguugccucugggacauuucagguaaaguuuagagaaaacuauaugcugauguugcccaggaccacugucuaggcucaagauagacuugagucaucagcaugcaucaacacauaugugaagccccccaguaguuaaggaaucaaagaauguuuguagaggggaagaagucuuaaguacugagcccaaggagaacauuaguuuuuaagaggcagcagaaugguaagcugaaaggccugguuauuauugucaagggccacagagagaucaagucagauaggaaucaguuggauuuuauaagggguuauuagugacuuugagaagauuaagacuagagaggcaaauauuuuuguauucuauggcaaaggagaugcagucaaaguagagacuggggaaaaggcugaaaaaagucugcaagaagaaaaaucaauacuuuucauugagugauuacuggaugucacauacagaucuaggcaagcccaacacccuggagucaucuucaguuucucuuaucccacauguucacccauuagcaagucucucugcuucuaauauguuccaacuuaaucguauuucuuuucaucaccucuguggcuaacauccuuuucuagccuagacuuaauguaauaguuuccuaagaagucuccguuuccagucuugauuugauaauguauuuaccauacugcagccagaaugacauuaaaaaaaaguaaauuggaccauguuccccuuacuaacagugaacuuuccauggcuuuccaucaaacguaagguccaaauuccuuauaacugccugcaagcuacaaagugaggcccuuaaaguagcaucuuacagcuucuuugcucucuugauuugagccuuacuuucuguugauugacuguaaccccaugugaguugaggagcaucuguauauguugcuuucugagagucacacuacuagguuaaagcaaagucaaugauacauguggcucuugaaauaauuuuaccauuuaagaaaacuaccaaaucccuagaguuuguaggcaguuggcagaaaauaaaaguguuccugcacuugucuuugaucucccuaauuguguaaucucuuacaucauuauuuuuccagcuaccacaccuauauguugugacugcacaaguuaaaaaaguuucaaucucuaauguuaacucuugguaguugacauagccaucuauuagauuguaucugggcuuugaacagaauauuuaguuggguuuuauuagaguugugugcuauuguuagaggcuaggagagggccagguacacuugauuguguauguauugauugucuuaaccucccugagugcuagauuuaacuucuggucuuuuuuuauugcacagcuuaacauuuucuaggaaucucaaauucuauaugguguuugaaucuucuucaaauuaguaggaggaaaucuguaauggucaauguguaacaauuaaacucuucagaauauaugagcugauaauaaugaucauuuauuaaguucuauagaccaggaacuaaaagcuuuacgguacagagaugcuacauuagauugccuacuuuugggaggaggggcaagagaagugggggagauauugauccuuuuauaaggaaaaacuccaauauuauauccguguuaucuuuccuccaaauagcuucugacaauaaguuacuugauuaaaaauuauguuuuaauuagaauuugauggcuucuuacaaacuuuuacugacgcuccacauguuuguuuuuguaggagcugacuaaggcuuuggaacagaaaccagaugaugcacaguauuauugucaaagagcuuauugucacauucuucuugggaauuacugugguaacguuucuuauaaaguauauugcccccuuuuaauaaguuacuuauacauuuuacccaugacaaauuaaaaguugucuuugagaauuuuuaaauuggucuuuuauacaagguaaaguagcucaaaugugacagacauguugagcaacacccauuuaaauuuuauggaugucgcuuuuuccuucauuggguggagaauguauacagauuucauucauaguuauuggguaugcugauaaaaaauagcaucacauuuacuauuugacagacuauuaaaaugaaaugcucguuuaaauuuuuuuuauaaaaaagaauguggccaggcaugguggcucacgccuguaaucccaacacuuugggagaccaaagcaggaggaucauuugagcccaggaguucaagaccagccugggcaacauaacaagaccaccuguauuuaaaaaguaauguauuucuguauuuuguaccuucugaauagggaaaaacugaauaccuugaguaaaauuacauagaaaauguuaaugagacaaggaggugaauuuugugacacagcuguauucauugaagagcuuuaagaaggaagcuaaauguuaagccaaaaggaagguacaagaguaauauuuauuugaauucuaucuuguauuagcuuuuccuaauuuaaaaccauuuggcauuucuaccaacuugaaaacuuagaaaucuaaaacugauucauauguuguguguauuugcuaggaucuauaaauaacugacuaaaaacccgucuuuuucuacacaguugcuguugcugaugcaaagaagucucuagaacucaauccaaauaauuccacugcuaugcugagaaaaggguaugcaguagcuacucuucuuguugagcuugguauagauaguagguauuuaauuuguugaaugaguucauugcaagcuuuauauaaguuguaaaauucuguauuuauacauuauauagcagagauaugauucaauuuuaaauacaacuuauaguucuauuauuuuguuaaccaaaguaugugauaggagaucuguacuuaguaaauuuuaaaauagugaugauugaaguauuugcaagguauagaugaaacugauagauuucacauugcuuuuuuuuuuuuuuuuuucaaucuuuuggaauuuacuauauuuaauugacuggacaacauccuauucagcaaagcugaauaggcuacauuuaaugcuaugaaagcgcuauaucuguauacuuuauaucccaucuuguuucuguugauaaguauaacuauucuuuaagaaacuucuuuaauuccuuuguauaauuauauuuuugaguaagcaagucuguacaauuaaagucagauuccuucugaagugaguucuaaaauugaauuuuaguaggaauuguacuagaucuuaacaguauauuagaaagucucuagguuuauuaacauacacuuaaaauaaauuuuuucuuucaacaguagaaaauacuaaguuuuuuauuuagaaagaagguauuuuccagauuuuuugugugucuuaauuuguuuuaaauauauucaugcagaauaugugaauaccaugaaaaaaacuaugcugcugcccuagaaacuuuuacagaaggacaaaaauuagauaguaaguauuaaaaauuauacuuuaauaaacuuaucuauuucugucuuaaauaccaaagcugaauuuugguaauguuaauuucaaguuaauuguagaaacccaauaccuguuuuucucaucuaaauuauauuucauauugauugcagauaugagaucacuuaaaaucgauuaaauuagccuuuuggcauuuaaaucauagaugaacuucaccauuagaaguaaaaaaaacuauggaaacaccuaacaugcucucucuguuuagucuggcuuuguuuuuuucuaauggagaagugaaaguuuaauuugccuuggucagaagucuguucauuuuaaauuauucagauugcugagaugugaaaucuuaacauuaaagguuuuuauggagaagugaaguguacguuuggguaaauuaugagaggguacagaagaaacacaguuuugagaguauugugacuuuuaauguuauauucuugagggaauauaugaaaaguaucacagugguguggauaucuagacauauagaaauugugagagucaagaauauauauauauauauauauauauauuuuuuuuuuuuuuuuuuuuuuuuuuuuuuuugagacggagucucacucugucgcccaggcuggagugcaguggcgcgaucucgacucacugcaagcucugccucccggguucacgccauucuucugccucagccccccgaguagcugggacuacaggcgaccaccaccacgcccggccaauuuuuuuguauuuuuaguagagaugggguuucaccauguuagccaggauggucucaaucuccugaccuugugauccacccuccucggccucccaaagugcugggauuacaggcaugagccacugcacccagccgagagccaagaauuuuuaaaucugaaaaauacuaagagguugugaguaauuucagaaaauuggagacuacauaauccuacuuguauuaucauuuuaucuuuauguuaugauagaguuuuaucacaguucucuaaagaagugguucuuaacuggaaacgguuuugcuucccaggaaacuuuaugcaaugucugaagagauuuuugauaaucaugaaugguggauggggguugugcuacugacaucuaaugaguauaaaccaggggugcuacuaaauauucuauaaugcccaggacaguucugccuaacaaagaaguauaugguccaaaaugucaguagugcugaaauuaagaaacuucacucuuaguauuuuauguuacauucuuacucuguacuguuuugaauguuugccuuucuguuguguaccuauucagaaaaaaggauuuuagcacugauuaugcaaauggaagcuacaaauuaaaaaaggagaggucugggugauaaggcuuauucucaaacuugcuuaucccaguuuugguaugugaauaguaggccuauucagucagcaaacaggacaucugcacucuuagcaaauucuagagugaaguuauguagugccuugguaccuaaugugaaaauccugaagaaacaugagucauaccauucucuacauuuucauuuuucuuucuuuuuuuagcgagagaaggucucgcucugucgcccaggcuggagugcaguggugcgaucuugggucacugcagccuccaccucuugggcucaagugauccucccaccucagccuccugaguaacuggggcuacaggcacaugccaccacaccugacuaauuuuugcauuuuauuuuuugcagagauggggauuugccauguugcccaggcuggucuugaacuccuggacucaagcguucugccugccucggccucugaaagugcugggguuacaggcaugagccacugcgucuggccccuagauuauuuucuugaguaauaucuuaauaucaugccauugacauuuauucuuuaguuauuucagagguggccuucagaggaagaccuguuugguaaaauugcuguugaggauauuuuacuuaaaaauaaauuugucuuuaaauccaggaaacuuuuuuuguuguuguuuuuugggguuuuuuuuuguuuuuguuuguuuguuuguuuguuucuuuuuuugagacugagucucacuguguuguccaggccauagugcaguucucugucucucaaguucaggugauucuccugccucaaccuccugagcagcugggacuacaggcaugcaccaccaagccuggcuaauuuuuguauuuuuaguagagacgggguuucaucguguuggccaggcuggucuccaacucuugaccucaagugauccaccugccuuggacucccaaagugcugggauuacagguaugagccaccaugcccggccaaaaucugggaaaaaguuaaguuaaacuuuuaggcuucuauuuuuaucagacaggguaaagaauuguuaccuuuuccccucuuugugugauaaauugcuugguuuuaguuacugauuacuuaaaauaauagguuacucaaaucuuuuugauauaauagauuuugauacaauaguucucuagaauacagugugugugagaguguauuuaaauuuuuuauuaaugcugguauaguuggauuucuuuuauaaauuaguaaaguagaaauuuuuguuaagaaauuuuuaauuuaagauuuucaaauuuaucuugucugcaguuaacuugaauuaauaagcucuuauuuagaguacuuuuaauacuuuuaacauaucuuacuaugcacugugacuguuuaaauguaaucauuguucugugucuccagaagugaauaauuuguuuaugcauacauuuacacuguuaucuauaaauauauaauacaucaccuauagccucucgacugccauguaacuuggagauaggacaaaacuucacggaauuuaaagaugcuugguguugguaggaaaggcaugguaacagauaaagccacugagagaauaguggacugaauagguaucugcauugaagagcaagcuggggcugggaacggcuuuugaaccucaacucagcucccaguuaccaagccuccuccccacccuaacugauggcauauugggagucugauuuacaucugauuuuguucugugugugaggaagcuucucuaagagcagcgggauugggggaaaugcagauuauuuguaucugugaaauuaagguugacuguaguuaaaauuuuuaaaaaaucaaaauguuucaugauuaacaacuaaauguuaaacuauugguauauuuauaacuauaguagaguuggugauaaggucuguuaagacagguuuuguucgcugccgacuccccagugccuagaacacugccugggauguaguagguauucaguaaguauuuguugauuuauagguugugcagaugagugauguuauagucaguuuuuucuuucuaggugcagaugcuaauuucagugucuggauuaaaaggugucaagaagcucagaaugguaugugggucucccuugguauuuguuucaauuuaaaaagaaguaaacaucugaaauuuuuuugguuuaaacaaauuuguuuuuaucuuuauaauuucuuuuaaauaguauacguuuccuuagauguggacuuccaaagauacacugguuuuugcauagcuucuuauguugaaagggggauuuggguggauuugcuuguaugguauaucaguaagaaauuacuaaggagucuaaaaugaauucaggaugcaaaaugaaaccacuuuucuuuaguugaaagguacggagaauuugcuugcuuaaucaguauguuugugcuauagaaaucauacaaauaacuuugcuuaaaaaugcacuguucccugaaaauguuuccuuuuuauguuuuaauaggcucagaaucugaggugguaaguccaaaguuuucauucuucauguuuuuauuauuuuaaauuucagcuaccaaauauauuugagacaagacucaggaugagcugucugauauuuaaauauuaagcaauuccauuuaagugcugguuccucuaggcacugaaauaaaaucauuuuuugauaaauauagaaguuuccagucaugaaaauuauuggccuauuuuaaugaauuuagugugugguuaaaguugauuucguguguuuuaauauggucaugaugaucauuuaucuuuucguuacuaaaaccuuauugcauuuauuuagguucaacaguuugaaucacuuguagggcuuuuuaugauaggcuaagacaaaaguuaaagaaaauuggaaauugacagggucuugcucugucaugcaggcuggagugcaguggugccaucauagugcacuugagcuucaaacuccugggcucaagcaaucuucccaccucagccuuccaaguagcugggacuacagauguacaccaccaagccuggcuaauuacucuguuucuuuaaaacgauuuuuaaaacaauguuauuuuaguuuaggaaguugcugaaucuuagaacuggccauuuuauauaagcaaccuuuucuaaucaugccuuuagaaguuuucuguuauuuaaaguucuguuauuuuagagcaaaaaucuuuuaugaaauucaaucuaagauuuuuuaaaugcugagcauucuaauuuuuuuccgaaaacuagugguauuuaacaauuacaguuacuaugucuuugaagaaaauuuucauguaguuauuuuauaucaaaauaacugcaguguuggguaaauuaauaauacaugcauuuuaauaauacaguugcuaaacugacuuguaaaaaucuuucucuuucaacuuaccaaaaucaaucugcaucccaguggacucaucagucaaaaaucaagugaguguuucuuuuucauaaaacaaugcaugauaaauaugccuaaagaggaagaaacccuguaguuuaauaguaagcaaauucuuaccaugugauuuuuaaguuuuuguuuguuuucuaaaauuguguaauagcuuuauguaaagccaauuuuaaggcuguuuaaggauuaauauuuguacuucaguuaaauucaaaucauuucucaucuuuaaaguugcuucacuugguuucauauuauguuaccuuuccauauguuaaggagagucucuuccaguuaaguuuauguuacuacacagguaaacaaguuaguaguagaucuaacagaauuguaacuuaaccugccuuuuauauuuggagcaaauuuuucauaggaacauucuguaugcguugaaaguuaauauugcugagggcagcaauuauaauaaugaauaagcaacuagcaagucuuugacuuuuaauuauucauuagccuguguacagcuuguauucuuaggaccguaacagaaacacaagccguugaucuggagcuuugcauccuuacugaauugcaaagggaaaccgagacucuuaaaguucauuucuuuaaucaaggugguuuuggauauaauuaccuaaaauggccuggaaaaguuaaaaaccaucuauucaugguaguuguggggagauacaggaugaaacuccaaguaccuaguagauaaggaacuuugacuugcccugguggcagcagcagggguagggcacauaaccaugaaauaauaauuaagguguucagagcauaaaauaaucccacaucuaacuuaauauacguguaccggacacugugcuugguccuagggauauaauagcgacaggauaaacagcucugcccucagagagcuuuuaaucuagucuaauuugaaagugaggauuccuacguuucuagagcuuucaguacaaaagaugcacauaauuagaaucuagacccauuagucuuuccauguaucuugaaauugaaggaaaguguuguauaugauguugugccugacacaguuaaacuucauaugauuuuaauuuuaguucauuugccccuguuuugugugcucaagucuaucugcuuccaacaucaguuuugagagcuuggaguguugacucaggcuuauugcuucaccuuucugagcuuaaguuuuaucaucuguaaaauagggauuuaaguguuuaucuguaguauuuggaugaaaugagaguauaaaaacucuauugauggcauauaaauauuagcuuguuuaaaauaaaugacaucuuuaauauuuauauuaguuuaagcacaacagugcuagagaugagucagaacccagaaaaucaugcaaguauuuaagucuacuggaaaggugugagcaucauuuaccuuaccauuuuuuuccauuaguacagagcauaaaaaacuaguuauauaaaguuguuucugugaaucaguaguugcuuugcuguuuucuuccuccagguggggcucuuguuguuuaucagacuaguuuuuguuuugacaauagcuuuaaaaaaauuagaagaguuaccuaaguuucuuuuuuuuuuuuaauagguaugacugguaucaaacagaaucucaaguagucauuacacuuaugaucaagaauguucagaagaaugauguaaauguggaauuuucagaaaaagaggucaguagacugaaucauuuuucaauguugauuacuauuauuugcaaauuuaguauauugcagaauaaucgauaacgguuuaucagauaaaugcuauuucuuccugagaugauuuggaaaauguugaauaaaaucugaagccauugcuuugagguaagaauauguauguugguaaauuauagcuggaugugcauuuuuuucuuuagauuugaaauuuaaagcagaauuugguuauauuaguaagauaaugugcuuugguuauacuugugugguguacuucaugaaaaagaucuaguuaguuuugugaucacacaugucuuagaauugacuagccauguuaaaugaguaugacuuuuuuuguuguuguuuuuugagacagagucucgcucuugcguaggcuggagugcaguggcgcaauuucggcucacugcagccuccuccuccuggguucaaacaauucuccugccucagccuccugaguaguugggacuacaggcacaugccaccgugccuggcuaauuuuuguagaaacgggguuucaccauguuggccaggcuguugucgaauuccugaccucaagugaucuacccaucucagccucccaaagugcugggauuagaggcaugcaccaccgugcccagccucuugaguaugacuuuuaacaacuugauuucuuaccauuuaguagagaaccuuauaauagauuauuuaaaagagguagugauagaacuguauguuuugcacauggaucacuuuuuguuauauaucauuuugcuuuuguauguuuucuugaaaucuaaauaucaaauaggugugauuaaauauaugacaaauauuaugaaacuuauucuuuucugcuguuuaaugaugucuauaagaauucaugucaaggauaccagauggaaaaaaaagguucuuaaaucuuugagaaccuuuugagguucuuaaaucuaaaauuccauauauaauguuuaaaauaauuuguaacauuauugaagauuugucauuauuuuguguagguuuuuuacccuccauuauauacauuuacaaaaugugaugcuaauuuuguguucauuaguugucugcuuugguuaaacuuccuucuggagaggauuacaauuugaaacuggaacuucuucauccuauaauaccagaacagagcacguuuaaaguacuuucaacaaagguaagaccauugaaaaguuuguuacuaguaauauuuucaaaauuauagaaauacuggugaacuaaucacccauguguuuauaagcuuguagauucuuucagcccuuuaacagggacaagaaaauaagaaugauaacuuuugaguauaaggguuauuuuaccucucaaauucuaguacaguaaagaauaaaaauccacuuagaguguguggcauuuguguauuuacuaagacagauauaauguuuuucaauaaagggguuuuuuuaaaaagauacaauaaucagccugucuuuaagauuugauacugacaaugucucuucccuugaacuugucaguuuugucuguuuugauguacaaauacuuuugucacccuaccucaugcaguuaaaaauacaaacuacaagaaagaugaaucugccuuuuguuuuuuuuguuguuguuguugagacggagucuugcuuuguugcccaggcuggagugcaguggcgugaucucggcucacugcaaccucugccuccuggauccaagugauucuccugcuucagccucccaaguagcugggacuacaggcaugcaccaccacgcccugcuuaauuuuuguauuuuuaguagagaugggguuucaccauauuggccaggcaggucuccaacuccugacuuuuuuuuuuaaacugaauuuuagauuacucuauuaugagggaacaaugaguaaauuauaguuugaguaauuuuuagauuccuuuauaguuucuaaaagaaguagagauauacaacagaauuaauauucagagaguaucacucaaaagauguagauaauaguguaauuuaguaggaaaaaaacugaaaauuuaaaaaucugacucuggaucuuugcuugcccuguguauuuagucuaggcacaaaaugacuauaagacugaauuuucagcaccuuugaaaggagggcuguggaccaaaugaacucuggaguccuuucagcuguagaauugugugaagguauaugauaaaugaguuaaugggaauaaaugauguagguaggcuuuuuccauuacuacuuuuuuuuuuuuuccuuguuuuugagauguagucuagcucuguugccaggguggagugcagugcugugaucucagcucacugcaaccuccgccuucuugaaucagguucaagugauucuccugccucagccuccugaguagcugggauuacagucauguacugccacgcccagcuaauuuuuguauuuuuguagagaugggguuucaccauauuggccaggauggucuugaucuccugaccacgugaucugcccaccuuggccucccaaacugcugggauuacaggugugagccacugcaccuggccuauuacuccuuuuuuuauacauagguccugcagcauacuguguuaguauuuauuagguugaagcucuaaggacaugugaaguuuccuguuguggaacaggaucgggguuggccuguguugugaagaaugauaauugggccugcagaaaggacacagcugcagaggguuggagaagaaaguguaaagugaaguaguuuuuugcauccaguuaaaaaggaucugccuacuuauuugaagauugucaagaacaaagcugguuaauuaugaggcagauuuuugaaauagcugcuugggacaauagaaagugaggaaagggaugaaaucuuaccaggauuuuggucucucacugguccuauccacauaguauagaauuuguuuaauaaaagaauuuuuaguaaucaagcacaaaauagguagauuugagagggauauaguucauaaaauaaugaauuugacuuuuuuugguauaugucuaucgagauugcuaaugcaagugagcugagaucacuacguugcacuccagccugggcaacagagugagacucugucucaaaaaaaaaaaaaaaaagauuguuaaugcauguccauuuggaguuauuuaaauugagugugaauuaaugauaaaugacuuaagaacuuguauuacugagccaccuccuauaguggaagaauaucaugugugguaaauacauagauguguggcuagaguugaggauguaauuaagcacucuuaucucaauucuuuuuucucuuuugagucuuggauuuguuaauuuuaaccauucuucaaccauacuacuauguucucaguuugccuuuucugccccuuccucuuuaaaugcuaagugacgacuuuucuuccuuauauaguaguuuauguauacauuucaugucccucguuucuguguaagucuuugaggauaagaagcauguuuuauuuguaucuuuguaugugccccaguuaggguccccagauaaaguuacaagauguucauuuaaguuucuauuuaagauaaacaaugaauaauuuuuauuauguaaauauguuucaugcuauaauuuuauuugcuaaacuuggcagcccucaccacauacauugcacagugggugcuuaguucagugaaugaauuaaaauuggauuuugguuuuagucccaugacauuggcagagaauguuuauucuuaguuuugcagguggaaaaacaaucauguuaauggaguuuaaauacuuuccccaaguuuaccuaguuaacuaaauucuucagccuggccuaggagacguagauacacuucugauugccaaccaaacuagugcaucuuugcuuagguuuuucuaaguuuugaauuggagaacuuagauucuaaggauguguccuaaagaauuauuauuuuucuuguccugacccuggaaucucuguauuuuauauaccauauauauauauaugugcacacacaaaaucuuguuagauuacuaacucuuaaacuauuuggggggaagcaaauugaaagaaguuuucuuaauuaugucuuaagggaaauaaaugauaaaaucuuugaauuuccuuuuucauacaguagagggagacaauauuaaaauacugaaaauaaaauaucuggguuacugaggcuuacuucguggacacuuaagagacaacaguacuaaaauaauuugcuuuucauguauucagauaucuugauuguugagauaucuuggaccuuugugaauugagaaaggacgcauuuugcagaggagaaucugcuuaauaguagagauucuguaaaauuugcagcuuaaaagggcgauuucuuugcuuuugggaauucucuuuucuuucccaccuucaagauugaaugaauguugcauauccauguauagccagugguuaaauauuauuuauuugagugauauguaauuugugaugaaaguaguaagagguaaaacccugaaauuaaugaaguagcauuucuuaacuauuuuacaguguaguauccaauauguuuuuccaagccaggauucauauuuuuucaguaucucugauaguuauugcuacuuuuuacugaauaucagcuuuaaugucagccuauuaauuuuuuagaaauuaagaaacuauaugucuuucaucuuguugauuucaugacacuauucucuggucacagucucagaauugugacuuuaguggcacccauauugugaaauacucauuuuaaaaauuaauuuucauucccuuuaagauuuagaauucacaagucgggcacggugggucaugccuguaaucccaacacuuugguaggccaaggcggucggaucacuugaggucaagaguucgagaacagccuggucaacuuggugaaaaccugucucuacuaaaaauacaaaaaaugaacuggacguggugacgggugccuguagucccagcuacucgggagacugaggcaggagaaucgcuugaaccugggaggcggagguugcagugagccgagaucaugucgcgccacugcacucccgccugggugacugagugagacuccgucuccaaaagaaaaaaaagaauuagaauucucagucuuuuggggugaauuugcccuuguggaaauguucuuguauucuuaagucauaguuaagucauaguaauuuugcugauuauacaauauaaaauacgaaggccuggaauugugagaaauaaaaaugucugucuuagaaacaaaauagccuccuuuucucuucucccacuuugagaaguuuuagagcguauccuauugcuuaauguucauagaagaauauauguauguuaaauaaaaauccuggugauaauauaauggaaugggguaucugggcaugaugcuuccuucugcuugucugaauacauagauaugagaguuuuuaaaauuauuguuuucuuuugcuuuuuuaguacagugguggugauaauagugagauuucuuuuuuaacugaauuaguuuaaaaaaagaucacaaauuguagaucuuggaauguauucuuaucuuuucauauauuuuguaauguauauuuauauauuuuuaaaagaauuuuacauaauuuuuaaacagcuacauuuuguugauauuuuuaucacauccuuacauauucaacagcaaaguauuucggcauaugcauguacuguagcuuauuuagccagucccauuuuguuugaccuguggagaauaagaauagguguuuugacuguuuuaucacauuccaggcacuguacuaugaauuaucucauguaauucucauaguuacugcaugguguagguauuuuuaucccuaguuuacagguagagaaacuuaacccagagauguucaauaauuugcccagguuuuuuagcugaggauauugauaauagcauucuguuguuauuugccagacgugguucuuuauucuuuucauacauagugucauuuaaucuucuugagaacccuaaaugagucagggccuacuguucucauuuuauaggagaaacugaggcucgcugagauugaguugcuugcuuauggucauauaucuaaccaauggcaccuauuugugacucuucuaacuauacaacugauuguuuuuguguuauucucaaccccugguuauuucuuaggaaauaaguuaaaauucuagcugaaaaaugcgcuuacagcaaauuauuucauaucuuggcucccacaucucuaaaauauggauaacaaucuuuuuuaauagggugauuccguuaaguaagaugauauaugugaagcauguagcaugcaggauauguaauaagagcucaauaaauguuacaguaccuuucuuacuguuuuauuuuaguuauuucgauuuuuauucgggcuguaaacucagcaaaugcguuaucauagaaaaucuggaaaagauaaaggaguuuaggaaguaaucacucagacucaccacucagaugacauucuagcauguuuccuuucagauaaccugauauuuccugauacauaggucagucacuacaccugacacauacuggaaucuuuuuguuuaugggaaugucucuccugauuaauuacuuuaagaagaacagaggcuguguccuuauguaccagcacuguuucuggcacagaguagguacucagcaaauauuugaaaugagcuguuagaaguuuggagaagaccuucaaucuucuccauucauugccauuuuuuugcauuuaaaaaaugauuauagaaauauuuuaguguaaaaucaagguagauguauuagucugggcucgaaggcagcuauuuucagacaaaggaauuugauguagcaauuaaaugugaaaagagcuuaguaagaguauguugggaaggcuguauucugaagauuaggggaacaauuauuuaaugaguacagucuugaaguguaugguucuuaaaaguuugccaauaaauugccccagcucuuuagucucugggaaagaucccuucaugucagucuguaauaguaggugggaucuuacuuaccacuuaagaugguggugucuggauaucaugauugcuuaagcguaaugccaucucuuuaaaucugaaauuucuuucauuggaaagaauuaaacucucugcuaugcagaggagacuucagaaguggaugguaguaccuaugcuguugagagcuaaugauccagcacauuagggauucuuaguguaaucugugaauacucuuuugggauauuagcaacuugagagccuucccuguacauaugagagcaacauucaagcaaacuaccaaaguuuuaaguuacuuuuaaaguuuuuuugacuuaaaugaaaauagaaugguauguuaaugguugcaguaaaaaccucugaaauuggacuggugcuaauucuagaacuaucugcccgaaucaugaagacuuaaaacuucauuuuuaaaagcauguacaaacauugaaagugaauuaaauguaaaaaggauuucauaggacauuagucccucccuucuuuuacuuuuuuuuuuuuuguguggggguagauagggucucacucuguugcccaugcuggagugcaguggagugaucauggcccacuguggccucaaccucuugggcucaugugauccucccacuucagccucccagagugccaggauuacacgugugagccaacacaccuggccccuuuuaccuuuuuaaaaaagcuacuuuaagugguuuauuacaugcagcuauuuuaaugaauggauuaaguauaauuucaaguugaggucagcuugucucagcugaagcagguuguuacuaagagcuuugccuuuugcuuuauaaaguccucuuuguucauacugcacaguuacucagguuauaguggcuuucaguagaugcgaaugcuacucugugcugcucuucaggugaaacaaggaacuuuuuauagacaguauguucauaguuacaggaacaugaagugugaauauaggguggccuguggccaaguuuaauguggugauguacacaguacuuuccaggcccucauuuuuuagaugaguugaaaauuaaagaagaugcaauuuuaauuuuucagauaauauuaacaguucuuuucaguaacuauugcugugucauugccaucuauuugauuuaugucccuuuugauaaauaucguagcagugacaacuuaaaguaaccagaauauagaagauauuggugguauauuacuuuauaaaaaauuaauuguaguuaacuuuagggaauucuagagauucuuaugaaauauguuuuuauauauguagaguuuaaacauguaaauuacaccaaagauaguauacuuuuuuuuuuuuuuuuuuuuugacagagucucgcucuguugcccaggcugaagugcaguggcacgaucuuggcucacugcagccuccgccucccagauucaagcaauucugucucagacucccgaguagcugagacuacagucacaugccacuaugccuggcuauuuuuuguauuuuuaguagagacaggguuuugccauguuggccgggcuggucuugaacuccugaccucaggugaucugccugccucggccuccuaaggugcugggguuacuacucuuugcccuuaucccagugacguuugcuucauauuuuucucuuauuaugaaaacagucguuuauuacauuucuuugcuccaaaagaaaauaaaaauaaacgcuugagaccagauaccccacauacauauaccaucauuuuaucucugauuaaaaauauuggcaguuuuucccuguguuagcgcuuguuaagguauuuuaaggugcaaauuuugaagguccuuuugcuaaaugcauuugguauaaagauggccuggaauugcuaguuuaaugagucaucugauaaaagauaaaagaaccaaagggugaauagacuucuuuuuuuaagucugccuuuugauuuuuuaaucccauuuacaaaaguagugauccuuuucauaggaaaaaaacaugagaauauaaaauucuaauucaauugcucauuuaaacuguuuuauauaauguuuauuauagugcuuacuuuaauauuugcacuaaaaaugcugauauuagccuguuaaaauagaggugagagcauuauuugaauaaagaaaacaaaagguagauaaaaugcuaugugauuguguguguugggggcaaggauagacucagaggccuagccuuaauuagauaguaaaagaugcuauuaggauacuauuaacuuuucauuuuaauaagugaacuuagucuucucgguaaguaagugaacuuagucuucucaguacuccccgaugcaguguccuuucauacccaugcuccaguuaggccauucccuaugcucuggagaccuaccccuucacucuugcaaaugcuucuacccuucagagcccuucaagauguauaaagcguuuccccuucacagucaggugugcucucuccugagcuuuuagaacauuuacuuauuuagaacuucaguaacuuucuuaaaguaucucacauacuuccaaauggucgaggaugugucuuuaauauuuuaaaaauccaccugggcuugguggcucaugccuguaauccuagcacuuugggaggcugaggugggagaauggcuugaggccaggagucugagaccagccugggcaaccuagugagacucugucucuacgaaaaauuuuaaaaacauuagccaggagugguggcacuugucuguagucccagcuacuugggaagcugaggcuggaggaucacuugagcccaggaguucaagucuagagugagcuaugauccuucuacugcacuccagccugggagacagagcaagacccugucucuaaaaauaaaacaaaaaucucccacagccuugaagacuguacugucucauaguaggugcuuaguaauuauuuguugaaugaaagauugccugaauguuaacaugaguuguauuguguuuauacagugaaauaaguuucuccacuguaaaacagguuaaugcacauguaaaugcaguaauucuuuuagaaucagauuucucuguaauggcauuauugacauuuuggggaauugcccaguacauuguaggauguuuaguagcaaccguggucucuacucaauagaugucauuaucaccucuucccucacugcaguaugacaacccacaaugucuccagacauggcuaaauguccccuggguggcagaaucaucccugguucagaacauugcuuuggaugaaaaaaagcauauguauuucaagucucuucuugauuauagcuuauauauaguguguauguuguuuuuuuucaagggugaauuuugaguguagaaacaaaauuguuucauaguuuuucaaauuuaaccuuguauaauuuaaggaaacugucaaagauacuauucuuaacaaaacuuugaugacuuaagaaaacugcauuuuuuacuguuuuguguauuuuacgucgaguaauggaguuuauuugguguuuccuccagauugaaauuaaacugaaaaagccagaggcugugagaugggaaaagcuagaggggcaaggagaugugccuacgccaaaacaauucguagcagguuuguuuucuggccuugaugagcuuuauauucauauuguguuguguaauugaaauuaaauaguaaugaacauucuuuuuacuuucauuauuuauguucucaagauaagauacauugaguauaauaagguugcuccguaaugaauauaaaguagccuuucugugaaaguucugacuucucaaauucuaagaauacaaaugaauggcagcaaaauccuagagggaguugggauuuauuguuuaccauguaaaguuuaugacaucaguuggaggguguuuaguuuugcguguuggcccuuccuguuguuucuuuuuggguuguaaguugguuuacucggcggauauauuuccccuucuucccucucccuuucuuaauuccuuucuguuccuucuacugauacugucaucuaauugccuggaauuugcagggcuuuacaggguaagguaucuaccccauuucuuauugcuaauuuagagauggacgcaaauaggugguaaaugccaaaggaaagucuaggagaagaguagaaaaccaggcuucauuguauauauaacccuguaagaaacagaacuuuguguugaggucaauuuuaaguaugugcaauaacuagguaagaauuuuucuaguggacaaauucacagcacacucagaacuacaaccuaagauuauauuuuauagcaauagcuucauuaaugaguggagggaaauuucuuuuuauuggaaguaauggucugauuuaaugacugaaacaagcuaacaugugucucagcuuuuucugauuuugacugcuuucuucuguaacagaaaacacauuuccuuguggcaccuuuuagaaaacacugaguuauucaacagaucauuuguguguguguuuguguguguguguauaguuauuucuuaagaaauaauuuuggauguuuagaaauuucaaaaauaagagauucucauauagcuuucacccaguuucccccauugauagugucuuaacuaguccaaugauuaccucuuaaguagucugugguauaauuuucaaaaucaggguauuaacaccaacagauacuuuuuaaggacugaaguauaucuaguugguauuuaagguauuuaagcaucugcuucacacuuuauuugaaagauguauguguuucuuuuaggacugacuccaauagauuuugaggcugagguuuauauguagcugaaagcuuuaaaaaauauauaaucacuuuaaauguaguaucuuacuuaauucuaacagcccugcauaacaggcagccccuuaguauuccucccauuuugcaggcucagaaaaguuaagcucaagauuaucccucaguucucauugucuaggacuaaaaucuaggucuucucaguuggguccaguuauucuguuaacccguugucuacuuguugcauacugcuuguuguugcauuuucuaacaauggaaacagucuuugccgacaugaguaucuaguaguuauuugauauuauagugaaugagcagggagguuagauuacucaucucucaguaguucaucugccaucuccagguguuaaaaguuuuucugagauuaaagaucaaggcuuuuuaguguuacaguuaccauguuuuuucuaaacucaacaccuuagauauucaagaugauacucuuccuguccuguuuuuguaagaaauuaauauacuugucagauuccuguguauugcaagcuggagacuguagauaagggcaagucacuuaaccuaucugacccagcuugcuuaucuacaaaauagagauuaaaaccucuguucucauccuuccugggagucagcauuaggauuaauuaaauccauauuucccaggcucuuaacuuaccauggcacgcauuuuuuguuuuaccuggcuacuagugaaaauguacaaagauagaaggauaucuaguagaaggaagguggauaggauuuucaaaacaauauauuuggcccugaaaaaaaacuauguguugguguuguguguguuguuuuguuuugaggaggaaugggcagggagaaagucgguuuacaagugaagagaaagcguagaaaaacaguggauguuaguuucucagcuauuuugacaaaagggauguagagagcaguauugggaggaacauuuagauuaguacuaauguguccuaauacauacugauggggaaauuuugaauuggguuuuuugaaaacuguagcucuuuuguccaacacaguagcugcuagccacauguuaccuguugagcacuugaaauaugacuagucugcauugagaugaugugcuaugugaaauauaugcuacaguuugaagaguuaguaugaaaaaaagaauauaaaauaucuucauuuuuuuuguugguuuuuuuuuuuuuuuaagagagagucuugcugugucacccaggcuggaaugcaguggcacugucauggcucaguguagccucaaccuccuggacucaagcaguccucuaccccaaccuuccgaguagcugguacugcaggcaugugccaccacgcccagcuaauuauuauuauuuuuuuuucauagagaugggcucucacuauguugcccaggcuggucucacacuucuggccucaagcaauccuccuacuuggccucccaaagugcugggauuauaggugugagcccccaugcccggccucuguugguuucaagucaauaugauacuauauuugauauaucagguuaaauaaaauguauuauuaaacugcauuucaccugauucuuuuuaguaauguaguuacuaggaaguuuuaaauuauauaugugacucacauuugaggcugucauuauauuuucauuggauagucaacagagcugcuccuauagcuacuagguugucuaguuauuuucuaauuauuugugugccaagaucuugaugccuuuggucuuuggagcaaucuuggcaguaccccgagccccugggccaguagccucucucgcugcaagcagcucuguuuacuccagugugcccuacaaauacuauuauuugcuagguguaugggaugugggcauugaacuuuagaucaucaaguguaguacuuuaaacauuuagaaauuacuuacuguuauugccuauuaaaauaaucuuacuuuuuugaugggagaguauggaguggcauggaugauuauuuauauuuucaggcuauuuauacucugaaagauacuaaguacuuuagaaaaagucacauuuuuaacauuuauuaaaaucuuaguuacaaaagauuucuuaggcauccuuuaaaaaauuucauuuuuagaauuguucguacugucucugcaacuuuucugaaaacauaaaaguucuguauacuuuucaucuaguuucuguuaucaacaugaagaaucugcuuuuaaucuaauuuuguauagcauaucaaaaguuuacacuuuauugaguuauuuugcucaaaagaaauccccagauuuuacauuaugguaacugacucaguuuuuagaaaugugaauuuuguuauugaccuauauaccagaaagacacuuauugcauaccugaaauucaguaaccuaaacuguuugcuaagauguuccauauacauggucacaaaguuuacauauucucgacauaauugaaacauguugauuaauuacuucugccuuuuuuuacuucauagauguaaagaaccuauauccaucaucaucuccuuauacaagaaauugggauaaauugguuggugagaucaaagaagaagaaaagaaugaaaaguuggagggagaugcagcuuuaaacagauuauuucagcagaucuauucagaugguucugaugaagugaaacgugccaugaacaaauccuuuguaagaauauaaacuuaaagaaauauauaugggagcaaauuuuacauauuuuaaacgagaaaauugguaaugugagaccaaauugcguguacuauagcugggagaacuuuuugaauaaggucugucugaacguuucuuuuugcucuaagaguaauuuuugaggaaguugaaaacuuauggaagagaugagaaacaagugguuuaucuuaaauagguauuuuuuaucagugaguuagauugauauggagucaucucacuuggauuuaucccaguagcugagugaacuucuguuguuucccuucuagacucauauguagccucaguguuagagaugaagaauauagauacgaaacuuuucagaauaguguuugcaaguagaaggugcacguuauucauugguuuaacaacucucuugauuaagaaaauucaggcuuuuugucagggcagcauaaauaccuaaauuagaccucaaaauuuuaguaauaauucgucauuguauauuuagcuugcaguuguaaucaugugacuuuuauuaauaccaguagcucuggaaauaugacucuuuuaagacauauuuacaguagaaaguuaaaauuaguauuuuaauuuaauauuuaguuaaugugguugaggcuuagguauuucacacuuaagaaaucugugguaauuggucaugauugugcuuuucacaguuuauuuauuuagagacaaggucucacucuguugcccaggcuugaguacaguggcgugaucucggcucacugcagccucugucugccgggcucaagugauuuuccuaccucagccucugcaguagcugggacuauagacaugcaccaccacgccuggcuacuuuauuucuuguagaggugggguugcgccacguugcccaggcuggucucgaacuccuggcuucaagcaaucuagccgccucagccucccaaagugcugggauuacaggcgugaggcaccucaaccagccucacuauugauuaaaaaauuuuuuuucaucacuuuugggagacugaggugggaggaucacuugagcuaaagaucuugagauuagccugggcaacauagagagacccuaucucuacaaaaaaaaaaaaaaaauuagcuaggccugguggcaugugucuguggucuuagcuacuugggaaggugaggugggaggaucucuugagccuggguggucaagguugcagugagcuguuuuuuugugccacugaacuacagccugggcaacagagacccugucucaaaaaaaaaaaaaaagucuucauuaaacuuuuaguuuugagauaauuguagauugacaugcaauccuaagaaaugagauucuuuguaccuuuuacaaaguuuccauugauggaaacauuuugucaaaacuaugcuacaacaucacaaccaugauacugacaguuaagauagggaaccuuuaaucccagugcuuugggagucugaggccacaggaucccuugaggcuagaccagccuggacaauaugguaaguucuggucucuacaagaaauuuaaaagcuaccuuggcaugauguugugccccugucagcucaggcgucugcggcaagaguauuguuugagcccaggaguucaagguugcagugagcuaugaucgugccacuacacuuagcuugggcagcaaagugagacccuaucucuuuaaaaaaaaaaaaaagagagagagagagauagaacauuuucauggauuccaaggaucccuuauguugcuaucuuauggccauacuaaccccacccccacccuuccaugaucccugaugaucacaaaucuggcaaucuuugucagauauguaguuuacacauauuuucucccaguauguaguuuucauuuucuuaauagggucuuucauagaaccaaaauauuucauuuugauuaagucuaauuuaccgcuuuuuauggaucaugcuuuuaguuucaggucuuauuaacucuuugccuaguccuagaucucaaagacucucuccuauuuaaaaaauaaauaaaaguaauauuguuuuacauauuacauuuauuuuuuauuuagagacagggucucauucugucacccaggcugaaguacaguggcacagucacaguucacuguaaccucaaaguccugggcucaagugauccuuaugccucagccucccaaguagaugggacuacacauccaugcugccaugccuggcuaauuuuuaaaauuuuuuguagaggugggggugucuccguauugcuuaggguggucucgaacuucugaccucaagcaguccuucggccuuggcuuccugaagugcuagaguuacaggcgugagccacagcaccuggccuacauauuacauuuaagucugugaugcauuuugaauuuuuaugucaagugugagauuuaacuugagguuccuuuuugugggguggauaguauguucggguguucuggcaccuaucuuuucucauugaauugcuuuugcaccuuucuuaaaaaucaguugagcguauuugugugagucuauuucuaaguuccccacuguguuagauugagcuguaugugaucuauauguauguuccucugucagucccacugucuuaagcuguagcuguuuaagucugaaauugggcagacucauuccuccuacuuuauccuuuauuuucacaauuguuuuuagauauucuaacucauuugucuuuccauguaaauuuuagaauaaagugauuauauauaauuuugguguucauuacuagaaucuagacauacaguuaauuuuauguuuaucuuguauucugugacauugcuggacucaguucuaggaguauuuuuggauagauugucauuuuuuuaauguggacaaucaucuucaaauauggagguuuuauuuaucugcagauacggagaguuuuauuucucccuuuucuaucuguaugccuuuuaucuccuuuucuugcuauauuucacuggcugcaacuuccgcacuguguugaauaagaguagugagaguggacauccuugccuuguuucccauuuuaagggaaaaguaucuguuguuucaucauuaaguauaauguuaacuguaaauuuuugguagaugaucuuugucaaguuaugaaaguucuguuguauuccuauuuuucugaaauuuuuuuaucauuaacuuucaauauuaacuuuuugucagauguuuugucuguguugauugauaggauuauaugauuuuucuuccuuagccuguuaauauggugauuuuauaugauuaauaugauugauuuucaaguauugagacagucuugcaugagcccuacuuugucauauaguguaucucuuaauucuaucuucuaauguuuuguuauggguuauugugucuauauucaugaggaauaugagucuaauuuucuuuuugugcuaucuuugguuuggcaucagaguaauacuucauaaaaugaauuaggaagcauugcauccucuucuguuuuuuagaagauauuguguauaauugguguuaacuuuucuuaaguauuugguagaacucaccagugaaacggucugggccuggagauuucuuuauuaggagauuuacaguuaugaauuuaguuaaccuaaaaguuuuuauaggacuguuccaauuaucuauuucauaugggugacuugugguuuguuucugauaaauuuauccauuuuguccaaguugucaguguuuguauagucccuuauucuuuuuguuuuuugucuuuuguucuugagacggcauuuuucuaucgcccaggcuagaguguaguagugugaucauagcucacugcagccucaacuucccaggcucaagugauccucucaucucagccucuccaguagcugggacuacaggcaugugccgucacauccaacuaauuuauuuuaauuuaauuuaauuuuauuuuauuuuguagagaugggguuuugccauguugcccagucuggucuguaacuccugagcucaagcgauccgcccaccuuggccucccaaagugcuaggauuacaggagugagcccccaugccuggccucccuacucuuuugaugucugcaggguuuauagugauaucuuuuuaucauucuuauaauaguaauuugugucuuuucucuuuuuucuuugucagccuugcuagagguuuaaaggacaccuuaucuagcauaugcuuacccauuagcuagauuugcuuauguuauugaauuuuuucuuccaaagaauuagcucuuuguuucguuuuuuccucuauuuuuuuguucuacauuuuuuuauucauuucuauuuuuauuuucuuccuucugcuugcuuuaaggugcauuuuguucuuacuuuucuagguucuuaagauguacauuugucuauuaucuauuucuaucuauucacucauuuuugagacagggucucccucugucgcccagaggggagugcaguggugcgaucguggcucagugcagccuugaccuccugggcucgaguaauccuccugaguagcugggaucacaggcaugcgccaccauucucaguuaauuuuuuuuuauuuuuuguagagacgaggccuccccauauugcccaggcuggucuugaacucuugaacucaagcaguccucccauguugaccucccaaagugcugagauuacaggcaugagccaccacgccuggccuguugucugaaaguuuucuguuuuccuaggcagcguccuucccugaucucuuggcaagagagagcagggguuuguugggacuuuuuuuuuuuuuccuuguuugugccccuugguguuuccagcuucuucagcuccaagucuaggauauaugaggcaaaaagaaaacccagaauuugccaccacgucauuucuugagucccaaggucccugguaggucuaucuucacuuuaccuuuuggugucuuuuuuuuuuuuuucuagucagggucuugcucuauuguuccagcuggaauacagaggugcgaucaugaaucauugcagccuugaacuccugagcugaagugauccucccaccugagccuccuaaguagcuugcacuauaggugugcaccaccacaccuggcuauuuuucuucuucuucuucuucuucuuuuuuuuuuuuuuuuuuuuguagagauaaggucuccuauguugcccaggcuguucuugaacucuuggacuuaagcaguccuccugccuuguccucccaaaguacugggauucuaggugugagccacugcaccuggccccuuuuagagucuuuuuaccucuguuucauauguagcaucuaggguguuuagauuuacuacugggaagaauaggaaaaguacaucuacuugaucuucccaggagaagucauucucacuuucuacuuuuaaaagugugguagacaaaauuagcaguaugucagaucaaagaugucaagucaagucaaaucaaagaucaaagauagaaucugaacucauuuucauauagaaacuuugacaauuauaaccaaauuguguauacccauaaaauaagccaucugugcagcaacauugaucuggaauauacgaggggcuucuguccuugugagaauaugaaagaaacuagacuuuguucucuauaaucuccuuaucuaauugggacaaaagaccaagauauacaaaauaaucaaagggaaaugcuaaauugcccugcagucuauuaggagagaugcggggguggggcgauaagugucaucagcaaauauggucagauuguaaaccaaauccacaacugaagguccucuugggguaguuuguguuugucuguuuauuugagagagaguuucacucugucacucaggcuggaaugcaguggcgcugucucagcucauugcaaccucugccugccagguucaagugauucucgugacucagccucuagaguagcugggacuacgggcgcaugccacuacgccuggcuaauuuuuguaguuuuaguagagauggaguuucaccacguuggccaggcuggucuugaacuccugaccucaggugaucugcccgccucagccucccaaaaugcuggaauuacaggugugagccacuacgccuggccuugggguaguuuauuauacagacuugucaaauguaauucagucauuuuauuuaaagcccacugugugcuaggccacugugcuuagaacuacgauaugaauauuaguaaaauguacuccuugcccuuaaugagcugucagcauuaguugaagucaaggguggaaagcagaucuaagaagauagaaccuuaaauugcaacaaugcacugugacacauguuauguaaaugguaauuaggcucacacagaagacaaauuuacaggaauagagaaauaagaggucagagaaagccacauagagguggugacauuucauguuuggaagaugacuaaggacacaaaaaucucugccaugcaaaaaagcccauguaagggagcucgguagagcgugucggacaugggguuacauugagguuccaauguguaggauauguaacuguauacauuggccacuaacacaguuguuuauuuuuaaauguuuauauuguaauaauucgcucuauucuuugaugugguucaaauccauugauuuuuaucauguuaaaauaagaaauauccagauggggcugggugcgguggcucaugccuguaaucccagcacuuugggaggccaaggugggcggaucaccugagggucgggaguucgagaccagccugaccaauauggagaaacccugucucuacuaaaaauacaaaauuagccgggcaugguggugcaugccuguaaucccagcuacucgggaggcugaggcaggagaagcgcuugaaccugggaggcagagguugcggugagcccagaucgugccauugcacuccagccugggcaaugagugaacuccgucucaaaaaaaaaaaaaaaaaaaaaaaagaaauguccagaugguuuuuuaaaauauauuaaugaauaugcuuggguuguugguaggugguauauucaguagaugguaaauaaaugaccaauucuucagugagacacugacuuucuauaccugcauuuauguaccuugauuuuuaaaaauuuuuggauaaacuugcauguguuuggcacaaagagagcacaaaguagaggcccuucaaguucucuucagcugguacaagaagagauuauuuugacuggucuuuacggucuucagcaaaagagauuauaauaaucauuuuuuuugggagcuaauaauauuuucaauugaagguaguuuuuccacaugcacaucuaugcucauuagcaaaggauguagugcaccucccugacuacuuuaggauuuccuuuucagauuuuauggaacuuguuaaccucuggaaugccuaaguuuaaauaaaaauauuguuuugaguuuauauugagcuauauauuuuaucuguauaaucuauuauauauguauugcauagaguuuauauugagcuguauauaauagccaauauuuggggcucuaugcuuggaacauuuuaagaaaaauauucuauuuugauuauaugguccaggaauuaaucuauuuuuauuuuucauugcagauggagucgggugguacaguuuugaguaccaacuggucugauguagguaaaaggaaaguugaaaucaauccuccugaugauauggaauggaaaaaguacuaaauaaauuaauuugcucucaucguauuguguauauucaccuaaugcccauuguguauugauauugcauucuugaauuuugaacacugaauaucuuuuugaaagauuauacuucuuuaccucuuugugcuuuagaaauuauuuuccuucaaguguucaagucuaaugaagaaugaagauaacauuuuaucacuucuguccuuaaagguuucagacauggugaaacugaauaaagcaugucauuugcuccuagauagauucauucuaucuaguuguggggauggagaaaucuuuaaugguauauuuucgguuauugccuuauuuuugauacaguauucugucaguaauuuauuagaccuggcagcuuugggugagcuuagauuuuucaccuucaguguuacauuguguuugcuuuuaaaaacugcuuuugaauggaguuguaaauacaauuuuucuaugaagaugu

SEQ ID NO: 192520 - RNA, 19444 nt, Homo sapiens
uacaggccaauaccaccaaaaugguuuuauuuuugucauugacaacaagcacaacacugcaauuguaucauuauuuuguuuaguuucuuaaauauuacuuaaguaugcauuaaaaauauguuuacauuuuaaaaaugugacacuuuaaagaaguccucuguaaacacgaucccuucucaauauauuuuccugcuuuguuucauacauaaauaacuuaaucuacaaagucauaaauaauacuaucaacucuuauggccuggaaguauauacaaauuuuggagucugacaaaaguguucuuuaugauuuuauaaauaacacauaguauuuguaguguugauuauaaaucaaaugacuuuuuacaaauuccuacugucuccucaaccuguucuaccaguaacagaucuuccaguuuacuugguugguaaagaugccaggcauuuaaaaagucaaaauggucaaaauucuauauuaaaaaaaaaaaaaggcagagaagguugcuauuuaaauauuaccaaaucuuaauaaaaccacuucagcuugucugaaaaacaaaaaaugcuaguaaagagugaaugcuuguacaaucauauaaaugguacucaauaaaaucuaaaauuuaagaaauaauaaaaucagaugaaauccauauuaguuuugcaaaaaaacuccacugagauucuauuacaggaacagaaucaauacuauucuacauuuucuaaaauuuauuucuaaucuucacuuugaugaguuaaaauuuuaaaggcaagaauaaugacaaacaaaacaauucugaaaagccauacuuauaauccuugacaucaagauguuaaaaagguuuuuuaaaaaaagccauacuugagauuccuaauauagaacauuugauuguuuaguuuuguuuaaugacuggaaauccuuauuucuucaaaaaauagcaaguauccuuugaaacacaucacccaucuaauaagauuguuuaguuuuguuuaaugacuggaaauccuuauuucuucaaaaaauagcaaguaucuuuugaaacacaucacccaucuaauaauuuauuaaauaaccauucaagauuuauuagguaagcacuaaaauuacuuuuauguaauaaaaguaaauaggaauuuugcauguuuguuguuucauuuuacaaauuuuuuuauuccguuauuuauaggauauaaaacuuuaagaaaacauucucaacuaacauucucauuagauguaaaugauucaaauuacaaauaauacuaaccuaagcauugucauuacuuuuaaaauccaaguuucucaaaguuugauuuuuuuacucaauacaaaaaugaccugguucacacuauuagcugcccaacaaacuguuugaaaaacuaaauauucuuuguucaagaguagauuacaagaaauguuuuccaugcucuuauuucaaaaaacaagauucugauauacauaaugaaucuaaauaaaaauucacaagugguggcugaaauccugucaacuuucagcccaauacaauauaaauccacaguuauaaugcauaaacaauucaaaauuaaaguuuauaauggaaaugucaacaagucauaacuacuacacauuacuacugauggguuccacuauacuucaaccuggcacagcagaugugcacaucugauagacagacugcuuagaaaauuaaagcuaucagagcuauaaauaaggaauacauaaauaugaacauagcaaugccaaagcauuagagcuguuaaaaaaagugaauaagaugugauguaaacacaucugauaguucucucuguaagccacuuuccacugauuuauaaagcuaugguuuuauaauucuuuuaaaaaguaaaauuuuucuacacugcugcaugcaguaauuucauuguacauucucaacuacaaugcaaucuucaaacccucuugcagagcuugacauaucucaucagaauuucuccagaaagucagcuugucauauuuucagcagccuagaacaagaaaguaagauucauuacaauaaaaccauggaaaaagaggcaucaugaagauaaauuugucaauacugcacugucauuaacaaacaacuauuccccauaaaacagaaccacuuuuaucacaguaaugcagugcuuuucauguuuugcuauacaucaggacuaccuuuugaauguacaguuaacaguccacaggcuaacaguggaaaauaguuauaucaccuaaaauaauaguuaagagcacaaaaaacauacugcuacuugaaacauuaaccuauggcagaccuguugccacagacuucauuaguuugucuguuucuguguuuuauucuaguaauagggauuaaaaaugaaaaagaccuuucaugcuacaaggcagagagaacaagagcaaaagaugaauaaugaacaucuuaucuaauccugucucaucuacaucccuaacuacuacucuuucccaggugauucugaagaaauuccaagauaccauaucaucaauaaauacuuugauacauuauuucuagagacuuaaacaaaucaccauacuauuauccuaccuaaaaaauuucuuaacaucaauauaaaaagauauaauuuuaaauaaguuuaauuuuagaaauauguguuaguauuuuaauucauuuaccuuucuaacuccuuuuuauaagaccuaccuacacagggacacaucgcagauuuacacuaaaguauuaguaacaguacaggacaucuguaagagaaagggcaagccuuaguccacaggacuccaccauaaugguauaacuuaagacacugggguacuaaaauagaagauacaggaaaguagguuuugcucagaacuucucaaauuacaauauguagaugacugcuuacacauaaauccuagaacuaaggagauaauauaaaaauucaaugucaauaaagaaucacuaaucaaaugcacuuaauuaacaauccuauuuaugcugugggagauauguauaaaguggccuauuuauggcuguugaguaacuuauguaauuagggagauacauagcuagcuacuuuuacuauaaaugacuuagaccacaucaauauacaaaucugugaaaguaaaaagcaaaaaaauucacaaaaaauaguuacuguuuucuaaauagucaaccaaagagcaaaagaaaaaaggaaugucucagaccaacaguuuuuugcaacauuucaagauacccuugauuuguuauccuacauauuccaaaaaaagagacaauaaauaccauacaguuaaauucuaaauaccaggaauucuagauaaagauagaacacagcaggaacaauuucucuuuaccuuaauuuuaaaacugaaagaaauuaacaaaaaaaaaaaaugagaaaaaaauucaugagcagcaaccacacaaggcagggagaagaaccuuaugcuuguaaagccaauaaaaggguggucaaggaaaggcagguguggcucaguguaucucuaaacccaccagcuccccaacucugucccaaauggcaauaagagagaacaagacuuuaauccagggagaagcaaaccgaugaguuauucuuuuucaauucacugaaaucaaguauaacacuuuuauuuuuaaaauagcaugauacuaucuggaaugauguucaccaaacauuauugcaggcaaucucuuugguaaucuugagugauuuuuuuuuaaauuuuuuguauuuucugaauuaaauaucuuaaaaguauaaggaugcauuacuuucauaaaaauuauagagauuaugucaauuacuucaaaaaaacaaguuguaauaaauacuuguuugcuagaaacucccuaguuguugcuguuguuguuuucacucuguugcccaggcuggagugcaguggcacaaucacagcuuacugcagccucaaaugccugagcucaggccauccuccugaauaaccagaacuacagguguguaccaccauacccagcuaacuaaaauaaauauuuuguagagauggggucucacuauguugcccaaggcagucuuaaacuccuggccugaagugauccuucugcuuuggccucccaaagugcugguauuacaggcgugagccagcacgccuagcugaaacacccuaguuuuaaugugaugcuaguauacuguuucuagaucauaggagaaaugcauuuuaagaggcuuuguguaugugagagacagauuuuccauucaaauagucaacacuuucugauucaguguaucuuaauuacugauuuuaccucccacaucucacuauggcccacuggaugcagaauaacuaguaugcuaaaagcugaaaaagcuauguuaaauuggcauuucugaacugccuauccuaauaucguagcuuauauuuugccuaagaaaaugcuaugccaaagcacuugucagucaccugccucagcuagguuuauuugacucugguucucuuauaugcacucaaacuguaguacaaaacaaaaauaucuuccuauuauguuaauucccuuucaaauucaagcacaguaaaacaaaaacucuugcaguuguggcagauguguacuaaauaaaucuuucccucaaaaauuucagaaauacacugauaaaauacuauaauacucauuuuuauuuuuauuaaaaguuauuagauaauauuaagucagggaaugugcccaugcuaaagcccaaggacucuuguuucuaauaacgacuucaucuuuuccuaaacugcuggcucaggaauucuugagauuuuacuggaggagaaaacuuaguaguuaaguaaacaacucugaagucagagagcccaaguucaaaucucaggucaaucacuaacuguaaaguucuuaagguaaguaaauuagucaccauaagcuucaguuuccuuagcaguaaacuacuaauaguagcauaggauaaguaucccuugucggaaaugcuugggaccagaacuguuucugauuucagauguccuaaaauuuuggaaaauuugcauugaaguugucccuugguauccauggugaauuguuaguuccaggacuccccaucuuccccaccucacagauacgaagguccacagaugcucaaaugccuuauauaaaaggguauaguauuugcauauaaccuacauguauccucccacauacuuuacaucaucucuggauucguugugauaccuaacacgauguaaacgcuauguaaauaguuguuauccuguauuguuuagggaaucaugagaagaaaaaaagucuguacauucuuaguacagacauaaccauccuucccccuguuccccaaauauuuuugauccacagcugguugaauccauggaugcagaacccacaaauacagaggacugacuguacuugcugacugagcaucccuaauuagaaaaucugaaauguuccagugaggauuuccuuugagugucauguugguacucaaaguauuucagauuuuggagcauguuggauuuucagauuuggaaugcucaaacuguaguaguuaucacuguuauaaugauagaggaaauaaugccaguaaagccuguagaacauacggucuggcaugagaaaaguauucauauaaauauuagcuauucuuguuauucaguuauuuuucuuucugccauaugaaagccaaagguuugagguaaaaaagaaacuucccuaucuaaauaggagacaagugcugauagccaagauaauggguaaaaggccuagacagcauuucagagaucuaagacacggcccuucccaugacagucuccgaggcccaggaucaggaccuggagcaaaggucaugcauguuaugcuuuagcaaaaaauuuggcugcauugugcccauguccuagggaucuguggaaguuuggacuugagagugauuuaggguaucugguggaagaaauuucuaagcagccaaguguucaacauguugcauggcuccuucuaacagcauaugcucagaugcaugagcaaagaaauaaccuaaggcuggaacuuauacuuaaaggggaggcagagcauaaaaguuuagaaaaugugcaaccuguccaugugguagaaaagaaaagcccauuuucaggagaauucaagggggcugcaaagcaaccacuugcuagagaaauuucugaaucuaaauagaaggcaagugcugauagccaagauaauggguaaaaggccuagacaacauuucagagaucuaagaggcagcccuucccauuacaggcccugagaacuaggauagaaugguuuuaugggccaggcucagggccccgcagcccuccacagccuugggacauugcuucuugcaucccagccacucuggcuccagccaugacucaaaguggcccagguauagcuugggacacggcuucagaggauccaagacauaagccuuggugacuuucauguggugucaagccugugggugcacagaguacaauggcugaggcuuggcagccuccaucuagauuucagaggauauauggaaaagccuggguaucuaggcagaagccugcuucagggguggagcccucauggagaaucucuacuagaguagugcagaggggaaauaugggguuggagccccuacacaauguccucacuggggaacugccgaauggagcugugagaagagggccaccguucuccaaccccagaaugguagauccacugacagcuuguacccugagccuugaaaagcugcagacacucaacaaugccagcccacgaaagcagccaugggggcuuaacccuguaaagccacaggggcagaguugcucaaggccuugggagcauaccccucccaccaguguguccugcaugugggacacagagucaaaggagauuuuuuuggagcuuuaagauuuaaugacuacccugcuggguuuggaacuuguauggggccuguagccucuuucauuuggcugauuuacccauuuugggaugggaauguuuacccaaugucuauaaucccauugugucuuggaaguaaauaacuuguuuuagauuuuacaggcucauagguggaagggacuugccuugucucagaacuuuggacuuuugaguuauugcuggaaugaguuaagacuuuuggggacuguugggaaggcaugauuguauguugcaaugugagaagaacacaugagaucugggaagggccagcgagggaaugauaguuuggaugugcauccccacccaaauuucaccuugaaauguaauuuccaauguuguaaucuccauuguaaucuccaauguuggagguggggccuggugggaguugacugaauucaucccucaugaaugguuuagcaccauccucuuggugcuguacucgcuaaagugagugaauucuuaagaguuaugguuacauaaaacuguggcaccucacucucucccucucuugcuccuguuuuugccaugugacaugccuucucccccuuuguuuccauaaugauuguaaccuuccuaaggccucuccagaagcagaugccacuaugcuuucuauacagccugcagaacuaugagccaauuaaaccucuuuucuuuacaaauuaucuggucuccgguuuuuuuguuuuuguuuuuuuuuaagaggaagucuuccucuguugcccaggcuagaguacaguggugugaaucuuggcucacugccaccuccgccucuuggguucaagugauucucuugccucagccucccgagcagcugggauuacagugccugccauaaugccuggcuaauuuuuuuauuuuuaguagagauggguuucacuauguuggccaggcuggucuugaacuccugacuucaagugcucugcccaccucagccucccaaaguacugggauuacuggcuuaagcuaucaugcccggcagguauuucuuuauaucaauucaagaauggacuaauacagagucuaccauaaaagugaggauaguaguuacuggagaggagagcaagagagagggguuagugacuggggagagggcagaagggggauuaucuggugcuggcagugaugguugcauggauauucucuuuaugauacauuuuagcucuacaaaugugguuuacccuuuuuaguuagauuuaauaaucaagagauuuuaaaaagcacaaaaacaaaccuaaagaauaagaacucauuggaaaauaaucugaaagauauguaaauugcauguuuuaaauaguugauuucuuaaagguaagaaaaaagagaagucacuuuguaucagguaucagaagguuuuauuuguuuguuuguuuuuccccccauugaccgucucuaugagcccauguuuuggacaaguuuuaagaugaacuaacuuaaaguuucaguauucaaagugaguuagugcuauauaaaaagggaaauaaaaucacaagcuuuuaaaucagaaagucuguggaagacagaauaggacauguuuuuaguugccaaucugagcaauuaaaacgugguuaauuugaauuggaaaaaagguggcccucugggaaccugguggcagcagcagucccauggucucugaggcgcucuuggagucacuuuuuccuuuucuugaaggauaacacaugggcccucagcugagcagcucuaucagccaguuuccugucuaaacaaucccacuaaucugauagccuucuuucacuucauccuguccaagcuggcaguguuuguguugagaugguugacuggcucuaucacauaccuaaugucuucacaaaaguguagccacacucuuagcccugucuccagaacauguuauucagacaggcugagaauuuucuaaauucucagaugcuaguuccuuuucucuuagcagguccuuacucgauugcucauuugugucacauuauuaagcagcaaaaagaaaucaggcuacaccuuccacaauuugcuuggaaauuuccucaaugaaauauccaaguucauugcuuacauauucuauuuuccuuccaacaauagaacacaauucagccacaaucugucacuuucuuuuuuuuuuuuuuuuuuuuagauggaguuucgcuccuguugcccaggcuggagugcaauaucgcaaucuuggcucacugcaaccucugccuccuggguucaagcaauucuccugccucagccacccaaguagcugggauuacaggcaugugccaccacgccuggcuaauuuuguauuuuuaguagagauggaguuucauuauguuggucaggcugguuuugaacuccugacaucaggugauccacccaccuuggugucccauaguguugggauuacaggcauuaagccacugugccuggcccauucugucacuuucuaacaaagaccaccuuucuuuuaguguccaauaaauguuccccauuuccaucugggucuucacuaaaagugcuuuuaacauuuacauuucuagcaacauucugauccuaauguuagucucgaaaaaacucugaagcuuucucuacaguucuuuucucuucuuucugagcccucaccagaauugccucaacauucacaguucuacuaacaguuccucuucaaggaaaucuagucuuuuucuaucaagcaccuuaaaacuuuccagucucuauccaauacccaauuccaaagccacauccucacuuuuaaguauuuguuacagcaacaccccacuucccaguaccaaaaucuguaucagauuucugggacugccauaauaaaguaaccacauauuagguggguuaaaacaacaaaaaucuauuuacaguuugaaggccagaaauccauaccuacuauacauauuuaaccaaggcguuagcugggucaugcucucugacagcucuaggggaauauccuuccuugccucuuucuagcuucuuauggccacagaaaauccuuaacuuuccuuggcuauuuguguccaaauuucucuucuaaggccaccaauuauuggguuaggaucuacccuaauccaggaugaccucaucuuaauuugauuauaucugcaaaggcauuauuucuaaauaaggucauauucauugggaccagggguuaggaccucaacaugccucuucuggagcaggcacaauuuuacucaccaaauagcacaauucuaaaaacagacuucugggaaaacauaacaugguccaugguaguaguaauuuuucuuuuuuuuuuuuuuagacggagucucacucugucacccagucuggagugcagugucgccaacuuggcucacugcaagcuccgcgccuccuggguucacgccauucuccugccucagccucccaaguagcugggacuacaggugcccaccaccacgccuggcuaauuuuuuuguauuuuuaguagagaauggggcuuuacuguguuagccaggaugguuucgaucuccugaccucaugauccgcccaacucagccucccaaagugcugggauuacaggugugagccacugcgcccggccuaguaguaguaauuuuuaugauaugaacauacacuauugagcuccuggucuucuagugguguugcauguuaguuuaaccuuguuuaaccaggauguuucccauaacuucaucauuaaucauuuuucuaaauaaaagcaucuuuauuuagaaugaacuaauaggaaucuccaaccuucagugcuucaguagccuugcgaagcuccuuaauaaccgaugauaaagcuucuggguuaauuccuuguucacaaagccguacacaaauagacagaguuuccauaucuaagccaguauucaaaauucuugaaaucucaagcagaacugaaaaaagauacaaaaaaaaaaaaaacuuaaggcuuacagcauuuaaaaauaugcauauaguacuuucauuaauuuauauaucacugcacaauaccaaggaauuagcauagcaucccagguuuuggaaaucugcauguaauacuuucuugccuuuacuuaguuuuagaaacuuaaauauaaauauaaacuuacaccuucccuucacauaacugccuuuuacaucuugcuauauauucuagcacuuguuuaauaucuaacauguauccaccauacuuaggauaauucugaacacuugcuuauuuuuuaguauucuuuuaaaaugcaguuuaacuagucgcauauuauuccauuuuauggaaacacuauacuuaacuacucuguuacuuuaaaaguuaggcugcucucauguuucucucauuaaaauaauauugguaagaaucuguacauacuaaauuuuauuucauuaggauaaauuucuagaaguagaacugcucagucaguaauauacauauuuaauuugcugaauugacauacaauagucaaaaaaagguaauguacauauuuaaggcuuuaaaaguguuuagaaacuuuuauaacaauuugacagcguaaucaugucuguugaaucuaauaauaaaaaugaaaccuuauauuuuuuaaacuucauuuguauaguacugcauuuuauuguaguugauagaacucauugucuuuaacaugagaagcacaaacagagaaacuugguuuccaaagugauuuucagaaucccuuccauuacagguuguaaguacaccgguuccacugaauuuuguuuuaagauugcuucccagagaguauuuagaauauuuuaagucaacugucaacauauuaucuauuguuuccuauaucauuuccccuuggcauuaugcuuagaaaauuauuccccaugaaaagauuauauccaccaguauucucuuccagcacuuugaaguuuauuucccaaaaccccccauaaguauuuaucucccuagaguuuggguggaaaauaggaucuaacuuuuccucccagaaaugagccaguugccccaguaaaauuuauugaaugaccuaaguuuuccccacccaguugagaugccaccuuuauucauaguaaauucccauauacuuacaaauuuguuacaugucuaucuuuuguaagggcaaccauuuaauuucuaacuuuauauugcauguaguaggguaaacauuccguugucaucuuucauuuauauaagccauuuuauucuucggaugaacugaacauuuuucaucaauucuaaaaacaaauuccaacuggauucugauuaacuguauaaaaacuacauuauuauuuugggaagaauggacaaguuaucaauauuuagucacccauuaauuuaagucuaagucuuucugaaaauucuuauaguauuuaucauguucaugagauaggucccucccauuucuuccauaucagauauucacuuucaucccuagaaguucaauuugagccgggcgcaguggcucacgccuguaaucccaacacuuugggagagcaagguggacagaucaccugaggucgggaguucgagaccagccugaccaacauggagaaaccccgucucuacuaaaaauacaaaauuagccaggcaagguggcgcaugccuguaaucccagcuacuuggaagacugaggcaggagaaucgcuugaacccgggaaguaaagguugcggugagccgagauugcgccauugcacuccagccugggcaacaagagcaaaacucugucucaaaagaaaaaacaaacaaacaaaaauagcaguucaauuugagucuuaaaaaaaaaaaugucuuucaugccucuacuaaacuuuuuggagauauggaguauaguucugaugcccuugucugcuaauucuaacaucugugugaucggggggguguucguuacaauugacugaauuuuucacaucaugggucauacuguucugccuugcauaucugguaaucuuugauuggaugccauguacuuagaauuuuacuuagguaccggauaguuuuguauuucuaauucuugagcuuuauaaugagauaccguuaucuggaaaugguuugauccuuucggauauuacuucuuagaucuguuaggcaggaccagagcccuguuuaggauagggcuaauuauuccccuuaugauugagguaagaauucugaguacuguauccaaugucuuaugaauuacaaagauuuccauucuggcugguaguuacaggcacuauccucagcccuguguaagcacggugcacgguucacucuaauccuucuagaugguucccucccagcuuucugaguacuuuccucacacaucugcuaaucaaugcucugaauacuuaagggggacacuucuacagaucuccagcauucuuucugugcaguucuccccucucagguacuguuauucaaacucuaccugccuuggucucccaggucuucuaaacuccuccuacucacuucaguguguccacuggguucucccugcuauacugaggccuggaacucucugaaggcagugagcuggggcaacccaagaaaucacuuugcuuguuuccugucucuaagggaucacuguacucugaugccugauguccagugucuugaaaaccauuguucuguaugcuuuaccugaguuuucuugguuguuucaaguagaagcauaaaucuaaucucuguuacuccaucuuggcuggaagaugacagcucuucccauuuucauuucuucaguuuugauauuccaauuuacugauacuuugcucuucagcuguauccagccuguuauucauauuaucugcugaauuuauuucaaauuuauuucaguagcuuucaagauuucuaauuucuaauuucucaccauaaacacuuguuuuauaacuaaaugcuuauuuauagugacaaauuucacagcuguuguuccugccuucgucuauuuaaggcuauauucuuaaacuguauuugagauugcucuauuaucucuauuucuuggaguauaagcaagcagcaaaagacagugguuaggagugugaucucuagagccagacuaccuguguucaaauucuagcuguaguauuuaguaggcaaguuacucucucugugccuuauuucaccauucucgaaagugaggauaauaagaguaccuguuuuaaaggauuagugugagaauuaaaggauacacuuagaaugguauccauuuguuuugcugacacugccuugcaguccuuuggaauggugcuuggcauacgguagggcucaauaaaaaagaguucccuguuacuaccacuuucccucuuuuuccuuuuccauguuaguugcucauguuuuucaucuaccuuaggugcuuugucauucuuggcugaaaacucaucuuccauagauuuauuuuagguguccuggacugguggcccauucuaagauaggaagccguacccuagcuuuaggccucuagaucaggccuuguaguauuuuugguccagauccaaaaaacacauggauggugcuucucaaucucuggcugugacaaauggcacauuucugacucccaacuucagugaggcaggguagcaugcuuugucagauucuauucccgacaauccccugcugugguucccaucugcuccuuucuuuuggggggaaaccucucucuuccuaaucaauggagacuucccuucuugcuuuugaacaggucuauccugauaauuauauuuucuuacuauuuccuauuuuuuuauaugcuuagaguuucagcaagugcucaaucuaccauauugaaucuucacuuuauuuuugacugucuucacaaauggauucuacuuagcccuuguacauucuaagugguuaccaucaguauacuggaacacuacauauuaaacuuuuuaaucaccagucaccuugaugaauucuaugaugcuucuaacaguuuuucaguugauucucucccuucucucuccaguuuccaguuuguucucuucaugguagacccccccacguauaaaggcuaugcuuauuccugacuucaugccuuuguucuugcuuuucuccucugccuuuuauccucccuucauauaacucaaugcuguuuucuuaguccaucucauuugugguuucuucuuuaagccuucuuuucaaauggacaccuauuuuuacuuccuauuuucacaaaucgccuguaaucaaaaacuauuucuuuagugccuaccauaugaucaguacagguugaacacuccuaauuccaaaaucugaaaugugaaaugccgcaaaauccaaaacuuauuaaguacugacauaacaccguaguggaaaauuccacaccucauauaauggaucaaagucaaaaugcaggugcacaauacacaguucauucagcaucccugagggaaaaaaccaaaauuaccuucaggcuauguguauaagguauauauaaaacauacaagaauucuguguuuggacuugggucccauccccaagauaucucauuauguaugugaaaauauuacaaaaaaaaaaaucugaaauccaaaacauggucccaagguuuuuggaugagagauaaucaaccucuaacuauauguauuuugugccuauuaugcuacugcugcaaauacaguuaugaacaagguauauauggucccacuccucacagauauuaguccaggaggagagauagauauuaaaguaauaacugauuccagauauaaguaaaauaaauaaagaguggaauacuucugaaacaaauuacaagggcaucuuaccaaguuuggaaggacacaguguuuagcaaagacuugucugaagaagugacaauuacacuuagacaucaaaagugaguagaaaucaaccagacuaauacagaggcaggaggaagggugaugguugagagcaaagaaaacagcuugugugauggucccuacacuagagggaacuugguaaauucagaccugaacugcuauugugaaggcaauguaauuaacggggugaauggguauaaaauaugagguaaguccuagugaagaucuuagaacuguggaaagcuacuggaugauauaaaauaggaacauaaaaaaaucaaacuugcauuuuaaggacuuuuuggcugaguaucaaaugaaucuuuaaaaaguccaguuauaucacaauuuugauaaaagacugguggguaggaugaacaggagauauuuagccaaccugaaaugagucaagaauugaaagggcuuagugaagaacaggaggcagaggaggugagaaagcaagacugacuucuagauuucuuucucaaaugugcaacuggauugauggugguagcauggacuguuucgcugguacugccuugcagugcuagucaaauggaaucuauauaccauagauucucuuaacuccuuucucuauaacguguuuuuuuuuuuuuuuuugagauggagucuagcucugucacccagucugcagugcaguggcgcaaucucagcucacgacaaccuucgccucccagguucaagcgauucuccugccucagccucccaaguagcugggauuacaggcacccguacuuacuacuaaauauauauauauauauacauauauauauauauauauauacacauauauauauguaaaguggugcuacaggccgggcacaguggcucacgccuauaaucccagcacuuugggaggcugaggcggguggaucaccugaggucaggaguuccagaccagacuggccaacauggugaaacccugucucuacuaaaaauacaaaaauuagcugggcgugguggcgggcgccuauaauccuaguuacuccagaggccaaggcaggagaauugguucccauccccagcuucaaccugggaggcggagguugcagugagccaaggucgcgccacugcacuccagccagacucggucucaaaaaaaaaaaaaaaauagugcuaugauaaagccucucauaaggaauaauuaucaaaauuaaaauucagaugcacaggacgauuuuagaggaaaauaaaaauuaagguauaaaaagcaaucaauagagaguaccuaacauaccaaaaaguugaaaagcaaaagaggcaaccauacacaguggguugcgagggggguguuguugaaaaggcacgacuauuuuaagcguguagaauuuuagggauauaaggaugaaagcagagaucucaugcagaccuuauucuaaauuggcagagauaguucuuuucagagugaggugcacagauaauuuauuaauagaaaguuagccugcuuccuuccaugucuuuaacaaaauccuuucauuucaugaucaaaaugcaaauguagccaagaguucugcaauucacaugacuuaaagggagguucacaaaugcuaccauugaggggagaaaugguauucaaaaaguuuugaaaauuuuauuuuugaucucacggguugauuuaaauacuguguaacaccacauccccucuccuucauuuuuuguuuuacuucacuuuuuuguguucuuacucucuuuauaaucuucauuucacaccaaguuuucucagaagagaucuugaugaugcagccaacacaaaccaucaguucucaauuguacaucagugauuccaccagagaaaaugugaguuuucuguucaaaugggauccuguggccauauacauaaggaaccuaaguacagcuaaccuaagaaaauaggcuagaagugaggucuuauacucuaccuuuuuccaaggaaauauacaagacaguaaauuuauauuuauauacacacacauauauauauucauacauaaauccacuuacaaaauaaaacuauuaaguguugauacaucgaaaaggauagaaaaauaagcugaauauuaagaguaacauucucagaaaaacagcaagguagauacugaacaagugaaaaauuagaugcaaaggcucuaaaaguguaauucuuugaaaagaaaaccaggaccagugcagaaaaagccagcagccccucugcaagugcuacauaagaaaaugaggccgggcaugguggcucacgccuguaauccuagcauuuugggaggccgaggcauguggaucaccugaagucaggaguucgagaccaaccuggccaacauggggaaacuccgucucuacuaaaaauacaaaaaauuagccggguguucuggcgggcaccuguaaucccagcuacuccagaggcugaggcaggagaaucgccugaacccgggaggcggagguugcagugagccgagguugcgccauugcacuccacccugggcaacuacagcaagacugugucucaaaaaagaaaaaaagagccuacggugaaggagagagagauacagcagugagaauuucauaggguuaucuuuuaacagagacggaagcugacgugaguagacccuggaaaacgucuaggcccacugcaaauaacaacaucgaucaaacacucauaauacagguggaugugaguaaaaaggagacaaagaaagaagacuacaagagagaggccaucugaaauaauauaaaaauaauugaucaucuuugauauguuuuuacaugguugucuuauuuaaauauucacaacuccuggagguaggguuuuauuuuacagaaaaaaaaaaaaaaaaaacuaaacaggcucaaugauguuuaaguaucuaguccaagcucaccacaggggcauaaaguggcagaaccgacauuagaggguagacagaggguaaccgcaagacacaaauuucguguucugcaacacuuguguaggcuucacacacacgugccuccggggccgaaaacaggcgacaccauagcacuugggcacuggugucacccgcuucaagaggaaacuaggauaauuaugaccaaaggggaacuuguucauucgccggauauuaaaggugccuacuuaagugcgaagaacaggaggcauagcggugaccaaacaccuggccccuguccccgccgggaucccaaccuuggggacccccgaagcgccccgggcgggaaucgggugggacgcggcacgcaggagggaacggguguacuggguggggugggcgugacgcugucaccgcaggagaucgggcggguagggcggaccugggaugcgggauagagggggcgcggcauucgcgcgagagggacgcggugcgcaaccggcugacuaggggccgcaacgccuagcgcgcgcgacaaacuacgcagcggcggagacaacucucaagggauagggccaucagcccugcggcccuggcaggucccuaccaaagaucuuggaagaugccguuuggggcacuaaggggaccugaaguccuccccaggcucauucccgccugggggccuuggcucugggaaggcacgcaagguaaagggagcgcaacggaaacucaccguccauggucucccgcaccgcauucagauucgccgccgcggccgccgccgccgccccagcaccgcugcuacucgccauggcuaaggccgagggaggcgggagaagggccugacccggaacuggagcgccuuccucucuccgaggcaaucacacagcgcgucucggcccacgccgggcaggcuccgccccucgcgcucgccgccggcgugaggcugcguugauuugaauuuggagccacguuccucugcgcggaacguggagcgaggaguugccauu

SEQ ID NO: 192521 - RNA, 197442 nt, Homo sapiens
gcggccgcggggacccucggcgugguccucugacccugcaaacccgcgacggaggaaggggagguccugcccgaggcgccagcccaaggaggaggaugcccauuuaacccgcccucgccugccgggcgcuugccucggugcccgccgccggagccuccgagccgcgcccguggaagugcugcauggggcagggcugcugaagcgcggaguucggggucgcgccgcucccaggcaggcgcgggagcccggugcggcaguuggcacaguuucggcggcgccuucugcgcgggaguggggggcgcggugcgcccggccggccuccgcggugcccuggugaggcgagaguuauggagccgcccagcugcauucaggaugagccguucccgcacccccuggagcccgagccgggcgucucagcucagcccggccccgggaagccaagcgauaagcgguuccggcugugguacguuggggggucgugccuggaccacaggaccacgcugccuaugcugcccuggcucauggccgagauccgcaggcgcagccagaagcccgaggcgggcggcugcggggcgccggcggcccgagaggugauccuggugcucagcgcgcccuuccugcguugcguccccgcgccgggcgcuggggccucggggggcacuaguccgucggccacgcagcccaacccggcgguauucaucuucgagcacaaggcgcagcauaucucgcgcuucauccacaacagccacgaccucaccuacuuugccuaccugaucaaggcgcagcccgacgaccccgagucgcagauggccugccacguuuuccgcgccacagaccccagccaggcaagacaggggcucggaggcgcgggggcgggcucggccuugggggaucggggagcagggcgggaggggcggggaccccacuuuaaggaccgacugagguuuggcugcaggcgcgcgcgcuccacguggcgcgcucaagcgccggcuggccccuucccuggaccuugggagugggagagaaggcguucgggggcugggcgagcggcgggagcggccggccggcuacagcagggacccggagggaaaaggacaacggucccgggauggagggggagcuggcgcguccaaggagcacgcguggaggagcgcccgucccgggaggacggcggugucuggggugugaccggagauggcuugcuugccgugugugugugugugugugugugugugugcgugcgugugcgcgcgagcgcguguaugaacgcagaagguuggguuccuagagguccucacuaguucucaaucgcagucaaauccuuaaccgguuuggcuggucgcgucaucuucgcagcagcaccugcaggucuccggucugggaggcaauuuccgagcggggcuuagggaaaaguuacuagacaucgucagauugucugcaaagaaggauucuacauuuggauauugaauggaaagaagcccuuuuuuugcgguuuuuaaacacacuuauuggaggcaguguaguagaacagguuucuaauaucauuuuuuaaauguuuuuuucacuuuuguuuuuaauauuuuuuuuccagagucuucuaaaucuaauuaccaaacaguaaacuuuacuuccuuaaaaacagauaugguccuuauggaacagggagaggagaacuugacuaugcagugauugugucuuugaaaacagaguuuucccccuuuaauuuguaaugaguuuucuccccgccauaucaaaagcuuccaaaaugcuguuuuaaaaaugguuauuuacuguuugcacaguacuuuagguucuuuggaaaaauaguguugucuaaauauaaauaaagucucagguugcaccauguggcuuucuuuugguaacugggaaauuaaucguagucagaugagaaaaacauccuauaaauauggcuuuaauuuuuuuuauuucacaauucuucugucuguaauugaaagacuuaguucaacaguuuucacaaaaggcuuguaguugaauugaagaaaauaauaguucauugucuuagauuucaucaguuacuuugaaaaauagguuuuuuuuuuuugagacggagucuugcucugucgcccaggcuggagcgcaguggugcgaucucggcucacugcaaccuccaccuuccggguucaagugauucucgugccucagccuccccaguagcuggcauuacaggcacccaacaaucagaacuccuaaugugaaguuauguuuauggcauaacuguuauguuuauggcaaaauaucguacuaaaauuauuucaagauccuaaccacgauuuaaugaauuucauuuugugaacauuuguucaaaacuuauuuuuagcuuucacauauguuaaaauuggaaaguuucugaaagcuauuacauuuuauuguauuacauuuuucugguucuggugguaaagaggagccaguugcauuuuuccaggacuuuaaggaacuuuucaugacucucggggguuucuguuaaaguuauuuccccccagcgacaucugaugcaugacacauuguugcuaaucucauugaugguccuggcaccuuuaguucucaacagcugcuguugaguuccucuuggucucauugguaggaagucaauuauaaacauuccuuuauuuuccuccauuauauauuuaagcguuagaggcugaacuauauaaauauuaauauguuuaggcucacuucccccuuuuaguccagugggagcagugguagucauaugacuuucucauaaaaguucaagaaaaccucuaacuuuccuguuuauugccuuuucccagaugaguguuugaucuaaagauaugaauuacuauuugcucuuaaccaagagauuuccuggcagaggguuauuaauuugaagggccagauguagcgucucuagagagcaucuccagccauuaaucggugguuacaaacucaaauaacaaagaagaggguugagugaggaccauggaggacuggauaguggguggccuuucucaaggugcuacuuagcuccacuuggaaauugcaugaauaggaugcaagucuagcguugcuagagcugcugauuucccaagagagaguggaaaucugaauuuuuauauaugaccccgcauuuuaaaguacuggcaaauauuguaaacauuuaagaauccuaucugggccaaacaauacacaucugagagauggcuuuagagauccaugagcggccacuuuugaucuuuggcauaaauauuuguugaguggacaagcgcagucauugacacuaugugcuguuugcuguauuuccuuuagagcauccagguucauuugauauggcugucauaguaggggaagcugggaccauccuuuuugaagaauuuagcagaaaaauucccagaaguguugauucugcagcuagacauguuaaaggggucaguucaacauauuaucauccagcaguaugcuucaugcagaguuggcuguggauaguucuagggacccuugaaaucagaaggaagaccugcuguuugcuuuguucugaguucuauauuugaaguggagaauuauuuauuuggacuuaagaucauuguuaagagagucuccuaaguguuucccucaguccucgacagagucuauaaagucuacaaacguagccuagagcaguagaccugcaaacauccccuaacauacuugucugugguuugucugucaugccuauuccuuuaaugcaauggcccuaucuguuggaugaccguauacuuuauuguuugauaugggacaauuuuauugucaaaaggggcaccacuaauaauuauacaagcacugugaguaauaaaccuggacuguugaggacaaaccgagauauauggucaccauggcaaaguuuguguucaugcagagccaccgaguuggaggauugugguuacuaauauaaaaugauaauguuuucaagaguaucuacucacauauuggaguuggaucuacauuugaccuuagagcugggagugcuguacuaaucgcuugggggucuguuguggggaguugccacagugauguguucccucuuggcuccacaccucccuuugggucagagucaauuuaaggaugugugucaggagaagcauucaaccagaauggcucaaugcaccacuguuucuccaaggugcaaagagaaauggagaugggggugaaauguaugccaaugcagaucugucucuagucaagccuauguagucuuauacaggaggaaugucaggcuuagcacauuucagcuaaacuugaauauuugaacugggaaaagggcuuaaucccauuggcaugaagugaauuacagacuuaaacugauuggggaaacaagaauaucugauucucucccaaaggucuaggauaggucacuaauacucuguaaauauuuauccacuugcaaaaagagucuguauggcauuacccaaauuuuucuguuaaaaaguuauuuuauguuauacauacauuacuacaauaaaaaauaaagcaggaguuguuauugaaaauaugagacuuuguuauguuaauuuuuaauuaacauuugccugugaguuuugaagcaucauuauguuuuauaauuauaggaugaacaaucauuuaaaagguaaaaacaugauuguuauaauguuuauugguuguuuuuguguauuauuuacugaagcuugcaagaaugauuuuaaagagacuuuacaaauuguguucuuaagauuaaaaaaaggaauuuaaugccaguguuuucccaacucucaguucucuuaaaaacguguauuacuaucugagcuuuauucacguaaccaguuuuuuugucaauauauuuuuagaaggucauuuuucaguucuuuuucaaaguugaugguuaguagcuuugagaauauacuaguaagaauaccagagaaauugaaaccuggaagauuucaccucucugugcuuucuaagaaguuuguucuguggacagauagaucuaucucuuuuuuuguaaucauuuuuuauucucucuccuccuugcagucugaaguggagguuaauuugccuuggcucugugguagaaucuugacugcaauaucuggcggaaaggcacaaacauagcccagagacucccagccacaauggagcacauuaugauaggagcccuaagcugaaaauugaagguguucagugucagggcuugauuaucagaaaccagagauucucaaacuucagugugugugucagaauuaccuagagggcuucuuaaaagagaccacuggacccuacccucaauuucugauuuaacaaguucucuggugaugcucaaacuacuggccgggugaccacaguuuuagaaacccugugcuaaguuauuugguucauuugguuggcuguaugaccauuucuguuccccuggauauuuuuguagucuuucucagacuugaaaguucaaguggaaugugaggagaaauaauauuugacucuggaauauuuuuaagaagcucuucaucuucuagcuuaaugauuugccuguccuuucccugauauagacauuauucugccagacaucauaagaccaugcaaauguugaaugaaaacuuugccuuucagccaaaaguuuuaaguucugcagguggaauaaacaguucauuuugaggggaauacagauaaccuaaaaaucugaaguccaaaguguuuuaacgucagaaacguuuugagcaucaacaugacacuacagguggaaaauucuucaccugauuucaugagaucacagucaaaacacacaaaauuauuaaacauauuguauaaaauuaccuugaggcuauguguauaagguguauagaaacacaaaugaaguuuuuuuguuguuguuguuuauuuuuuugagguggagucucgcacugucgcccaggcuggagugcaguggcgcgaucucggcucacugcaaccuccaccucucagguucaagugauucuccugccucagccacccaaguagcugggauuauaggagugcaccaccacgcccagcuaauuuuuguauuuuuaguagagacgggguuucaccauauuggccaggcuggucucaaacuccugaccucaagugaucugcccgccugggccucccaaagugcugggauuacagguaugagccucugcacccagccagaaacauaaaugaauuuuauacuuagacuugggucucauccuuaagauaucucauuauguauaugcaaauauuccaaaaucugaaaaaaaaauucaaaaucugaaacacuucuguucccaaguauguuggauaagugauacgcaacccauauauccuaauuucagauuaugauaguuuuugaaaaaauuaaagcuugauuuacagccugagaaauaacaccauucaguaaggcagagacuguucacaugcccuuuucucauuuuggaaugaguaauugcuuggugaggaaacugaugauuuccaugaauuuucuagauuaucugguauauuauuuaccucauaaguaaaagaaucaagucagaaaaauagcagcaugcuuaguauacuggcuauuaagaaaaucaugcaaaaagaaguagaguugggcaauuuagugaauaagauaauggccagccuaaauaauuacugcaaacaauuuuauuuacuuaaaaaaaccucaaggcuucuguuuguuuaaaaauaucuggcugguaguuucagaguccccuuuccuuuagacuacauuggcaugucugaaccaagccaacaugcaguuacuuggauguagccccuuggaaagugaagaacagcucaauuaugauuuaauguaauaguauauucagacuuauuugaccaaguaaaggauuuuucuugacauauggucugcauaaaauauguauacaaauugaauaccucacugggaugugccaacucuaaggaugucauuggcuuguuacuuuaagguuggaauaugguauguaauaugguauguugacauugcacugucaaguuugucugaguagcuccuuaaugcauuuccuuaaaagugaacguuuauugagcucuuccugggugauagcacuacucucacugcuucucuuaggagaucacccuuuagcuucacaguaacugggugaaguacguaccaguauuuccuucauuuuauagaugagaaaacugagauauagaaagguuaaauuaugggccgggcgugguggcucaugccuguaaucccagcacuuugggaggcugaggcaggcgggucaccugaggucaggaguucgagaccagacuggccaacauggugaaaccccaucucuacuaaaaauacaaaaauuagccagguaugguggcauacgccuguaaucacagcuacuugggaggcugaggcaggagaaucgcuugaaccugggagauggagguugcagugagccuggaucguaccacugcacuuuagcuugggcgacaaagugagauuaaaaaaaaaaaaaaagguuaaauuauuucuccaaggucacaagaccuugguagaagcauauuucuauccaggcagauucuaaagcuuguuuucuuuucuuuuugagacggagucugacucugucgcccaggcuggagugcaguggcgcaaucucggcucacugcaagcuccgccuuccggguucacgccauucuccugccucagccucccgaauagcugggacuacaggcacccgccaccacgccuggcuaauuuuuuguauuuuugguagagacgggguuucaccguguuagccaggauggucucgauuuccugaccucgugauccgcccgcauaggccucccaaagugcugggauuacaggcgugagccacugugcccggccaguuuucuuaccugcuacacuagaaugcaguuauugaaaauuaguuuuuaguuguuggucuuaucagcuuuuauacuaucacuuuuuccuacucauauuaaaaaucuccacagguaaauaugcuuauuaaguuuguaaaauaauaauuagugcugaaugcacacuuggguauaguuaugccaguauguacuuuccauuuuaaggggaaauaaaaaaaguuuguuugauuuguugggcugguaaggcugaacucugguguaccuuugauuuagugucuuuaaguauggcgggggaauaaacuaugagucuauaguauuuauaaccauuauaauuuuagguuagaauaaaagaucauuaggaucuacauuuaaaaacaaguaaaccaugaauuugaauuuauuuuauugaauuauaaaguauaugaauaucuuuuaauaugucuuugauaucugugauuauaugacagggacaaaauauaggauuaaaacuuugguugguuucauuucagauaaucuugccauagguuugugcagucucagcagaaggaaaucaggguuguuauuacuguuuuacugaucucuuccaaguuucacuucuugcaagauguugggguuggaaagaggaucucuaaguaauggaaucuuucuggcuaaaaauaggagccuacauuggcugcugcuuuagcguuuuuauuuuguggauacccuuaaccaguugaauagucuucacuuuuaacuuuugugaauuuucacacaaauuuuaaaaauucucuaaguuaggaccauggaaacuuugugcuaucaauauuacauaauuugugaauaguuuacuaucagucucagauucuaagucaaacacagugcuucuggucgaacaaaucuagaaaucuucuguaucucacaauuguaucuucuuuuguaucuuacaauuguaucuucauauauauuuuuaauaauggguuauguaacuuggacaaauacauuuauggcugggaccuuuuaaaauucaguaaaaauugggaggccgaagcaagcaaaucauuugagaccaggaguuugagaccagccuggccaacacagugaaaccccaucucuucuaaaaaaauagcaaaaauuagccaggugugguggugcaugccuguaaucccagcuacccaggaggaggcugaggcaugagaauugcuugaaccugggaaguggagguugcagugagccgugauugugccacugcacuccaaccugggcgacagcuuacucugucuccaaauaaauaaauaaauaucaaugaguaaauuguuuuugguccuuacauggcucccagcuuuuucaacucaucucuugccuugguuucagucauuuaauucccauuggcugggcagucugagagcuuuuccugaguuuaccugaauuaaacugauagccuuucuccuugauucuccagguaauuauugcucccagauuuccaguagcaaguucuuuaggagacuaguuuggaucccucauuauucuguguuggaacucccugauucugcugcucccuuugaagaccacccaaugcuuguugccuaacucuuuacagauugugcacuacuugccugauuggauuucuuucuagucauggaagcuggccuucuuuuuccugagagaguaucuaguuaugguccucgccccuuccuguuagcuccuucuaaggcuguuaacagauuuuauuugcagacagauuuuauuuuguacagauuuuauuuuggcugucguauggaauuuuguaaaagccuguuggcaugaacauaguggugguggugggcaugacccuuuuaaauccauccacaauucuuuuuuuuauuuuuauuuuuuuucucugagacggagucuugcuuugucacccaggcuggaaugcaguggcgugaucucggcucacugcaaccuccgccucccagguucaagcaguucuccugccucugccuccugaguagcugggacuacaggcgccugccagcacacccagcuaauuuuuguauuuuuaguagauacggaguuucaccauguuggccaggcuguucucucuugaccucaugauccgaccacuucagccucccaaaaugcugggauuacaggcgugagccaccgcaauggcccauccauauuucuuuucuuuuuuuuuuuuuuuuuuuugagacagagucuggcucuguugcccaggcuggaguacaguggcacaaucuuugcucacugcaaccuccaccuacuggguucaagugauucuccugccucagccuccugaguagcugggacuacaggcgcccgccaccauguccggcaaauuuuuguauuuuuaguagagaugagguuuuaccacguugaccaggcuggucucgcacucccgaccucaggugauccgcccgccucggccucccaaagugcugggauuacaggcgugagccacagugccuggccauccacaauucuuuuuaucuaauuugaggcagguaggcagguucaauaggcagaucuuugucuaguuucuuucuuuuuuuuuuuuuuugagacagucucaccgucaccuaggcuggagugguguaguggcccaaucucggcucacugcaaccuccgccucccagguucaagcaauucuccugccucggcaucccauguagcugggauuacaguugugugccaccacaccuggcuaauuuuuguauuugugguaaacacuggcuuucaccauguuggccaggcuggccuggaacuccuggccucaagugauucucccgccuuggccucccaaagugcugggauuauaggcuugagccacccggccuggcuuugucuaguuucuaauagcaguauuaaacaauaugaaaacagguggugguguauucuauuuauagauaccccuuuauguuuuaucuugcuccauuaauuuuaaaccuuuccacuggucacauuauucuguuaauaacauuugauaaauuuguuuauucucuguucauguaaauaaaguacauuaguuauaacauagagacugucaccuaaugccuaauccuccaucagggaucuggaaguuaauuggcauaucacguuucuucuacuggaaguuagguuggagauauauauauauauauuuaaaaauuaaauuguucauuuuaauaaguggagugugaacaugacauaauuaaaucugucuuaacauaagaaaguaaaggacuucuuuagaauaaagaauauauaaaaaucaaccuuuaauuucuccaguauuuucaccuaagcccaccauauaguuuuuuuuuuuuuuugauacaggggcucacuuugucaccugggcuggagugcaguggcggaucuuggcuuacuucaacccccaccucuuagguugaagugauucuugugccccagccucccaaguaucugggacuacaggcacgcuccaccgcaccuggcuaguuuauguauuuuuugguagaaacgagguuucacuauguuggccaggcuggucuuaaacuccugaccucaggugauccaccugccuuggccucccaaagugcugggauuacaggccaccaugccuggccaacccaucauauaguuuaacagagauuuuuaucugucuuuugcuugaucuaccaaaauuacccagcauuugacuugauguuuaggagcuauacccuaaacuucuaggagccagauuaaugaugauaaaaauagcaccuaaucacuuuauauuuauuuacucucuagaccagagauucucaaauuuaggacuccucccuuggacguuuuguuacaauaugauugcuggaccccaacccugacccccggaguuuuugauucaguaagucuagggugguaucuuaaauuugcaucucuaacaguucccaggugauguugaugcugccagucuggugcccacacuuugacaauacggcaguagacaguggguuggcaaaacuauagccuuuauuuuuguaaauacaguuuauuugaacacagcccagcucauuuguucauauauuguuuauguuuucgugcuacaguggcagugcugagcauuugugacagagacuuuaugguccccaggccuaaaaucuuuauuaucugguccuuuauggaaaaaaaaauugauaaccccugcucuagacaaucuuguaaaaaauaauagguauuuuaacucucauuuuauagaugagaaaacuaaagcucaaauacuucucuuaaggacuggagcuaguaaguggcagaucugggauuccaaaccccauguccuuucugaaaccuacuuaaaaauuuuuuguugacggcuuccacauuuguuacuauagcccagcccucuccucugaacccaaacuuucuucaguauuuaaaugcuuauuugacaucugcacuugaauauauacuugcugucauaacugggaauuauauuugaauccuacuuuuucacucaccaauuucaaucauugaggcaagucacauugauucugccuccgaaacucuuuuuuuggagggguaggagacagauucuugcucuguggcccaggcuggaguacaguggugcagucguagcucacugcagccuugacuuucugggcucaagugauccucccaccucagccucccaaguagcugagacuacagguuccagccaccaugccuggcuaauguuuuaaaaaauuuuuuguagagauaggguuuggcuauguuucccaggcuggucucaaacuccugggcucaagcaguccucuugcuucagcccccuaaagugcugggauuacagguaugagccacagcaccuggccaaaauucauuuuuuguauguccacagcucuccauuaccacugacaccacccggaucucacuaccuuaucuuuugcugggacuaucauacugccucucaccucuucuccuuguucucagcuugcucucccaucagucccuucuuuuauggagcaguaggagagguaaaauacgagccagaucagguuucccuugcauucagaauaauaugcaaauuccuuaucaugugaucgugugugacuccgccccguucaucuccgggugucuucuugaaggcugcucuccugcaugcauuacauucagacauauaagucaucuccccuauccuuaaacaagcucaacucuuaaaucacuccagagccuuuguacuugugacugccauucuuugcgagcuuaguuuuuuauccugggcuucaguucucuguuaaauugcaaaugucacuuccucagauuggccuccauuagguggguagcccacuuuuucacuucugucucagccauuuguuuuucuuuugacacuuaacucguuuaaaauuaauuuucuuuuuuacacuuccggggagcacugucaccaccucuggaauguaagcuucacacugagcgagaucuuaccugcacaugguugugugcccagaaccuaguucuguaguauggguucauuccaacgaauugaaauuagguugaguaagaauugaucccugcccucaaggaauuuaaguccacaggagcagauuaaugucuacuggcaaagauguauguuuguuuucauaugguugccuuuaguuuucaucauguuuaacaaguggugauuguauucuguuugcacgauauuuuuuguuauggcuacuuauaaauuuagagccaucauacugcuuauaauauuaaaaaggauuauaaaguaacuuacguaauuucugaaaauauuuuguugucuaauuugagaagggcuuuuuuuuuucccuccugaucaaaacauaggaaguuugcuaaagcuaccaacaggagaaugugugucuccuuguccuuugugaguugaggauuuggggauuggaagaugaucagccuuaaugauuuuacaaauauauccaugcaauaauuggauuuauuuuuaguuucaguucaguucaguuauuuaggcuucccagugguaacaugaucucauuuggaagccuauuuaguaacacagugcuugagaauggcuuugguaaguuuuuacucccaaaucugaaacugaccauuuucuuaggcccaagaagcuggacuagacccaagaaauugaagcucuggaccccacucuuccguaauuagucauguaacaugaaaaauccagaucaugauuucuuaguuguuccuuuguucauuacccuguuuauuuaaaaaccaacaagguuaauagcuuuuuaaggccuuucuuaacaaaucggcagggcagggcuaagaguuguuucaaaugcuuuuugaaaucaaaaagggaaaugaaugaauggagaggagauccaucugggugaggucagagaagaguaagaaaaaaaacuguggccaauguccacagugaacucuugaccaacuauaagauacaggguuuguauucuggauuucuuuauuugcgaaaacagcaugcucuugugacagaauaauaaucacugcucuuguauguauuuuauuuaauacuuggaauaagagguuuugguaggucgauuauacuuuucauggccacugagauaugcaccaagcuauagauaagauggcaaguaagacugcaguauucuuguggguugggguucuacuuuaaagaaaaaacuacacaaggaaagauaacuuuauuuuucuagaaaaaccuaacaggggccauaguuguaugccuuuguaaauauaggcucucugcuuccaccuccuuccucaaaagggccuuuucuccuccuucauagucugucuaguaugagcaauacucauuucuacauuucuucaauguuuggucccuuacaugguguaggagagucucauacaguaauaaguucuaaacagcuuuucuuuuuacaccauugaugaagcaguaugugguuuauguaugcguuucucuguuuugucauuaguuuuuauaauaauugaaaugauuuuuggaaacccgcuuuccauuauaaucuugacccaaaaacauagauauugcugaugauguguuguucaaagcagcaaacacagcugcuuguuaaggcaaaaggcaaauaugaaaauagacaguuucacaacauguuugcuuauuuacaaaggcuguuuucuuuuguucuuggaguagaggauaaacacaucauuucuguaaagggacaagcuguaauguacauauugaguaugagaguuacuuguuagcauugauuugagucauaauauauuaccccguuuacuuaggaaccagucagguuaauagauuuuuuuugugccugugauuguaccaguuaguaguuucucuggaaaucuuguucgcuaugauuuuucuucugaaagcagaauugauucuagauauuggcaguggaaacugacauauauauguccuguaauuguuuuuuggcugcuuacauuuuucagauguuuuuuuuuuaauuuuuaaauuauuauuauuuuuuuuugagacagagucucacuuugucacgaggcuggagugcaguggcaugauuuugacucacugcaaccuccgacucccuggcuuaagcgauucuccugccucagccucccgaguugcuuggguuacaggcaugcaccaccaugcccagcuaauuuuuguauuuuuaguagagaugggguuucaucauguuggccaggcuggucucgaacugcugaccucgugaucugcccgucucggccucccaaagugcugggauuacaggugugagccaccaugcuggccaucagaugauauauuuuuaaaagccacgcuacuaccgugaaagagaauuacaacaaaugcuuugcauauauuuagaucuucauaauucaaguggagacuuugaacugauuauuagaaaauuguugauuuaaaaaauuauuguuaaauauccucaguaccugauagugcauaggguuuuauguauauuuucugcuuuagacucuugcugucaaugaacaaaauguucauuuuucuagugcggauggaguaaaugcaggaaaaucccauccuucucacaucguucucuguuuugaacauguucacuguaaucggucuuaaaagaaguaacuaacuucugcuaaguuuucauuugccauuugguggcuuugcaaaggagaaaagaccacuuauuauugacuacgcaagugugacccuguggaauagguguugaugaaaagagucaaagucuacuagguauuugaagagauuuauucugagacaaauaggagugaccaacggccucugacacagcucucagaugauccugaaaacauaugcccaagauggugaggccacaacuugguuuuagggagacaugagacaucagucgauacaggugagauguacguugguucagucuggaaaaacaggacauguagaagugggggcuuccaggucacagguagauuaaaagauuuucugcuuggcaacugguugaaagaguuauuuucuaaagacuuagaaucaauggaaaggaauguguggguuaagauaagggguuguggagaccgagguuguaucaugcagguaaaaucucuagguaguaggcuucagagggaauagauuuuaaauguuucuugucagacuuaaagagucuguucuaucaguaauuacaaaagggaggaagguauaaugaggugugccugccccccaacccaaucauggcaugaauugguuuucagguuaacuuuggaaugcccuuugcugagaggaggguccauucacaugguuguaggggcuuagaguucuauuuuugcuuugcacagggaccuccaguuugagaagccagacuggaaccaggaaauugaagcuccgcucuccacccuucuguaauuagucaugugacaugaaaagucauuugaucuggauuaugauuuucuagcuguuccuuuguucauuaccucauucauucauucauucauucacuugcucauucccucaaccauuccuucauuuguucaguuauguuguaaacugaaugccuccagugugccugguacuguguuggaucuugguauagaguguuguauaaagcaaaugcauucacugcuucauguaucuuaaaauuuugcagaggagugggacaaaacuaagugaaaaacagcauuaguugauagcagaguuccuggacucuggaauccgacugcugggacuccaggcuccaccacuuacggcccugcgcaaguucuggcaccugucuguacuuguauguccucauuuauaauauggggauggcaaaaugugcagauuucauaaggcuguugcgaggagugagugaauucauuuguauaaagcacucagaacaguaccauaugguaaguacuguguagauguuagcaacauaacuacaaauuuucaauuucaaauugugaugaaggcuaugaaggaaaagaagguaauguuaugaggaaaaaaaagaggaaacuuacucuagauuggguuuuguaguagguaguuucuucaguucuguuuuccuaacaaaaucuuguuuuuauucagucauuucuccuucugucucucagccaguaggcuacaggaaagauuugcccaggaauccaggcccaagccaguuuguaaguuugucccuggacauacagugguuccaggaaaugugucucaguuugugccaaugcaagaucaagggcauuugccaggugccgagaccagcccgguugugaagacccuaacccaguggugcuagaggaauuaaagacacacacccagaaauacagaguguggagugggaaaucagggggcugacagccuucagagcugagagcccugaacagaguuuuacccacauauuuauugacaguaagccagugauaagcauuguuucuauagaucacagauuaacuaaaacaggaaacaaagggaugggcugaaacaaagggaugggcucuggcuaguuaucugcagcaggagcauguccuuaaggcacagauugcucaugcucauguuuguggcuuaggaaugccuuaagugguuuuccacccagcaugggccaaguguuccuugcccucguuccgguaaacccacaaccuucagcgugggcgucauggccaucacgaacaugucacagugcugcagagauuuuguuuauggccaguuuuggggccaguuuauggccacauuugggagccuguucccaacagccaggggcucugagaaaguuuucuaauugguuguugcauguggauuuagaaacuggaacuguuauaauuauuucacuaccagaaagaugaugaaguuaacauacugaggagggcauuguuuggacaucugggaaaaacuguaccugaauucugacagaaauaaaccugauuacuacuaccggugguacuuuuucaguuuacaugaguugaguugguuuuucuguuacuuguagccaaaagaaagagaugggucacagaaggccacuuguggaggugaacaauucaggauaacuuuagauuugcugauuuuuuuacuaauggguagauuugggaccauuuaccaauaugaggaaggcugguugggggaaugugggagaaacagguuuuagggguaaaucaggaguucuuauuucuauaauaagaugagcugauguuaacagugguuugcaagcuuuuucuuuuucugaccuaagauaccucagacauaucacaucuuaauaucaguaauugugauuucuaaagaauuggcaaucauuuucaccaauacugagguugaugaaaucaaaaucuuauugggggcagguaggaagggugauauaucaguguuuuucaauuugauugcacauaagaacuucauggggaguuaacaaauguguacaugucuacuagauucuuggguccuucuguagagauguagaaucagaaucuccagugugggcccugggaaucucuguuuaaaaaugggccauugggauggagucagcuuagcacuuuugugcagccuuaauuuggagaaccagugcauuaggggacccaaggccccuuccuauacagguuuuuuuaauuaugacuccaggaaucaauuccacuuaagcucaggaaacaccaagagccuuaggauuugccacaguacagucuuguuaaaacacaugaguaacaucauuacacuacugcuucuugacaccaccucuggugagauuguuaugacuuuuuuuuucuauaguguuagugaaaacucgaucucugcaggaauauuggcaauacugugagugcguuaacaguuaccaaaugcuuggguguuugacugaugguuauuagaacaucugucacuuaaacagcaguuaaaauaucacuuuacguaucaauaguuuggcaguuuccuggaaagucaggugguagaucagccuguaaucauaagguuguguucuacagucauugcaaggacauuauuacccaugcuuugcugaagcuagauaauaccaauagaugaaaucuguugucagaugguaagaggacaugagucuaggacacacugaagcauaauuaugagcgguguuacaagcagcggggaggugggaugaucugugauggugaugagccaaggagggucguggcuccaaggcccagacaggguccccaaauaaugaggugaucuacaggaagacauuacucuaauuaauguaauuaagacuuuauuuauagucauuugggcuacauugucagcaaaccaauuugcccaaggugguaaugauucucucagcuuuggaaaaugaugcuguaggcauugguguagggauggggggcaggggaggguacaauuuagcucugcuuugucaaaucuuuuuuuuuuuuuuccuuuuucccucuacccuccacccucagagguuugugagugcuggaagaacauuuaguccuggaaaaaggcaauauuuuaacucuucuaccuaguaagagauaaaguucugacuugacuuccccagaaagcaagcaaguuauaaauauaacauucuucucuuugcuuaucuauuuuuugagguaauguacaauuugguaguuacccuagguaucauauuaaacuuuaggucuguagauguggggugaggcuuagaacguuggacaccucggacacauuugcaucuguuccucugguccauuugcuguuuccguaauugaacugcccuucauguauauaguugaucugagacuaauaaaaauaauaauaauaauauaauaauggugauggcauaggauuuuuagaggguaauucuugguuauggauuaggcagugagagccaugagaauuuuguaguugucacaguguuuuaaucauacuuguuaccaacauugucaucaccacacugugaccauuagcaaauauugguugaggcuaaucaaguguaagauuagcagguugacaacugggaauaagagguuuaagugauuucagcauaacagauaaacacugguaguagccuaagcucauguuaauuaugaagugaagcuguagagauaguacacauuguuggggcacucgguauucuccgacaugagaucugcaauugguuucaagaaauguggaaguuucagggccugguugaagaguguuucaagggaaaauugauaaauaaguaacauuuaagccuucugcagguuuucauucuuuaacaaaaugucucaaucuguuagagacuuaaaagucaguguagcuaccuguauguaggaaaugaagaacucaaugauuaggaaauuuuaaugauagugcuuuuucugucauucuuacauuucuauaaauaauaugacauuuacagguugaaucaaguuaaacauugcuuucaguggcuucauggugauuuccacauuccuuagaaauauaaucauaguacuuugaaagagaauuuugguacagcuagaaaguuuauagcacuuaguaauuuuuugaggcuauaguauuaaagaaauuuauggcuccauuauauauggaaaugggaucuggagagcauaugaucauugaaauccacagauaguccuuuacuugaaguccuuucucaaugaguugaggaacaaauaaauacagauggucuuuacaucuuuuuucucuuaagcccuuacuugcauuucuuucaugccauuguguauuguagauucuaagauguaagaaaaaauagcuuaaaaaguggcucaacugaauuugagcucugauugcuuugcagacauucaguggcucccaaauauacagcagaauaguuagauucacucuuuuguaagcgaguggcuucagugauaaugaugguauggaagaugauaaugaaaaacuacauuggcuauuuauggaaacacauuuuuaugucugaauggguacagccuaaucuuguauacugcuaguauccagucuguaagauuauugucauugaaggaauaaacuuggcucaaccauuuacuucauuccuuaucucucuccuuuuuuguuguuuuuuugaagcaggaucuugcucuguuacccaggcuggagugcaauggcgugaaguuggcucacugcagccuugaccucccaggcucaagugauccucccaccuuagucacccuaguagcugggacuauggacaugugccaccaugucuggccauuuuuuuuuuauuuuuagugaagaugaggucucgcuguguugcccaggccaguguugaacucuugggaucaagcgauccuuccgccuuggccuuucaaagugcugggauuacagacgugaaccacugccucuggccucucucucuucuuucuuauaaccaguccaguuacucagagaaugcucaagcuccauaccguggguugguaguucucauccuucucuuugucugaacuccaucucugcuuuccagcucucugaacuucucaucauuccucgugcccaccuggccuuccacaucucucucuacacacauuggucuuuuuguugggaaugcccucuuguucaccugguuuccugaucuuuacaaacccuauucacaagucacuuccuuugcuguagucuucuugauaucaauccccauccuccagaugaaaguuguuccuuccuuugugcuucccuguuuauggcuuuauugaggcaguuacagaguauuuuuauuguugauuuguaagccucucuucacuaguuuguaaacucacugaaaguauagauagggccauuuuuguauccuuagcaucuaacacaaugacuaauauguauuauuauuauuuuuuuuuuuuauuuuuauuuuugagacggagucucgcucugucgcccaggcugcagugcaguggcgcgaucucggcucacugcaagcuccgccucccagguucaugccauucuccugccucagccucccaaguagcugggacuacaguugccugccaccacacccagcuaauuuuuuuguauuuuuaguagagacgaguuuucaccauguuacccaggauggucuugaucuccugaccucgugauccgcccaccucagcuucccaaagugcugggauuacaggcgugagccaccgcgccuugccaauauguauuauuuauaugcuuuguugaaauaauuuuaacaaaauauauguuuuuguuguuguuuucaagucuuuccuuucugaguaggacugugcuauguguccaggguuauaagaaguauaaggauugaccuagacacuaaaagguucauauuguguuuggaagaaaaagaacacacagggaaaauguuaaauaauuaaagacagugaaugguccuaccacuguuuugggaaaaagaacacagagaaagcauauagguccuuaauagagagcuagguaaaagagguuuuauuuuaaaaaauaaaauaaaagucuacuaaaacugaacugcuagacauaggaguuagcuaauauugugagaaaggcaagucaagccagaagaaugucauuagaaugacaguaagaaaauauaguuguuauuaauaaguagugguggccaagcauaaaaacacacauuuaugagggagccauacaaacugaagccacacaaucaaucagaaacacagcuaaagaagauaaagguuagguauuaggcaaggaauaugucaacaggaaauugagaaugaacaguauggggucaguguuguggggaagggaaaggcagggaaguuugaagagcaguugagaacaaaacacaaagaacuagugaaaagaacgaccuugaagcuaaggcauugcuugcccuaggcugguaaaaaacaugcucuccuuccugccaggacuggagcggaucagcgugugaccagcccagggcuugcuggcggaagcaggugugccaacgagugagcugguaauuagguuaagggggagaauggggaauugcaguagagccagauugcgacaagagagaguaguggaggagguaaggagggagacucuugaggcaaaagaauggcagaaaggaugugugaaacaaggucccaguuuacauuuaccuagugcuuucucuuucuaaggcccuaggucugaaagggaaggccaagcagagacaguaucaguuucauaggcccccaggagagcacauagccacuggcuugacuugccuuucucacaauauuagcuaacuccuaugucuaguaguucaguuuuaguagacuuuuauuuuuuaaaagcaugagauuuaaaaaaaacuguuaaaaaauuauacuuguagaaauguuuaggauuuuugucaugcaauauaguuaaaagguuuucuaccuaagggguauacauuaaauagaguugucuuagaguacuguuuuaacacuugcuuguuuaugauacagauaggaugcagggaaauacuagguaaaagagggcgguuccccaucaaaggcccaauccucaagccuagaaacccauggccuuaaaugggaacaggcauuccuguuuuugcgcccacauguugcuuuuuccaaggccacuguggcuugccacaucccuaccucgagcccauauaaacccuaagcuccgcgagucacgaguagagaaaaagaggagcagaagagcagcagaguggcagagcugugcagcagagaaggagagaagaaagggagcaucugaacguugagaguucggcugggggugguuggagaagagauuggccaggggacagccgaacuccaggggaagaccaucuucccacuccauccucuuuccagcuccccauccauccugcagagauccaccugcaccacucaauaaaauccucacauucaccauccuucaaguccgagugaccugauuccuccuggaugccagacaaggacccggguaccaagaggagaggguguaaaaggcugucaccccaacucuccacugggcugguuuaacacuuagccauccaugaacggcaacuacuuaaaagggcauuaauuguaacaccccuagaugcuacuaugcggccagagaccaaaagcgcuuacccuggcuccugcaccugcccaucugcaugcuccccauuccauaagggguuugugcgagcaacagggcugaccuagcagaggagucacaccccuguuguaagacccaugagaggguuagggaacgcucgcuucauugauaaaaaucaccugaggugcuuguuggacaacagagauuucuaagccuuaccacagacuuauagaaacuaaaucucuagagcaagcaccuaggaauucauguucauaagcauccuagguacuucuugugauuaggcaguuugggauaaauauugccugugucaagugaaagacuuuuaaguccuucuuguaggucaaggauuauagugcuuaauuucuaagucauggucuugauuguacuccgguuccuacuuugagagguuacaaaggaagguuuacuguauucucccauuucuaccaguaguuuaacacagggguucucaacuccaggugauuuuauuccccaguggacauuuagcaauaucuggagacauggagacacuuuugguugucaggcuguucaugugggcacuauaggugucuaaugaguggagaggucagggauaaugcuaaauauucuacagugcacaggacagccuccuacaaacaaagaaugaucugggcaaaaguaucaauagaggacccuggcccuaaggucugucaguauuaauuaauacauaaaccauuuaauuaguuaauaaaaucuuaaauugauguauaauauauaucccaugucaccgacauccauauuaaaauguagaauauuuccagcacucagugcuuucuuguacccucuuccaguugauacccauucccccuuagaaaucauuauccugauuucugucaucauagaugacuuuugcuugugccugaacuuuauauaaauagaaucauacaguaugcacucuuuuaugucugaccucuuuuacucaacauugugucugaaagguauauuccugguguugcauacagcagaaacuugcccuuuuuuauucuuguaguauguauacugcaauuuaguucuccauuuacugcugaugggcuuuguauuguuacaaacuugugauuaauaugaauaaagguguuauggacauuuuuguguaugucuuuugguggacguaggcuaucauuucuauugcauauaugccuaggagaggaauugcuaggucuuuggauagcauugguuugggcuuacuagauacugccagguuuccagaguguuggaccaguuucuacucccaccagcaaugugugacaguucuaauagcucuacauucuucuuaguauguaauauuguaaguucuuucauuuuagccauucuuguagggaauguauuuguaucucauggagguuugaauuugcauuuugcagaugacuaaugaugugcuaagcaccuuuucauaugcauuggccauuuggauguuaucuuuugugaagugcuuguucagaucuuuugcccauuaaaaaaauugucuuaugauuuguagaaguucuuuaaauauucuggauauguguccuuuuucagauauguauugcaaauccauucuucuaguuuguugcuucgauuuucauucucuuuugagaaauagaagcucuuaaugaaauacaauuuaucagucuucuauuauauuagugcuuuuguauccuuucuaggaaaucauugcuuaucccaaacaccugaggucuuuggaugcucagguuucuguuagcucagcacuuuguagugaaccagauuuauuuauagauauuauggcuuucuuuguuuguuuuggucuaauccacaugguuuauauuggacacuaagccuaugugagagcugggaguggugcaugccuauaauccuagcuacugggcugagguaggaggaugguuugagcucaagagugugaggccagccugggcaacauagugggacccuguccccaggaaaaaaaaaaagccuauaugaguagcagauuaauauuuauauauguauuauauauaugcauuagaagagaaguccuuuugcuucuugaguuaggcaguugauugguuaauauuuuuguuaaagcaggguaucagaaaggauacauuuccuaaacauuuuaagcuaaccuuuugcuaggcuuuugggguagguccacaucaaggcugugucuuuacauaugggugcauuagugacaguggagacucuucgguuuuuugacuauaucauaccuuaaaaguaccuuuaguguuagugagaauguaaagauacuugugaauugguuagaguucaaagucauccuaaaguuuuaucauuuuuccucauuuuauuuuaugauuguuuugucugcacuugauuugacgauuucucauuuuagugaauuaaaaaaaguauauauuuuaaaaauucuauuuauguucgcaggcuggacuugaacuccuaggcucaagggauccuccugccucagucucccaggcagcugggacuauagaccugucccacggcacuuggcuugguuaauuuuuuguuuuguguccuguaagacuuuuuuuuuaaacuccaauuuuauuagcuuacauauauuuaauuacauaaauauaauuauaaucguuguauaguaagcacaaauaggacuggggacaaacacaguugacuuauaaccauaggguucaauucaggacagagauaucuagguguacggagugggggccccuagcuauccauagccagcgggcugugggcacauggaacaugcauguuuuacagaggcaguggagugugaggguuaauucaucgacuuauuuagaggaugguggaugaagguucuccaguucucauugagcuguguaguuggaaagauaggaugggagggagggaaaaccagauauuuugaucuuucugaucaguuacauagaaucucuaccuucucuaacugaagaaucagaagcagaugaaagaguagucauauauuuaacuagggaaagcauuuauauauucauguuuacauuuuucccagagaguacuuaauuuuuaaauuugaaauaguagcuugggauuagacagaggaaucuaacaccuaugaaagguuauauuggaguacauuuacaauguaguuauguaaaggacuuuacagauuguauuucaaaagaaaaaauauauaccuuuagaucagaucauuauaaacccugggaaaaaggacuggggauuuguguguucuuguuaggucuugcuuguuaguaucuccagacauccuguacuaacaugccaaaauccaccccauaaauucuguuggaaagcgaccugcugccaguuugaagcugccuauugcuuaauaaagucuagcaguuucuauauguuuucugcagaaacugaauaaauauagcaagguagaaucuguauuuaauuuuggaucugauaacaucuuuuacuuaaaaguuggaagcaauuuuugcaugcagcuguaauuucaugugaaucguauuuuuaaauauugaggauaaaucuuguaagaauuuaaaauggaacauuuaugcuaacauuuauauuaaucuuuuuaucaaagccuggaaagaacccuauuaaauagcaggaguagguauuuuaaauaacauuucagaauguuagauugucuacuuucuuuuaauaagucacaauagaggccaggugccauggaucacaccuguaaucccagaacuuugggaauauaaggcagaaagaucacuaauauauuuuuauuuuuguuuuuguagacaugaggucuugcuguguugcccaggcuggucuugaacucuugggcaugguggcacaccuguagucccaggcucccagggggcugagguaggaagauuguuugagccuggaggguggaagcugcagugagccaugaucauaccacugcacuucagccuaagcaagagagcaagacuuugucucaaaaaaaaaaaaaauagagauuuauuacaggauggauuauuagaaauaauuguauuuuuacagaauauuccuuuuauuuucauguuuguuucauuuauuauuggcaaugccagguaacaggauccacauaugauuuuucuuuuucgauauuauuaaauaagaauuuuuuuuuuuuuuugagacagagucuugcucuguccuccaggcuggauggcaguggcacuaucacggcucacugcaaccucugccucccggguucaagagauucugccaucucagccuccugaguagcugggauaacaggcacaugccaccaccccuggcuaauuuuuguauuuuuaguagagacgggguuuugccauguuggccaggcuagucuugaacaccugaccucaagugauucacccaccuuggcaucccaaagugcugggauuacgggugugagccaccgcgcccagccaagaaucuuuuuaaaauagaaaauguuuuuucuaccuaguggaaguauacauacauauauauauaacuacacuuauaauuaauauuuuuaaggagauugaauaacuugguuuaaauaugucugaguggaacucaacuauuuggcaguauuuaugaagaagaaaacaugacucggugaagaauucagauuuaaguuuuaauugcauaauguuauuauuguauuaaaaauaaaggcuaugauauaugaaauauauugcuuguucgauauccuuuggaaauuugaauggucagaaacaccuuguuaaacuaaacauauugguuaaacucuaaugugcugcucagugcuugaggauacuugaaagcaagaaaaaugcuaccuaaaaaucuuauuuauacuauuuauaaaguaauauaauauaaaauuuaauuaauucaggaauuauguauuaugacugcuuugugccaggaauguuagaaauaugaagaauaaaccucacagaagcugauaggaauuuuaaugcauuugaaaauaauuuucuugaaauuuugcuuauuuuuggcagaaaagacuaaaaccuaccauugccaacauuuuuauaaauguaauuuuauggguuuauuaaaccuguauuuauugagcccuaggcccucgagacgcuauccccugacggccgccucaggcuuccucaucacaacaacagccacaccaaaagcuggaaacagacacuuuaaaaagagaaaaaaagacuuccaugugacaugucuaugucaccacaccuaaaauuguuaucucucuccugugaccuagauaauuacuucacuccuccguaucacucauauaucagggauugaagccuuuuaugauuuaauaccguauaguucaacuuucaccaguuucuuuguugaaaaucacuuacggcaauuuguaaaaacuucuguggaaugguuaugcaauggaauguggguuaauguuuagucaucgaaauuaguuggcagguucuuagaaaacugugaaauaaaaauaaauuuucuauaaaacauuuucucauuauuauugcuuuuacugcuaccauuaauaaagguuucaaguuauauucccacauuuuuaauuaaugucuuaauuuagcuuugucaaccaauaugacaaguuuuacaaagauaggcucacaguuuuauauauacgcucauaguuuuaucaagauauguucaugucauauauccauaguuucuggauacaugcagcuuucauauacuaauuaggguuauuuuuggucauaaacuccaagauaguaucuuuauuuacuauggaggaaaugcaaaagcuaaucuaauuuccaauuucuaggcagacaguaacauuuacugaguaauccccagcauuauaaacugauuuuaaagcaccuuuaauaaacagcgaguuuacuuggaaggaaggauaaacaugaagauguacuuuaaaaauauaagcaaccaaaaaaaaagucaaaacuuaaguaagugguguaaugaaaucagucaaaagaaaaauaacacaauacuagucaaaauaugguccaaaagaaauuuacucacuuaaaauuacaucuuguacuaaagaauuaauuuacagaugucaucaaaaaauauaaaauuaauugaaguacaauaguuuaaacacuaguaauuauuugguuugcuucacaggaaacagccaagugucaaaacaauuaucaguuuuuugguuaaaugcuccuuuuaauauauauacacauuuguuauauaaaauauauauugcaugcauauauuuaguguauauuauauuuauuacaaauauauuuuuauaacacauuauguauaacuauauaaauuauaauauagagcacauauaaauauacauagaaaagcuuuuggaguuuuuuuuugagauaggaacuuguucuauuacccaggcuggagugcaguggugcaaucauagcucacuacauccucaaacuccugggcucaagggauccucccaccucagccucccgaguagcuagaaccacaggcuugcaccaccaugccuggcuacauuuuuuauauuuuguagagauggagucucacucaaaauauguauuauaaauauuaauauauauguuauauauuuaacaaaauauguaauauuacauaucuauauuacaaauagccaaguuaaaugaaaacaguccuagaauguaugcuuaauaaguaacagaaaaaaauuaucuacugacucuuaaauacagcauuugauuacaagaaaaagaugcacauaauaauaauaguuauuauuuuauagagcaccuuuuaugugcagacacugcgaggcacuuuuuuucgcucuaauaaguagguacuauucacuccaucuuauggacaagaaaagugagucucaaacaaguuaagugauuuacccaaaccacauaauuaguggcagagaaaaguucugaauuaagagcucuucaugcgcacugcaaugcaaauacgguaaagaaaugguaauagaucaauuuugcaggcaccuaauaaaauaagacauacuauacuuuugggggaaauagaaggacgcuugaaaagaauuuggcuggccuuuguccuagcuccugagugguaacuucuaaaucccuggacucuuccuauugauaggaguaucuuuguuauucauggugggacccucaaacuacacuugauaguuuaugcuaacgagggggcucacagugggcccuagauaguuuaugcuaauaagaggacugagaauggagaauggccaagcuagaaagacuaaccaugugauuaaagguggggcuuguggccaccaggugauaucagccugaccuuuggggaggugggaagggcugaagauugaguucaaccauaugucuaaugacucaauuaaucaugccuauuuaaggaagccucaauacaaacuccagacacuuagguucuggugggcuuaccuggcuggcaguauucucugcauauugucacaaaccgaugcuccaggaggaaaauuagaguaucgaucacaguguuauacacuuauaaaaagaggucaaaguuaccaauuucguccuuucuauuugaaauuuccuggaaaaaaagccagaaaacauaucugcauguauccguaugggugugauaaaacuuaaauaaaugucaaaguugcuaucaaaagacuuaauacuaaagggcuuuuuuugaaaguauaaagcaaaugaaaaggcaacaguaacaucugaaacauaacacgugucaggaauguugcuauuacacuaaaugaaguacaccucuggaggaaaacggaaauucugacaccgcaucauaaugaagaaaaacaaggaaaacaauuaaaagaaaugaauggcaacuauggccacugugagguaaaguagggcucaauaaauacagguuuaauaaacccauaaaauuacauuuauaaaaauguuggcaaugguagguuuuagucuuuucugccaaaaauaagcaaaauuucaagaaaaucauuuucaaauccauuaaaauuccuaucagcuucugugagguuuauucuucauauuuguguguauccacacaaaacaauauaaaauguaucagaguucauuuauuuggaaucauccauaggaccccacgguaccacuggcagucuacuccuaaaugacuacagaauguaaaaaauacacauuaaaacuauguacauuuggcugggcacgaugccucaugccuauaaucccagcacuuugggaggccaagacagguggaucacuugaggucaggaguucaagaccagccucgccaacauggugaaacagucucuacuaaaaauacaaaaaaguagccaggugugguggugcaugccuguaaucccaguuacucgggaggcuaaggcaggagaauagcuugaacccaagaagcgaagccugcaaugagccgagaucacaccacugcacuguagccuaggcaacagagcaagacuccaucucaaaaaaaaaaaaaaaacuauguauguuaaaacugugugugugcgcgucuguguguguguguguguguguguugcaguuucacuuucagguuucaguuaccuguggucaagcgugguccaaaaauauugcauacaauaagauauuuugagagagagaccacagucacaucuuuuauuacaguauauuguuacaguuguucaauguuaucauuaguuguuauuguuaaucucuuacugugccuaacauaaauuaaacuucgucauagguauguacguauaagaaaaaaaauuguguguguguguauacacacauaugguucaauauauauauguguguguauacauauauauacacacauauauacacacacacauaugguucaauaauauucaauaauauugcaguuuuaggcauccacuggggguccuagagcauaucccugaggacacggggggauuacuguauacaacacacguuaguauuauauguguuaauauuagguaauguaagugugauugauauauaauuaucaucagauauguauauaauuauauauauauaagucaaauaugugaaugcauauacaugauucuccccuuuguguaugugaauuucaaaaacugcuaugagugucacuuucacauuuuaggaggcaauaacuggagcagcuuuuauaaaauuucacauaaucugcuauaauuucaaagacugguuucauucauuuuuaaagaagcaguugcuaaaguuuauuauuuacuaaacaugaccuggggaaguauauuaggucaauuacagaaaacugccuauuuguauauauugauuuacuuucucauuacuaaaauauuuuguuucuuuuuuaauaagucuacucauuucacaugcuuuaggaguuagauuuuuagccauucaucuacgguguuugguuaaaaacaccguauaaaauacucauuuuaauuaauauguucacuacagagcauaaaguggaguuuuuuuaugguguuuuuguuguuguuguuauuguuuuuuuuuuuuuuugagacggaguuucgcucuuguuacccaggcuggaguacaauggugcaaucuuggcucacugaaaccuccaccuaacggguucaagcgauucucccaccucagccucccgaguagcugggauuacaggaugcgccaccacgucuggcuaauuuuuuguauuuuuaguagagacaggguuucuccauguuggucaggcuggcguugaacucccgaccucaggugaucugcccaccuuggccucuccauaaaguguuuuuuaaaacaugggaaacaaauuuucacauaaaugcaauguaaaaacacugcauccaacuugaaagaaagagaccucugucccagcucauucacuuguucguucauucaguaaacuuuuauuaagcauuuacuccaaugaagacccuguagaagacagcaugaauacaagagugauuaaaguagucacuguagaacagcaguccccaaccuuuuuggcaccaggaagagguuucauggaagauaauuuuucuguggacugguggcggggaugguuuugggaugauucaagagcauuacauuuauugugcacuuuauuucuauuauuauuauuacauuuuaauauauaauggaauaauuauauaaccuaccauaauguagagucagugggaacccugagcugguuuuuuugcaacuagacagcccuaucuaggcaugaugggagacagugacagaucaucaagcauuagauuuucauaaggagccugcaacuuagauccgucacaugcacaguucccaauaggguucuugcugcuaugagaaucuaaugcugcugcugaucugacaggagguagagcucaggcaguaaugugagagauagggaguggcuguacauacagauaaagguuugcuaccucaccugccgcucaccuccugcugugacgccuagguccuaacaggucacugaccaguacuguuuuuauauauguguguguguguauauaaaguauacguauaugugugcauauauauauauaaacaguacuggucaguggccuguacacacacacacacacacacacacacacacacacauucacacuaugcaugcccaucagcuuaugaucugaugucccuacagcaucgcagccuucaguauccucaucuaugaaaauauaaguaacaauaagaaucuguuuuagcauuuauauuagaagaaaguguuaaugauuacaccuagggcuuacaaguauguaaugaaacuggaacucgcauaaacugcuaguugcacugcaaauuaugaaaaucuuuagcaacagcaacuugaaaauaggaguauagaaccaauaaaaaucuaccuuaauccuuccauacuucuaccguugauauaaguuuaccaaaucuacuaaauacuuucucccuauaaauauccuccaguuauuucuacauuugucacccaucaaguccaccgacuaaaaguaacuccuguaaccacgugcaacaguuguauaucuuugugcacagugaggcuuuuauuuuguaacaccuacacuuuguugccuaauauauaaaaagaucuuagccuucaaucuauaauauuccacccuuaacugcaaaacauaucccuggcacaaccuguucccacccccucagguccugcugagggugcuuccuuggccaccacaauuccugcugaugggacauuuuaagggcuuccuugcaaucucuuacuucaccuguuuguuaaaaaaaaaaauuauauggacuaauuugagaucaaccuaguaguagaggucaaauauuuauaguuuugcuaccucuaaaaucugcuuuuauugaagguuauuacagaaaaagccauauuacaaaugcuucaguauacacugugaaacugcgguuguucaaugucacaucaagucccaauugagaaauuucauuuagaauucagugucaagaaaaacuguuuccacugaggugcuggaauuauucucugcuuuuggauaauuuaucagauguaccuuuaugcucuguugcuggaaagcuuaagugucaaaccuaauguugaauaaaaacuacguuaacacauguugauuucauguuagcuucuuucuccuuuccuugguucugaucuuccauuucuauuuuauuaauagccuuaaugagaagccacucccaagcuuuuuuuagaaagaagcacagcacaaauaaacuccauaaauaaauuuaaaaguacaacacagugaugaaaguguucuggaacuagauagaggugaugcuugcacaacauuacgaauguucuaaaagcuacggaaucgucuccuuuauuuaaaauaguucacucuauaagaauuuuaccuaaauuuuuuaaagugcagcauaauuccagcaaauagcauauggguagcaugaaacaaucauauuacauucuucucauuuucacugugguguuuggagagaaaauuaaucuccccucugccaugugaacugucugucuccccugcuacuacuuauguuccaguaucauuuuccgcugcucagcuuaugucaaaaauacuuaaacauucuguuaggccagcgguuuccaaaccagccugguucuggagcucagagaauuuuuuuucaaaagaugucuuucagagaauaccagcacauaaaucaaauaaaaccagcugcucuguaacuuaaaauuauccgaaauaacuuuuuaaaaacaaaaaugucuaggcugugacucaggcuuguugaaucggcaaucaucagauuaugaauaugauaguaaaguguuuuccagcaauauugcacaacuuuugauuugcuuacauuuuuuuagggaguagugugaaugguaaauaacauuuagacuugaaacauuuucuaucuuaaaucaauguaugucacauguugguaaauuguaagcuuugccaauaugaauuuuuuucuuuccuuuuauaccaguaacagauaacaaauuagaugaaacuaguauuaccacugcuacauuuuacucugggugagauuguugauuuuagugcuccaugaccuuauuuuauagaagauuuuacaguuuagaaaggauuuugcauauacgaucucaguggauucuuagagugguuucugaggaaaauacaacaauagaugauguuauauuuuuggugcaaaugagaaaauaaugugcccaaggucuauagcuaauucauauuugaguaucuacaacaagcccagugugucauguagacaaggaaaugugcuguucuagauauuuugagacauuaauuauucaauaaccacuugaguauuuuugagaauaguuccaugcacuguucuauguguuguauggaauagagugauguacaguauauacacauagauuauuuaaauuucuguuaauauguaaaacuaagaaauagcaguuaccugugugauuaucuucucuggugucugcgugauauuauuagaaaauuccaguuucgguguaguaugaggaaaaagcaugggcuuuaggguucaucuuguccuggggcuaacacuugacucuuccaaugguuaagugucugugaccuugggcgagugacuuuuuuggggguguuauuuggaaaauugagauuaauauagcuauucuuauagauuuuaugaggguaaaugauguaauguacauaaaaugccuagaaaacuggcuggcccauaguaagcaauuaauaaaugaaagccauuaauaucauuuuuuccaauauugaaauaaaaaguagagaaauguagacccaugggucaugauuaauuuauauuauaaaauaaaauauuaacacaccaccaacacagaauuugaaauacagguuuaugaacaaacauccagacugcagugauaaaugaucaaccccagagccagggguauugucuuuuauuuacucguuguccuuugaguuguuuuguaaguguuaagguggcuuacagaaaagcuggagaauguaccauuguuguuuuaaauccaggauuccagauuucaucagggugugcaguaacaccaaaagacaugaaacaugaacaacaaugucuuauuuauaaugugaaauuauuaaacuuuugaucaccuuguuuuuuccauucccuuggacuuuauuauuaucuuaucuaaauuaugaucacagcauuuaauuuucuacuaaagaguuagaggccaggaaagguggcucaagccuguagucccagcccuuugggaggccaaagaggggcgaucgcucaaagcugggaguuugagaccagucugggcaacaaaacaagacucuacaaaaauaccucaaugagccgagcaugguggugaaugguggugagugccuguagucccagcuauacaggaggcugagguggaaggaucucuugagcucaggaguucaaaguuguagugagcuaugaugacaccugacugcgcuccgcuuucgcaacagaacaagacuuuaucuuaaaaaagaaaaaagaauuguaucauuugcuucuuacagcuacauuuuuccaccuuucccuccacaacuaaauguauguucuuuagcuuuuggguauauccaauaucagcaguuacuuugccuuuguccucuguuacccuagcaucuacagcuuuuuuuuuuuucagauggauauuuuuuucuacuaucugcuuauaaaaugcuuuaagaagacuaugaaaguuauccuguugucacgucuguaucuucuucugauucccaguacuuggauuucaaaguagcugguagucguuaagugcuuggcaagguagguggaagaccauguuaaacauucaccuuggcuuuuccuggucucugcaguugugguagcugugauucugaguagggacagggcuugguggcagauacaggacaguguucucaggggaaucuauugucccuuuaaggugaaggaaagcgaaguugacuggaaaaagccucccuguuaguuuggauugacauucuuccuuuuucuuucuuugagaaucacggauguagagacagggaaggugggacgucucuucugacugcugugucagcuguauguucugcguuagaagggugccuggaaggcaguguuugauagguguuuuauuaucugcuagggaaucccagccccucuguauauucuagacguguuaugaugagaacucguccaacaauuucccugaucuuacccacacuuggcagugugcuuugauuuagauauaauuaaauuuuugcauuauuuaaugcuguauggaauacuuucaggggauuauaacaaaaauacucaaacacaugaaaugagauaucugcucagucuagguacuuuuguguuucuaauucuuauuuuuauguuccuuuagaaacucugugacaauucuugccuuuucauucuucauagcuaaccucuacagggaaaaaaguaguugugcaguuauuugucagugaaauguccuagccgcuguuggcauucacuugugcaucuggcugcauccagcugggggccucuaaacugaaguaacuaauuacuugccuaagcccagaggagcuacgauaaacuucaucaaauaaacagagcaaugaagcccagaggagcuacaauaaacuucauaaaauaaacagagcaaugauacauguagcaguuuaucaccucuggugccuuucuucagguuaaguggugauucuguuuuuaguauagacuaggcagagagaagaggcacagacaggacauggaguuuggacuguuucuguuuucuuuuucugcucuguucuguuuucuuuuuucgcucuguuacucacugacuuuucuuuucuuucuuucuuucuuuuuuuuuuuuuccgaaaccgagucucgcucuguugccaggcuggagugcaguggcgcgaucucggcucacugcaaccuccaccucccggguucaagugauucuccugccucagccucccagguagcugggauuacaggugugcaccaccacgcccagcuaauuuuuguauuuuuaguagagaugggguuucaccauguuggccaagauggucucgaucucuugaccuugugaucugccugccucggccucccagaauguuuuuuuuuccccuaccaaaucccugacacucaaacuuaaauguuaguuuuagacuauaugauuccagaacaaaauuuaagugauuuugaauuuguuuucuguuuugggauauucauagcauuguuuuauuucauuauuguuauuagaaucuuaaaaauaaucaucauaauaaaccccacuaauguuuauugagaacugguuauuugcuagauucuccucugaacacuuaaaaaaacuuaguucuaaaaugauucugugguaaguuuuguuauuagccuaauuucacagaugaagaaacugagguuuuaagauguuaacuguaaaagagcauuugccagaaacuaacuaaauaccacucccuccucuuugagauguaacauuuuucuuuugagguuacccuauauuauugaggagguuaaaaagaguacauacauaguauauauuaugauguuuauaaauugcccaaauguuuucugaaaccauuauuugaguagcucugaaauggaaauuaugacuacucauuuuaauuaagugcuuuaagcuuaguugucuucagcacguuaauugagcauaaacauugagugcagcuacaccaugccauuggauacaaagaaguguuacagagucuaauuugucuucuuagagguaaaacagacauguauacaauuaaguuguaauguagaucagacugugaugguugcuguaauucggaguugggguacuguaaugggaacagagagaaugaaguuacugauuuuacuggcaggacuggggaaggcugaaggguugucauucuguuucugaguuaacugauccuguuagaucaugcaguuuuaaauugguucaaaauuuuaugacuacuuaguuuuccaacucuauaggugcugugugcaaucuauacaugugcauagacguuccugggcuauggaagauaaaaaaucauauuuuuagauuucaaaaguaaucuuuuuagagauauuaaaaauauagugcuuuuaaguuacucaaggggggaaacuauuugaauuuuuuugguaagaauacaauuuccuuuuuaauuuuucgagauugauuagauauucaaaaaguauacacauaauaauuagguuucuuuuuuuugguuccuauucuugaagauaugguuuccagaugagucccuuaaaguagaaagcugcuuacauuguaaacauuuuacauguuuuuuuaauagaauucuauaguuucauauauuucaaaggcacuaaucaugccuuguacccccuccuccuuguuuuuugagacagagucucacacuguugcccgagcuggagugcaguggugcgaucuuggcgcacugcaaccucugccucccagguucaagugauucuccugcuucagccucccaaguggcugggauuacagguucccgccaccaugccuggcuaauuuuuuguguuuuuaguaaagacgguauuucacuauguuggccaggcuggucucaaacuccugaccucaugauccaccugccuuggccucccaaaguguuggaauuacaggcgugagcaccgugccuggccuguccucuuuuuuaaaaaaaucacauagcauuuagcacagcaccagccugaaagaagguaaauguucacugaauuuuuauaaauuaauauuaaaauauggugauggucuggugcaguggcucacauuuguaaucccagcaguuugggaggcugaggcaggagaaucacuugaggccaggaguuugaaaccagccuggacaacauaaugagacccugucucuacaaaaaaaaaaaaagaaacaaauaaaacccaaaguagcugggugugcugguacgggccuguagcccugucuacucagggggcuaagcuggggggaucccuugagccuaggagcucaagguuacagugagccauuaucacaccacugcaugccagccugggcaugcagugacacccuaucucuauaauuuuuuuuuuaaaaaauaguaaaaauaaauauggugauauaaacauagggcccuuaacaauugguucccucuucaauauguauuccuucauguucagucuagucuugauguccuucacagcucaguguuuuuuuuuccuucuaaaauuuaacugugucaauuacuucacugcuuaaaacccuccucuguuuucucuuugcuugaaggauaaaguccaguuuuuugccuggcuuacugcccacuucaugauauaaucuggcccagcuuaaccucagacuucuccaggguucugcucccccuuugaagaguuagccauuucauuuuauacaauccaccccuaguugaaacacccuucuucuuuuuuuuucuuuuccaguuauaacacuuaucgcauuauucuguuuguugacuuugugucucuuuggaauuacguaaaggugggauuucugccuugauauauuuauauuauucgucuuuuuaauuaccagugccugacacauaguauaucaaaaaaugcuuguccaaugauuguguucuauccucagaguccugcaaaauuauuaugcucauuaaguguacaagaaucuuuucauaaaagguacuguuuauagucagauguuaaugaaacauuuauuauauuagauuuuaaguuguuuggaauauugcauauauaccaguuaauuuucuuuucuuuucuuuuucuuuuuuugagauggagucucacugcaaccucugccucccggguucaagugauucuccugccucagccucccgaguagcugggauuauaggcacgugccaccaugccuggcuaauuuuuguauuuuuguaguagagacgggguuucacuguccagacugcgccacugcacuccagccugggugacagagugagacuccaucucaaaacaacaaugacaacaacaaaaaccuugccaguuuuucuaaacauuggguacagcaaaacuagucauugaaauaaagaagcauagauugaggaauauauucuaagcaagaauaagugaguuauuuagcuauuuauaugaagauuugaacauagugguuuacaauuucuguuaaauacucuggauagcagucuuaauauuuuguguaauuaauacaguaucuccgagugaacauacgauuugcauuagagaaagaacacaaguuuaaaagagcaagcauauuaggcuuacuucaggcagaugauaaaguauuacauuugaacugugaaaaaguaaaaaauuaugaauuuuaucacaacacuuggccuuaaaugaaucaaaaucaacauaaauagaauaaaaaacuuuauacaugaaguuaugaggcauuucuuuaugcuuuauaaguuaugaagcauaaagaaauuuagauguggcaaauuuuccuuaaaguugccaucaauaaacuggaauuaccucuuggauaaggaacaagacaguuuuucgggagauuuugucuauggcaaacacauuuauagaacuucuaaagggaagcauuaauagugauguugcuugagcuuaucuucagcuggagaagcuaagcucuuugcucucaaaauauaugguccacauaauacuguacaaaauauuuggcacuaaaauaauguagcuuuccacuuaaauugccuuaaacaggaaauacuuuuaucuccuaucauaucaaaauauuuggcacuaaaauaauguagcuuuccacuuaaauuaccuuaaacaagacauacuuuuaucucauaucauaugcccuuuugacuacauagauacguaucuguuggaaacuauuucuagauuuucuaauauacgaaucuaagagacuuguagccuguuuaucuauagacguugaggucgacauuaaucugcuuuaaaaaauaagugaagagacacaccauguuucugcaugaaaagucuuaauauuauaaaaguuuuccauaauguuuuacuguuuauaacuugaauucucaguguguuauggccuugcauggucucuuccuuuuagaucuaucauuguuauagaacauagcgacagguuugcuggcuagacuuucuaaaacugacuuccaagugcuuuagaggacauugauuggauuugccccuuuuuauacaccuaggauagagcucuucuguuuuuucuauccuuaggcauuuacaagugacugggcauuuacaagugacugggcuauuaagguggguauuucaggagcagcuaauauugaaaggcauaguuaaugaaauguuucuagagaaaauugaacauaagcauugcucaagugaaaccuuuggaauuguuuuuagcauagagaugcuuauuugcuuuauuguuuuaucaguuauaaguuucuaggaguuacuaggaaauguaauuaacgguauaugaacaagagugauaugcuucaagagggaagcuugacuaggagaauucaacagguggaaguugucucuugaaagagcaguucaccauaucaauuauuggauauagcagaaugaggaaaagacguuuaugacauuggaaaauuguggugugaugggagaaccugaagauuuuauuuuugccauguuuguguagcuuuuugaguauuuucuuggccaagaauguuuuccucaauuguaagaauugcagaucuaaaggauuuuaaaaaacagauuuuuaguaauaucaggcaaaacucuguacucuuuugacagaccucugccagccaccagaaagaguuaaugcaucuucaaauaguucacagugaacagcagugacuucucacugggaaggucagggcacuuaacagcuugcucuguuuuauagaggaauuagcuacuacuggugaguuagcuguucucugagagucgguuauccacuggagagcugccaaacuuuuaaagacaucagcuacuucuuagugucccaaaucugaaaaacuguauaucgguguauuguagaggagcuggaaauagcuccauucucuaaaaaaaaaaaaaguuuauaaugagaauagcacuuaaaggaauuuaagggaauaauuuugcuacugcacugcugauacuguggacaacuaaaguauauuuaagaaaccuuuuuguuuuagaguaaguucagacuuauagaaacauugaaagaauaauacaaaaacucuuacucccuugacucacauguuacauucauuaacauuuuugcaaaauuugccuuauaauucucucacaauauaguucuccuuguuacuauaauuuuuuuuaacaacuuaaaaauaaguugcagacaugaugcuguccugcccccuuaaugcuucguuggauuuuuccugaaaucaaggacaccauuagauaaccaccgugcuaccauaaaaauugggaaauaaaugccaaucuguuguuaccauuuaauccacagaccccauucagauuucaccagugaucucaguaauaccccuuuaggccuaggaucuguaucgaauccauuuguuuauguuuaagucucucuuaaucuggaguuuuccuagucuuuucuacucucucauugccuugacauuuucaaagagcaccaguuauuuuugaacagggauuuuuaggauauuucucaguuuggguuuggcuaauguuuucuuauuguuagauauaaauuauguguuuugggaggaauaccacagaaguguguuccuaucagugcauuuuaccaggaggcaugagaugucaauaugucccauuacuggugauauuaacuuuuaucacuugauuaagauggugucuuccaaguuucucuaauguaagguuaauaaaauuuuuuuacuugucaauuaauaauaaggauucugugggggagaugcuuuuuaaucaaacauuuuacccauuaguguccauugaugauucuugcccaaauccauuauuacuaugaugguuguaaaauguuuuuuguuuuuuuuuuuuggagacagggucucacucugucacccaggcuggagugcaguggugcaaucauggcucuuugcagccucagccuccuugagcucaggugauccucccaccucagccuccugaguagcugggacuauaggcaugcaccaccacaccugguuaauuuuuguauuuuuuguagagaugggguuucaccauguuguccagguuagucuugaaccccugagcuuaaaugaucuggcugccuuggccucccaaagugcugggauuugggagugagccacuguacccagccugaaaugguaguuuuugauuccaccauuccuucuucaugaacuaguuggcauuuguguuaguccauuuucauacugcuaugaagaaauacccgagacuggguaauuuauaaagaaaaaaaguuugaauggacucacgguuccacauggcuggggaggccucauaaucauggcagaagggaagggaggagcaaaggcacauuuuacaugguggcaggcaggagagcaugugcaggggaagugcccuuuauaaaaccaucauaucuugugagacuuauucccuaucaugagaacagcaugggaaaaccugcugccaugauucaauuaccucccaugacacguggggauuaugggagcuacaauucaacaugagauuuggguggggacacagccaaaugauaucaccauuguauauaaaauagaacuuucuuuucuugucuguuuguuuauaucaguguggauucauggauuauuauuuuggguagugggcuauaaccaguuacugucauuauuucccagaguuugccaguggcaacucuuuuacacugacuucuguaucuucuucccauacccuaguuauucuuugagcacuuuuggcacaaaaauggauuucagacuuauuuuauacuuaccuagcuugucagucagccauuucuucaagaaacucccagauucuuuuaguggagaaugguauuuagaaacccacaccaggacacuugguauauucguugccacugggugucauagcuucuaggaucugucaguggacagauauaugaaauauauguauguuuaugcauacagauuuacuaccucuagaaacaacgugauguccuuguguuaaagauuguugcuugucuuagcauuucaauaucuaauauuuaaaguuuguaaagauuaaauuaaaaaccuuguuacaguuauuacugaaguuuuccuuucaaguuaucaugacugaaucauauauuucucuuacaaagauguuuuaauuaugucacuuauaucaaaguuuuuuuuuuuuagucguaauuauguauuuuuuuuuuuuugagacagaaucucccucugucucccaggcuggagugcaguggcgugaucuuggcucccuguucaagcgauuccugggauauuuuuucgcauucuguagguugucuguuuacuguugauaguuucuuugggaagcuuuuuaauuugccauucucuuuuauuuauaguaugaaucaauauaacaugguguaaaaugaguauuguguguauuagaauagaugaaucaaguacguuaggaaagggcugccucucuugcagguaauuauauaauggguuaaagagcauucauugccuuugucuuuuacaggugccugccacaacgcccagcuaauuuuuguauuuuuagcagagacaggguuuugccauguuggccaggccaaucucgaaugccuaaccucaggugacuugccugccuuggccucccaaagugcugggauuacagucaugagccaccguaccaggccuauaauuguguauguuuuaauugaacuuuuaaacuuuccucuucuuaguaugaaagcaacaguuuuuagaucugugaaacucucagaacuuuuuuguuuuacagauuuugaaauaugcaacuuauauucuuuuuauagguugagucuguguuauuaauauuucaucuuauauaaaaacauuuuuaguuaucugaagcuuuuuauuuauuucguuaacuuuuauuuucgguuuggggguacaugugaagguuuguuacauagguaaacacaugucacggggguuuguuguacauauuauuucaucacccagguauuaggcccagaauacaauaguuaucuuuucugccccucucccuccucccgcccuccacccucaaguaguuuccuucuuuguguuccuaaguucuuaucauuuagcucuuacuuauaagugagaacaugugguauuugguuuucuguuccuguguuaguuugcuaaagauaauagccuccagcaccacccauguucuggcaaauacaugaucuuguucuuuuuuauggcugcauaguauucuaugguauauauguuccgcacuuuuaaaauccagucugucauugaugggcauuuaaguugauuccaugucuuugcuauugugaauagugugccauggacauugccugcaugugucuuuguggcagaaugacuuauauuccucuggauauauacccaguagugggauugcugaguugaaugguaguucuacuuuuagcucuuugaggaauugcuguacugcuuuccacgaugguuaagccaguuuacucucccaccaacagugaauaaguauuuccuuuucucugcaaccucaccagcaucuguuauuuuuugacuuuuaguaauagccauucugacugaugagagaugguaucucacugugguuuugauuugcguuucucuaaugaucagugauauugagcuuuuuuucauaugcuuguuggccacauguaugucuuuugagaagugucuguucauguccuuugcccacuuuuuaaagggguuguuuuucccuuguaaauuuguuuaaguuucuuauagacacuggauguuagacuuuugucagaugcauaguuugcaaauauuuuuucgcauucauagguugucuguuuacuguugauaguuucuuugggaagcuuuuuaauuugccguucucuuuuauuuauaguaugaaucaauauaacaugguguaaaaugaguauuguguguauuagaauagaugaaucaaguacguuaggaaagggcugccucucuugcagguaauuauauaauggguuaaagagcauucauugccuuugucuuuuacacauaugcuucccuaucugucuauaauagggaaaagcaucuuguauuuucauuucuuaacaagggacaguagauuguuuuuauuuuauggcuuaugcucucuugucuugauacuuuggguagauauauuagggcaggaaucggaacagauuguacaaagaaucuaugagcccuuaaaaaaacacucuacuuccauacauacuuagugagugcuacauaguaaggcaguaugguuugaagaauguuuuggauaaauggacagggcagcuuccucuguuuuccaccaugugugagagaauaaggcugaggaaugccacuggcaccugagauggaucugaugaaugaguggcaguacgugggucaccauggcaugacagaaaaugacucaugcaugguaaauaugcaauauuuauugaauggcauggaauggugagugagaguugaggcaauaaguguaagugaaguaggguaggcucuuuuguauuguguauuuuuuuuuccuuucaguuauuugcucuaauccuuauuagaggcaccaugcaaagagcauaggcauugugacagacaggcaugauuuuuuuuuuuuuuuugagucagucucggucugucgcccaggcuagaguguaguggcaugaucuuggcuuacugcaagcucugccuuccggguucacgacauucuccagacaggcauuauuuuuaaugccaaugccacuucuugcuggcugcaugucuuuuacagccugagaaaucuucgaucucagcugacucauuuauaagaugaagaugauaauaccuaucuuauguaugguugugaggcuauagaaagugcaucagacacuugaaaauauuaguuccuuucuucuaugucuuuacuuguaaauaguuauuccguuuaaguauuaacuauacauucuaaauugcuuucugugugccauuucauuuuuaacuaacaguaguuauaaauucccacaccuccaggucaaacauugccuuuuuauauugcuggcagaauucugguucugcccucuuccuaguccccagugcuucucuccacccgacccaugauguuuuauuuauuugugugguuguugacauuccugcagugucauggacaucguuguuuugucugcuuagaaccacagugagcuacagaaaacugcugccucagaacauggaguuucaauggaccuuuuagucauagucucacgagguuccuggggccauagaacaucugggcaguuaauacauuuaucccuuggcugagaugcuugccccagggaugggccagaucaaguggagcuuuucccugaauauuucacacuagauaccauucucuccagucauggagcuggaaggcucuaguuugauuugucuguaaagccaacuccacacugccuacuucugguuacacaagaaaaaugagugcucuuuauuugcuuaagcuaguuugaauugggugucuguuacuuuucaccaaagaauggacuuggccuggaaucuuuauccacuuucucacuccaguugacuaaguuuuacugauuccuguagacucaguucaagcaaaucuaauucuucuaaaauguccauucuuaacccuuagacuggagugagacuacuccuuccuuuccugguuccucucaauauuucuuaauagguaacaagcuguuuuaaaauuuuaugugcacaaguccaugucuucuuucauauccuauuucuagaauauaaauuaucugaaucuuuaguaccaguacagauccugaaacauuauagauacucaguaaauguuaauucagugaaaaggcaaugauuugccuuuugaauuccaugcaaauaguuacuuaguaaagaucuuugguaagaagaaugcaauaugaaauucuuuuuauuacuuuucaucauuacaguuguuaccuaacucugauccuuagaccaacagaccaaagguugggauccuuagucccaacagaccaaaccaaaauggaguuacucaugcugaaguucccaggcaccaaguagaaauuaaguuguuuauccaaggaagauguucuuaucugaauuuuauagaugugaaaauaagcuuuugugugacaguuagguaucauacugaaggucaccugacagcuuuagcgacauaauugggauuagaacaggggauuaagaucauuuaggaaguuaaagaaaauaguacaaaagaguuuucuauaacccuagcacccauauacuugacagguuauggaaacuguuuucucaaaguucuucagaaugaaaauugcauggaaacaaagccaaaacucagguuguucauaaugauaauuugcauguauaauuacuagcuucuuuauaucaacuagcuaauuacaccaguuauaauuucuagauaaucuucuauaauugauuguuuaaaggaauuuaguacagcuguuguaaagcccauugaugccucauuucccuuuuauucucccugggacaccuccagaaauagcuuagcuuaagcuugccaggaguguucauuugcugggcaccccucaggaguugaguuugaguccagcuuauuuuaaccacaaagcuuugguucaccuugucuuucacugaaugguuaucagcaaggacauucugaguuacacuggcaagauuguggguggaguggcaugggaagguaaaugugagcagacacacucagggauggagcugcgcugaccauaugaaaaggaagggguggauggagagagagugaagugcuguaccggaggaacccuaauuacacaggauaaagccuuaagggagcaacuguucauaucuacacaaaucgauggggaaauaaaagaauggaagauucaaaacagaaacagccaucugcacauauaauaaacauuuggcaaguugugauuucuccaucugucccccgaugagccuggaguacuaagcugauguauagcaacgacgcuuaacaagaaaagcccuugagauguccucuucccuauuucugucaguuucucauucugcuuuauaaauuccgguagugugacccuuuggucauauuuggaaagaagauacagauauuaagaaacaaaagagauuuugaaguacgugcuuggguggggcacgaggggacaguguggacuguuuugaaaauggccuauuuagaauucacaaaaauaccauuuguuuaauuuuuaaagaaaugaaacaaugcuaaaugacucauuuuucagaguaaaagcugucagccuuuaaagcgauguauauuucacagugagaaaggaaugucuuccaacuaaaggcuguaauguuugucaucuaucaagauuauagaguaaauuuuauaaauuuccaguuacagaguauaucuucagugagauguagcuacagauauugugagaauauuucauguaaacucauauucucaacugucauguguauuugucauaauuuucuuuuucuguguucauugucugugugcaaugguagagcuuguucuguuuaacccuucucuggagauuuagagugaaauaccuuuaucuagucuugcucauucuauguggacuaacucuagcucuucuccuauuccagaugggugcuuuuuggaauacauuauuauguagauuacaaaauucagcuaaaaaucuauuuauucuguucaaguucugcagaugguucuaugcucugaaaguccuauggguucucagacuaagguuuuucuaaguuuuucuuugcauuucagugccuuaaagauuuuuucuuuuuugguccaauuuuucuccccuccaguuuucuccucuuuuuucuuccuaaauuuuuuccaauuucucucagguguuuuguuuuuucuuuucucccccaauacuuuuuuaaaagaguagugguucgaucuaaauaaauuuuaaaagcauuuuugggaucauuuuaauuaaaaccuuuuauuuuaucuugccaaauugauuuggaagaaaaauuuuaucaacuuuuuuuuaugacaacaauauaaaugccugggcaugaaaaucucagcaaauggcacugcauuugucaagcccugaaggcuuaaauguugcaaaucagaccaggagauccagaaagcucugggucaaccucaaaucacucugcuguacauacucauuccugaaguucuguuccauauuaagacuucgggcuuauucauugaacucugaaacuagauggacuuuucuuugugaugagaugaaaauauuuacuuucagugauggagauuaugaagagggggaauuuuacuuugccuuccauagguuguugauuuccauauugacuuauuuuuuagauuaggguaagacaauuaacuuucuuuccuuuguuaccagaaagauaugcuucauucuuuucuccaacacgugauuuuacgauuugaaaacauacauuuggugguuuuaauacuuaaaaagaaaacaccaaaaaaguuacucacagaaaacuaggauugccaccacuugcgacucuguguaaugauaaccuggguaugugguuugagaaauuugugguggucaggugauucggcaaaggcaguuuccacaguuaauucacucuuaccucuuaggaugcaggaguguauagggagggggccuacugucaucauuacugcucugaagguuggcuguguuccaucaaagaccaaagcugucauggcuggaaauaugggagccuaugaaaugugugaugaaagggguugcagcgaggguggcauucuccuauuuacuucacccucaaucugcccuguuuauguuugcggcaagccucuguccaagaaggcaaagacuuuugcaauguugcuucagaugaagagugauuccauuucaaaaugaucaagaggaacuaauccggggaacuggguugccaaaaaccauuuuggaagaaaauugcuccucaguuguuauauuuuuauuucuguuguguucagucaccugauucuguacauagagugauuuagauuaaaagagucuugauuuuauucauaagagcuaaaggaaauuauuauacauuaauuccugacuuguucauuuuucuggaaaaaucuaguauagauucacaccagcaaacguuauacugguuuuccauuacuguauuuaauccaaauaugacuaacaaaaguuuaaggguagagggugaaacaugcuggaaggauauguaaaaaacaugaacauugcccagguaaauuuucagguuuuuuuccuuuaaaaucuuauuugguaguucaccucagaccuuagcauagaauguuacaaaagcagaaauguguuugagaucuguuucaugacacgaagcauuuuacugucauguuugagcuuugcuuguuucaucccuucccucuacuccccccaaguccuccccaaaauaauaaacaaacccaacaguacugaagcacccccuuaaugaaggcugaauuuuguguccccuguugauuuuaauaccuguagagaaugccagauauucaauguuugcuuccuaauguuauuuuaaguacacaugcuugcuugcuuccugauguuauuuuaauuuuucuucccauuauagucuauuccuuucuuuggcccuuccuccuguugauaaauugucagaggaguauuucccaaaguauaucagaaauccaucauguauaguucacaaaaugaauucaugaaaaaguaauuuagcauuuucucuuuguucuuauaagcaacauaaaacaagaauauggaagugugggcuuucaagaguuuucacuuaaacagugaauaaagcacaguuauaaaugugugaaggaugcaaagaucagugacccagggauccuagcucuuacaggaucuugcaagucuagugaaagagaucaaugauuaugaauaauucgagcgugaguauuggggcaagugccgagggaggucuaaauacagaaggagccagcuucaagcuucaagcuggagcagcagaggugugagguucacuagcugcucugauggguuccaucuucuuuuuucuuuuucuauuuuaauauuuaauucaaaaauagagacagggucuuucuguguuggccaggcuggucuugaacuugagucuaggcuggacucaagugauccucccgcuuugaccucccacaggcugagauuacaggcauaagccacugcacccaucuugaaaguuccaucugaauaauauuguugauauauacagcagauacuuaaaaguuuauauuuugggccgaggcggguggaucacgaggucaggagaucgagaccacggugaaaccccgucucuacuaaaaauacaaaaaauuagucaggcgcggugaggggcgccuguagcuccagcuacucgggaggcugaggcaggagaauggugugaaccugggaggcggagcuugcagugagcgagaucgcgccacugcacuccagccugggagacagagugagacuccgucucaaaaaaaaaaaaaauguuuauauuuugaagguauucauuccuuuuuuguuuucuuuuucuucugagacagucucuugucgcccaggcuggaguaugauggcacaaucauagcugacugcagccuugaacucucaggcucaagcagucaucccaccucagccucccgaguagcugggacuacaggcaugcaccaccaugcccaucuauuuuuuuuuuuuuuuguauuuuuuccagacagggucuccccauguugccugggcugaucucaaacuccugggcuugagcaaucuaccugccucagccucccaaaguucugggauuacaggugugagccacugugccuggccaauauucauucuuucuacuucuguuuaaagcuuuuuguuuuggggaugcuuuuucuuucauuuaguuuuggacaugaauagucuguugugguuauuaagagacaagggauugcacaagauugcuuccaaaccuguguagguauuugcuccugcagguaagaaauugagccaguggcugaauaguuccugagucucauaccaguguugcuagggaauaaauucaaugcaaggugaguaagaacagguauuauuugauuuauauguguuuauccugaugugucuagaaucacagucuuugauauagccaauaacaaauaggguugaccuccucccauuuauuagccggauacauguuuucugugaagccacuuaguaauuucacuuaugguuauuuugauaaggggacuugaucugugacuuaaacauuaucaaaaaggauuuuuucccuuuucuacacauccuccccaacacuuguggucucuucucuuuuugguaauaggcuuccuaagaggagugaggugguaucucauuguauuuugcuuugcguuucuguaaugauuagugaagucaagcaucuuuucauaucccugucggccauuuuuaugucuucuuuggagaaaugucuauucaaguuuuucucccauuaaaaauuuuauuucaauugauaaguaaaaauuuuauacauuuaugguauaaaacaugauguuuugauacccauauacauuguagaaugguuaaaucaagccauuuaagauaugcauuaccucacauucuuaacuuuuuuguguggugagaaccuuuaaaaucuacucucucaaagacuucgaguauauaauauauuguuauuauuaacuauggucaccaugauguacaguaggugucuugaacauguuccuccuaucuaacugaaauuuuguguucugugacuaacaucuuaucagugccucuacacuccagccucugguaaccaccauuuuacucuguuucuaugaguuaauuuuuuuuagauuucacagauaagugagaucaugugguauuugucuuucugugccuggcuuauuucauuuaacaucacguucuccaaguucauccaugcuguugaaaauaauaggauuugcuucccaggcugaauagcauuccauuguguauguauaccacaguuuuuauauucauucaucuguugguggacacuuacauugauuucauaucuuggcuauugugaauaaugaugcaauggacaugauaguauagauaccuuuucaacauacugaugucauauccuuuagauauauacccaguagugggauugcuugaucauaugguaguucuauuuugaggaaccucuauacuguuuuccauuaugaccauacuaauuuacauccuggccaauagugugguucccuuuucaccacauccucaccaacacuuaacuugucaucuuuuuuuauaauaaccauuccaacaggugugaggcguugugguuuuaauuugaauuuuccugaugauuagugauguugaacauuuuuuucuuacaacuauugaccauuuguaugucuucucuugagaaauguuuguucagguccauugcccauuuuuaaauuguuuuuuuuuaaacuauugaauuguuccuuauauauuugggauauuaaccccuuaucagauauaugguuugcauacauauauuuucuccuuuuucauaguuugucucuucacucggguaauuuuguuugcugugcagaagcuuuuuaauuugauuacaucccauuugucuauuuuugcuuuuguugccugugccuuuggggucauacugaaaaaaaucacugcuuggaucaaugucauggagcuucugguaguuuuacaauuucagauuuuaugucuaagucuuuaauucgguuugaguugauuucuguauauggugcgagauaagggucuaacuuuauucuucugcauguggauauccaguuuucucggcaccauuuacugaagaggcuauccauucccauuauguguucuugacaccuuuguugaaaauuaacugaccauaagugugggaacuuauuucuggguucugucuuccauuccacuggccuauguguaugcuuuuaugcuaguaccaugcuauuuugauuacuauagcuuuguaggagauuuugaaaucagguagugugaugccuucagcuuuguucauuuugcucaagauugcuuuggucguucugggucuuuugugguuccacgugaaucuuaagauuuuuuuuuuacuucugugaaaaaugucauuggaauuuugaugggaauugcauugaaucuguagaucacuuuggauaguggaaacauuuaaacaauauuaucaaaaaugauuuaaaaaacaucaaaaaauacaauauuaauaaaagauuuugaauucauugaaugauugcuuucuuagagcaauucugcauucacaauuuuuucuuuuuuucuuuucuuucuuucuuuuuuuuuuuuuuuaagacaggguuuuacucuguuaccuaggcaggaaugcaguggcaugaucauagcucacugcaaccucaaacaccugggcucaagggaucuuccugccucagccuccugaguaacugggacuaccagcauacaccaucaugccuggcuaguuuuuugaauuuuuaaauuguuuuguagagauaaggucucacuguguugcccacacuggucuugcacuccuugugccuugaccuccccaagugcugggaugauaggcaugagcgugcgacucauaauuuuuucaaacugucaaaaauacacguaauauaacauuuaccaucuuaacuauuuuaaaguguacaguuuaguagugugaaguauguuuccauuguugugcagucuccagaacuucuuuucuugcaaaacugaaacucuguacccauuaaacaacuccccuuuguccacccaucccaucuguaauuuuuaaagauuacuuuuuauuaagagagaauaaaaccuguaauauaaaagcagagcaaagauccuaauaggaacuauauuaggaagagcugaaaauggagacuaaacagaaaaguagcugcagaguuacucuacaauggaaguuuuuauuuuagauucauagagaagucauucuucucuugcccuuaauaccuagaaucaguagaggaauuaaaaugucuggaauugauugaugucuucaccugcuuuggcuuuuuauugaaucucuucuaacuuuguuauuuaaucucccucuuuccuuuuacucccucucccccaguuuuaagggaaaacucucucucucuuuuucuuaaaauaaauuuuaauuucuuuagcaaggugcuggcccuaacaaaccaucuguuguuagaaacagugcuuucuuauaacuuuagugcuggaauaacugggugaaaaacacauuaucauacugcuuucuuuuggacauaaguuauauagcaaccuguuaagauauuuucugaaaacuuaccaguuggcuuuaaacagagaaaaaaaaaacacuuacauacauagagauuuugaacuauauaaauuaaaaauuaaugcagauauaugaaaacugucauaacuuucuauggagggcucuauuuagaccuaauuugugauaacuuugggcuaauguuucuaguuuccaauuuugagaguguuguugcuuuuggaaacuuuucccuuaagauuaacucugguaucgcaucauuaaaauauguuuucucugucagcugugucauuuagccuaacuaguagcgaaugcaauucuaaaauuggccucauuuaugaaguuuaauuugaauaaaaacuguaaguucaauuaaaauaauuggucaaccgaugguggcuugacauacaaacucauggaaagcuagggcaaaaauccauuuuuaaaaaccgagaguagcugaauacuugauugaauucucuguuuugcuuguauagacaaauuaucaaguuaaagauaaucccaaauauucugugacauuuagaaguacauugaggaauauuauuucccccucacuccucaguuuuacuaggaaaaagguuucauugauauuaucuuuaauauaaaugcccagagaauauccuuuccauagucuuacuggcacuaucauaaaagugaauucaauaaacaaguaacaaaaauacagcaguuuuuaacaagauagauuuaaauauuguaaagaauugaaguucgaaaggauuuucuuugauaacaaaagauuucuagcagaaauucucaauauuuuaaaaugaauuuccaguuauuucuaugacucaaaauuaauuuuccauuugcauaguuaacgacuuuuugcuugauaccagaguaauguguuuuucaaaggauuuuaugauggagauaaaugaacuuguaucugagcuguguguuauaguuucucauuuccauuacaagaaagaaaugacugucugauuucauccugcaguggcuuccuaaauucaggccugaauuauuuugauuuuuuuuuuucacagccaguuucuuaacacuguauuuuucuggucaaaaugacaaggaacuccaugagacugaggggcagaugaacucaucuuugcucaguauuuugcaaucugggucagcauuauuagccucuuggaauaagguuuguguauagcacaauaggugacauuuaaaacaguauuuaagaccagguguugguggcucacaccuguaaucucggcacuuugggaggccaaggugggaggaucacuugaucccaggaguuagagaccagccugggcaaucccaccucuaguugaaaaaacaaacuccaguauuuaauacccgaaaugugcauuugagugcacaaucuuuguacaccauguauggggaggaaauggauuuguggaacauuugaugaaauaagggauugcuucaucucaguaucagugauuaagucacaauaauuaacuuuaaagucaguauuuuuuauagauuuggaauaugauugucuuuuguuaagaaaguugucacuuuuaaaguacuucguuauuuuuaauauuaaaggaaaugagguacauuuguaauccaaaaauuauuuucuuauaaacauaauagagaaguucucuuugcccagucuaugauaugccgcuucauuucagguuuuucucccaagacucuacacacaaccaauagaguaucauuagugcuccuuugaaguauaauuguucuuagcaaaaauaauuauucuggaguucuuguuacagaacauuuuguaacaggaaagcauguauaaauauacuccaaagaauuacuuaguaacaguuucccagcaaauaaaaaauuacuaaggagucucucccaucagggguugcaaaggugagugugaccuaaugccugucuucaaagauuuugugaacuccccagcugaguucacaaaguccccaugcaguuagggaguuagggggauuguaaaugggauaggagaggcugaagccaaguucaguggugccuccaaggauggagagauuguacguggccaaaggguccaaaaaggcuuugugaggacgauggucacuguucugaggcaucaucugcacacagugagugagaaguaccucagauaccugagcaguggggaugccacccugcuguuccccuauuuaucauuucuccaaaagaaacuaggaaagcaaauguagauuuuauuagugcuucauuauagauaagugaauagaauuuucuuugauaaguaaucuaaauuuuaagcaaagagugauguuuuuauucgucucugcuuuugacuuuccaguguugggcucuugagaaccaggggguaaaucugccuaaauaauucccccuuuuauaacugcuuggucuuuucuguucacucaagguccguuuucugaaggccucguucagcucuuguagaggguauauuucuucucuagauuuuguucacccuuucccccugaaugauuuccugcuuuaauauuuucuuggacugcuuguucucuuccuguccccauugcaucugcguaccccacuacauuugguguaacuuauuaaauuauuguugcguagaauuuacaaggaucucaggaagcauaauugugugggguuauuugaaaaucacuguuauuucugauuauguuccagaaagcuuuacuagagaucuaauuaggucuccugauuaucuucuucaaaguagaaauaucugcauuccacguugcuugaagcaguuguaaauuucgugcuuauuugccucaccaaaucgccacuugaggcccaaguaguuucacacuauagaaggaaguuuauacacguagauuuguugauuacugacuguuguagcacucuaaaaagaaauucaaaccuuugaaaaucuaaaaauuaugcugacuuguauuuaugauuuacaugcuauacauucacuuuuuuuuuguaacuauuuuuguggcucucugaauugcagaggccauguagguagaaggcuagcuauagcuagugagcauucauugcaacuuuucuuggaccaauugucucucagauaagagauguccuuuguccauuccuauugccacugcucugcccagcacaagucccccaccccuucuggaagauggcagcaucuaacuucuuacuauagccacugaggaguuuccuggauccaggcucuccaaucuucuuuggccuauucugucucugccaaaaugugguacuugcccuucuucugauauguuccucccucuccucuuccuuuguguuuguucacgcaguguucuucucauuucugcccagugacauccugcucuuccuuuaaaaucuagcuccagugccgcuuccugcgcgaggacuucugauccuuccagaaacuuuuuuugcuaguagcacaccguucuuccagugcuugucauauuuggcauucuacugugguuauuugugcacguccuaucaccccugaugagagacaccauaucauauaaucuauuuuuauauucucauagcauguaguguggaaucaggcacaugguaagcacucagcgaagauuuuuugauuuaauacaauuugugaguuccacauauguaccagauggaggugacugggagaccacaguuaaugugugaugcccacuucagccucccucuguggaagaauguaaauuguuauaaaccuuuacacuacugugugguucucauucauuuccugcuguaauuucagaaauauaucuauuagaagaguuagaagaguauuuaucccccuuuaacaugauuuuugauaauauauuuuauacaacuucgagguaugccucaucagaacucacauauuugccuucuauauuuucuuaaagcugguaauagacuauaaaaacuaaaaaguugguaaaaaucugcaauccuuacuagauacauacauuguuagacagaaauccaaggaauagggugaaaauguugcauaaaacuucaacagcuccuuuuuccuccuccagcacuggaaugagaagaggcagaacgguagagaggccaaaugauugcuuaaagacaccucuuagauugcaacagagcuugaccagcaaaauaaccuccagcaaaacuuucuuaagcaguuaucugaggcaauuguaaaaauugguugguuacagcaaaguggcuaaagucacauuugaauuacuguaaaaguacccugaguuauauaaucuccauuuguguguguguguguguguuugugugugugaaagagagagaaaguaaaacaauuaauaguuacacaaaacaaacguuuagaucaguggucccaacccuuuuggaguuauggcacccaagaggucccacaugugguuuuuggucccuuggauaguggcugcuccuauuuugccccagucuucaauccaccuuuagcacaaccagaacugcugcuaugauaguaacaggguauauguguguuuauuuugcggagguugcagcagagaguagggagugaauaaaaauuguaauucaaacauagcacuuggaguuguuagaauaucugugauuccaaaaauugagaaaaagaaaaccauugaaauaaaguguuuagcagagcuggcccuucugagaaauuauuagcaauugcuuauguaaggcugugucuucaagcugccuguauuuuucaccuuaacacugcuugaaauauuguuaauuaaauauuuauguagauaacaaguguucuauuuuaagaacacagaccucuuuggaaaacuuaaggggaccucucagaguaacuaacaagaagcuuuggccuaauagcuaaauguaugcccuucauuguuuaggaucuuuuguuugcuagaaauucucuuuucccccuuuuucagcuggaaaauuccuacuuaucuuuuagggcccagcucaaaugccgcaugcccuguguaacugucccagauccaucuccugucuggcaggaaaaguaauuaucccuccaucuggauucucauuuaaacaggucuuuucacacauucgauuacaauuuuucuuuauauucuuauuucccaauagaaagaauaaauaccauggcauacucaaugcuauaucgguggggcuuaguaacaccugcuggcugaguuaaaaaauuuuggcaauuagauuaccuuaauuuuaaaugaaucacacuaggugauuuucaagucaguccuugccaaaucuaacauuuuaugaucucaggagaaaugcuuacauuuuagucauugacaauuaugauaaaauaauaauaaaauaauaacaaguauaguuagcauauccagauaguuuauuauauuucacauacugggauuuauacucacuuccauuuaauuuuaauaacaacccuaugguggugguaguaucauuaccacguugacaaauguggaagauuaugugacuuacucaagauugcauaacuaguaauuggcacgaugugaacauaggacugucagauuuccaagcuuaucuguucaucaguagaguugaaacuaaaagguaaaaagccaggcagccaccugaggcauuuauuuauaaggguugcuaacacaugaaucacuggaauaagaauaauacuacuaguuaaaauagguuuccauaucuuaauucuucaugucugaaaacaaaacaaaacacacuugauuccuuaaaggaggccacauccuuucaugcgugccccuccuccucugccuggucuguaugugccccuguucuccaugaugaagguccuuaauuaaaccuauccugauccccuaugcuaaaaacuagaaggagccuucuauucugagcccaggcaauuuuuuuuucauuuuuaugacucuuauuuucuaucugguauuauaauuucagcaggugauaagaugaaauccaguuugagcugagguccuaugugcccaccacucucagacuccaaagggcaguguuacuccucccagguagcacuuacccggggcagguggugcaggacacagguuugaggaugccggcucagcacacaccuucagccugcacaugaggcuggaaggagauuugggaaguagaaggaggugacgugucuagggcaaguggcaguugugcugugagccccauuucagcgagggggcagcaaguagagccuggcaugugggcccuggcucuugggggacaggguguggugugugagucaugccaguggcagagaacagaagacgaugggugggaaguagcugcuuuuccugcuaacaguggaccagagauauuggguggaauugugagugaccauccggagcaggugcuuuugggcaugucaaggaggguccaccuaugagcagagcaagcagcuuugagcaucugcacaguaaaccaacaaagauacuugcagggcaguuugaccuucccugcccucuuuucuccuccaggggucagaagaaacugcuagucagccaguaggaucuagguuugggcaagugaagagaggaagcccacccugcccuugugccucacagcugccugagccaguggagggugacacuuucccuuugaauggagcccauaguuugguuauuacauagacuggguauuuaccgaaugaagacuauuuuagggacuuuuuauuauccacaaccuggcaccuaaccacggugacugucucagauuuaauccagggcuggcauaagauguagccugaucaaauagguuuccagggugcuugugcaggaaaaguugcuuugugccuuuugaguauugcuuguauguugcucuuuccguaugccugggucgucuuugucuuuuccugcacuugaggcucugugaauacugcagcuuggaaaugagagggggcugaugucucagcugucagcacuuaguuaucuuuguaaaucauacagagcugagcacucaguuguucaauacauauuuguugaauaaacgguuugcaaaauuaggccaaauauaauuuucauuaaaaauuuuugagaaguacggagauuacuuuuuuaaggaaacuuuaauuucagaguaguaauuuuagacuuacagagaggcuauaaagauacugcagaguucccauacacugcaugccuaguuucccuucuuguugacaugacuugaguauauuugucacuacuagugaaccaguguugcuuuuuauuuauacaaauuauucuucuuacagcauaaaauaauaaaggaaagaaugccacaauauuugucucagaauagcuauuuugauuuccagauugagguuuuguacaauuugcuaaacuuuguuaugcauuugcuuuguacaaguaaugugcuuccuaauuucaguuacaaaucaaaguguauugcacaauuccuagugagucagauugcuaaguucugugacccuugaauuucauaaaguagcuaugcuuuucuuuaaaauggccaaggaggaaacuugauauuuauguggacuguugucuucagucugugauggaguacuuuauguuguugccagaaauaacaugaauuuaacaguuaagaucauuuuugguaccagugguuuuguacaaaaccauaaaauauaacaagaugaucaagcaaaacucuuucaucuaagaaguuuucccuuaaauacagcucacccuuuaugucuccgauuucaagaaauuuuguggccuuccucacagaauaauuauaaaggaaaagucaguuaauguaagaaaaaugcuuaaaaagccacaagacucuaaauaaauuaaagcaacagaaucaguuuggauuagugugauauauaguuugucacuacuugcgagaagcacauuugguggucuguuauuuaauauguguucccaaguagaguguaaauuauuaaagugaacaaugcugagauugaaguacucucagaugguuuaaugccuaugugaagauggcuugauaaacuuguuuuuguauucgacuuacucaucuguacuggaaaugucaucaauccaauauuuuucucaugucacccauucucugcaguauuguaaucacugggacuuuauagcuuaacagccaccagcacuggugaaugucuacaacuggaugucuucugucaguccuaauucaguaugucuaaaaccaauucuucuuuuaaagucuuaaguauuucucuugaaaucccaauuucaauuuaugguaauaaaucagugaccuauccucacaccucauacuuuacuuuuuuuuuuuuuuuugugagauggagucuugcucugucacccaggcuggagcgcaguggcaugaucucggcucaccgaaaccuccaccuccuggguucaagcgauucucuugccucagccucccaaguagcugggauuacaggcaugugccaccaggccuggcuaauuuuuguguuuuuaguagagaugggguuuuaccauguuggccaagcuugucucaaacuccugaccucaggugauccgcccgccucagccuccuaaagugcugggauuacaggcaugagccacuaggccuggcccauacuuucgauuugcuuucuuuccaucccauuucagucuucacauuguugacuuugaauggccuuucuaugaauuuuuuccuauucacuucuaaaucccuauuuuaaggaucaccucauaucuggauuauugacauagcauucugacugguucuacccugcucuauuuucucuucccccaaaauacacacacaugcauauacacacagaccacacccacacagaccacaccuacacaccauccugcauacccuuucuucucccaacauaaacacacacaaacaccaacauccccccauauucuuccuccauauaauacacacaugcacauacacacuucauuaauugaucuaguugauggucacauuaauuguccuaaaauacuuccccucauuucagcuuacuaaaaacuuuucguggguagcuccucaugcuuaugggauguggucuggacuucucagucugacuuuguaggcaguucaccuuucaguucacuuuguugagaauucuuccucugcuaugcccuuggcuuucuguaugcaggaggagauuuaugugcuuguuaucaagacuuucuacagagugaccuggccuuuguuuaaccaagucagcuguuuuaguggugucaucuagaacucauuggagauuguucaguggccuaggccuaccacccucccucugacaugucacugacaugacaugacacugagaaugaacucaaccaugggaaugcggauguaguauugcagugccauaaagggacaaaauacuucuaauugcuaaugggauugcuugaucacuguacaucacuccaaacacaagcaucacaggaggcauaugaaguugaagagacaauuguuuuuuuccacccuaagcacaaucucuugugggacccuucuugacaucauggaaccccaaucaagaaacccugcucuagaagaagagaaggagaaccauguuugguuuuaguuauuugagauccuguagagaaccaccgaagagaggggcuccagaaaugcaaacaccugugguuaaaagcuaggguacugugaaucaguuuuuauacacugaggaagcuacaggucauauaacuggaaucuugacaguguaauacaaaguguuucccgccgugaugcuuagugacagaaagaacucuauccuuuuaagacuaacagucuggccucuuuguucuugaaauuccauaucugcaggugugguccuagguuuaucagggguauccaaugucuuuuggcuuugcugggccacauuggaagaagaauugucuugggccacacauaaaauacacaaacaauaaggauagcugauaagcuaaaaaaaaucacaaaaaaaucuuauaauguuuuaagaaaguuuacaaauuuggccgggugcgguggcucacgccuguaaucccagcacuuugggagaccgaggcaggcagaucacaaggucaagagaucgagaccacccuggccaacauggugaaacccugucuuuacuaaaaauacaaaaauuagccaggcgugguggugcgcaccuguagucccagcuacucgggaggcugaggcaagagaauugcuugaacccgggagacggagguugcagugagccgagauuguguugcacuccagccugggcaacagagggagacuccgucucaaaaaaaaaaaauuaguuuuuggcuguucaguguuucugaguggucaccuuugaccuucugugaucuuccuccccuuuaugugcuccgauggcaccaucugcuucucucuuuguggcauuuaucacacuguacuguacuugcccauuuucuugucuguuucccccacuggaagguaagcugugugguugcaagggaccauuccugucuggcucaucuuuuuccugccuggcacagugucugucagguuuuaggucacagaauaaacauuuguugagggaauuaacucgguaaauaugucucuuacuggagaauuaugauguugccuaaaugugguuuaugacaacuaacuucucugcaacaauaaauugaaaauuggcguuguuaauagauugggaauuaauccugaaacuuccauuauauguuaaaauaaacuuccaaauuuaguaucuuuuuuucugguaauaaccugggaagaccuaaugacuucauuuccuuuuuguuuguuugaaauuguggaaucaauuuaguuuauuuggcccuuugacuuuauuuagaggugacgguaaaaagguauuuuagcugggcaugguggcucacaccuguaaucccagcacuuucgaaggcugaagugggaggauugcuugagcccaggaguuugagaccagccuugcaacauagugagaccuugucuucauuaaaaauaaaaaauaaaaaaaauaaccgugugugugugcaugcguguguguaagcaugugccugugaucccagcuacucaggaaccugaggugggaggaucacuggagcccaagaggucaaggcuacagugggccaugauugcaccacugcacuccagccuggaugauagaggagacucugucucaaaagaaaaacaaacaaacaaaaaaaaccccacgucuuuuaggccaucugugcauuuagaagccauaaagggguuacuuaccuaacuuaaacuggauuaucauucagauguguguuuugugugaggggaagcaaaauuagggugaauugggaggguauagcccaaacuucuacagcccucacaaaauuucaagcucucuuauucauuauaauuuacaggauucucuucuucucccagacaugcgaacacugcugucccuaggccuaccccccaacuuguuugaauugccugguuauuauuuguaguaguuagacuagugacauuucaguaagugaaucuuauuaaacugacugauucauccuuagccuuaugaaaauuuaugggauuaacuaaaguuaauauugcaaauggaagcagugcuuuuugaaccccaagugucuucagaagcucuguaaacauccgugggcugggcaugguggcucacuccuguaaucccagcacuuugggaggccgaggcggguggaucaccugaggccaggaguucgagaccagccuggccaacacggugaaacccugucucuaccaaaaagaaaaaaaaaaaaaauaaaaaauuagccagauauggugaugugcuuguagucccagcuacuugggaggcugaggcaggagaaucucuugaacccaggaggcagagguugcagugagccgagaucacaccacggcacuccaaccuggaugaccgagcgagacucugucucaaaaaaaagaggcucugugugcaucccguaguugcuuaacucuauaaauuggggcugucacuacagcuucauagaaccauuucaguauuauuuuuugaaacacuuuaaccaaauggcccuuggcauugaagcauuuuaggaaauguccuuuacuccaaauguuuguggguuugagaggaauccuaaaagcccaugaggcagacauaauaauaguauuaaugagauuuuacguuaagcccuccuguuucauacuaagugguaacuaguucuauuucaucacauuauaucauaagguggggaagauuuuauuauguauuucauuuaacucucaucaguauuagaauuugaguuauugucauauuuuccaugugcuugccuucuaaggucaguaaaacaaaggagcgguuguggagaagagcguuuaaaccauuuguuggaaaauauauggcguaacguuuggguucuuucggcuuuuuuaucucuguggccugauaagcuuuagccacguggauucauggucuaugugaaaugucuuacauuuuauauuaguuaaaauauuuuaugucugcacuuagaauuuuuuuuuuuuuuuuuuuuuuuuuuuuuuugagacggagucucgcucugucgcccaggcuggagugcaguggcgcgaucucggcucacugcaagcuccgccucccggguucacgccauucuccugccucagccucccgaguagcugggacuacaggugcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccuccccuucgguauuucuaaaguaguuauuuuuuacuuuuaauguccacgugguauuucugaaaaacagacagguguuuaauuucuugauaaccaaauauagaccugcacaucauguaguguggugugcccugacccaacuucuucagcaaauacagcacguguggaguuuauuuauaguuugaccucuagucuucauuggcuuguaguuuauuuggggcauaauucauuagcgugacgggcugugguauuuaagggucagcucugaggagaaggagauagaagaagaagcacuguucuggcguuugugcgcugcugugcuguguccgcaccuggauuacuguguguguggagaugggcuuggguuaggcagaccauagcagacgguagacugacagcauaggaaccuuuggaaugaaaagggggauggcuguaauauaggaaagcuuuuaaagaggacgugaugugaauauaucaaacauaguaauuauagguaccauuuauugagugauuaucaugagcauacaccguuauuuacguacauuagcuuauuuaaaccucacaacaauacucugagagugcuguuauuuuguuuauacaaggcaggcaacugaguuuuaagguaaguggcaaauuugguuaagauaaacaaauuuggugaacaaauuuaaaaaucugaaagcuggggaaauccuuuacaacaucugucaagugggucagaauauuugaaagaaauuuuggauucgaauucauuuccuccagagaugauauagcagggcaaguauaaauuaacacuaguaucuuaacauccuaagauuagaagggaccuuuauagcuaucuagcaaaggguucgcuaaauuuauuaauugaaauuacauacaugucuaaagagaagcugggauugcagagaacauuuauugccuccuugaaagccuuuguugacagcagaauauaaauucauuaaagagauuuguguuuuuguuccuuaaaauuauauuuaagauuccguguauuuuacugugaaguuucaccaagggucaaucugcaucaaacuguggaaugaacuaaacuaauuugcagaacuuccagagaaacccaauacuuuaaauuuaucuguuagccaggguauuuugaagagggggggaaccuuuaaugugaauaaaucuacauugggaaggaauggaauguuugauuugaaaugggcuacugaaauggaagaacagauuaaucgugaacccagccauuacuuuccuauuucuaaauugagucaguugaaauaucugggagggagugagcauacaguauuuaaaaugaauauaaauuuaaaauuagaaaagguuuuguuguagaaaauauuuuaaaacaaauugagcaaaaaggaaaaauuugccaauuaccagccauuacugugauacaaacauuguugagauucugguauauacauuucuagccuuuuuaaaaacccacauauaugauaucauugugugaagacuuacguauauauucauauuauaaguuuaaacaaaagguuucuugaaggcaagacugguaacugaccaauaacucuuuaugaaaaacuauguauguauguaugugagugugugugugugugugcguguguguauauauauaugcacacaaucauauaucagagggaacuuguaaguuugcaaucauauaucagagggaacuuguaaacagaacauguacagaauuuuuacaacuuaauaauaaagauaauccaauuaaagaaugggcaaaguauuugaaugguuauuuuuccaaagaagguauucagauggucaauaagcacauuaaaaaugcucaacaucauucgucauuagagaagugaaaaucaaaaucauaaugagauacuacuucacgcccaccagaacagcuauaauaaaaaugacugauaauaacaaguguugaugagaaaguggaugaauuggaauccucauacacuguuggugggaauguaaaaugguacagccacuuugguaaaugucucgcaguucuuugaaagguuaaacauagaguuaccaguuaacucagcaguucgacucccaguuaucuacccaagagaaaugaaaacguaacucucuacaaaaacucauacaugacacuauuugguugaugguuacacuagaggccuggacuucaccauuauaugauacauacauauaucaaaacagcauuaauacccccuagauuuauaccaaaaauaacccucguaugugaauuuucauugcagcauuauucguaauagccaaaaaauggaaacaacccaaauguccauccgugaugaauggauaaacaaaauguuucauauccauaugauggaauuuuaccuggcaauaaaaaggaaugaagcacugauacaugccacaacauuaugaaccccaaaaaaugcuuaaaugaaagaggccagucacagaagaccacauauuaauaugacaucauuuauauaaaauguccagaauaguuaaaucuauacauagagaaauuaaaucaguguuugggggaaggggguaagguccagauauggaggugcgauuggugacggguacaggguucuuucuggggugcugaaaaugauggugauggucacacaacuuuguaaauaugcuaaaaagcagugaccguaugcuuugaaaaggugaaucuaugguauguaaauuauauauuaauaaagcuguuaaaaauaugguagcuuauuuucugagauuucccggcucguuccccauuucuguuuuauguguaccaucucuuuucuuuuuuuuuucuauuuucucucuccugaucaagccguuucuugucggugugaguuccugucuuagaugugaguccuggagugucaguuuccagaguuuauacccuuagacuuugcugugggcacuucuacucacuaacugggauagagaaaaacuugugguuucagcugcugugcucccaugggcaggccaugauugacaaugaguaccuguuggcugccuuguagaucuguucucuggccugucagucacccggcugcuucccuuugcauccuuccucagagaugccgagauucugcaagucuuguauguaguuuguaccaaagccacuuuuauuuuuggauucaagaggauacuuucucaccuaauuuuguuguaaauguuguccauggguuuugguuuugauaucaguuguucuguuuuuguguggagauuugggaaaaucaaacaauuuugcuuccauugcuguggccaucuuccuagaauucagaaguguaaucuuuccggcuguuugaggaagagauuuggagggaauugaucugacaaaaacagaagauauuguccuggagauuuuaauguccuugaaagaacucuuggucuauuagucuauuuaaaucuguuuaaacucagaaccuggcauuaguaaacacucagauaaauauucuuggaaugcuguugaguuuguugaacguagaugugcaggagaugaauggcuaccugaaugaggugggcuagaauuuagagcugguacccacuuaccaguauggucauugagggggcuggaugaauaguuucuccuccuuaugcaugcagaucggaaacacuucugaagcuuuggucagcuugucucacaugccucaguuuaucacgaaugccugaaaugauacauaacuaucauguuaaguuucggucucacuaggguaugaauacuaggguguugaucagaaugaugcagauccuacaugcaucugaaugagugugcuagagacccuuaauuaauccuuaggugcugggucuguuuuccaaguccaaggcuuuggauuccguuuuuguacauuaaacuaccauaaacccugcuuguggguaaccaaagcacauguagugguuuaaucaugcaggaccuuuccaauuugguauggagggaacugccugaucuuuccugagcucucuuuucucuaauaaucacuuuuguuuauucuacucuuacaugaaucguaaaauguuaguaaauagaacuauauauguuauagagaugaauucccuaaaggcccccucgaugacaacacugugaugugugcuccauccuucucgauccucuuauccucaccaacacuuagcgucagagguuucauuugcuuggugcucuguuuugcaacauguccuuggagaaaagguugcugagguugaaaugaaggacaaaaccaugcaaugugccgucuguugaagacagcauauucuuuuguguuuuaacaaaggccugcaaugcuuuaauuagaagaaguugaauuggguggcaauuuaaguaccuuggacauuuuucaaaucugggugaugcccagugaucuugguuuuaaguaaaguacguaaauaauagaauuauaaggaauccaguguuuacuuucugaguagcagugaagaggcuaaguguuuuccuucuggguuggcuucucagauguguuucucaauaaauucucuagagauaugugugucaagucagcuuguuaaaaaacaaagaaacaugaaggcauguagcccucacaguuggaugcuuuuaaacacugcagcuguuugaaaggccggagcgaacgaauucaauuaugacugagaaaccuaucaucucucccuguuagugcuugucaugaacauccuucucaaaauaaugguagcccagggaagagaguugugcaaggaauauagacagcuucaguuaacuucaauuuaaaaaggaacaaaagacaaaaaauaaaaugacacuuaauucuuaaaagauaagugaaggauuauaaucuugguucaccaugcuagaaguuuacucaaacuuccauuuuuuugggucuacucuuugaaacugugcuuuauuuuguacauagugguuaauuuaacucuuuaaacaaaugaguucuuggcuuaaagcuuuucugcauuauuauuuacaaccuuuuuuugguaauaaaagaugaucaugguaaaguuuaugcaauagaaaaauauaaaaaguuaaaacaaaaagaaaaauaacuucccuuucaauuuuucauccuuucaggaaguuauagauugaugcauacccuagacuuuaaaaauucauaugaccaggcgcaguggcucacgccuguaaucuuagcacuuugggaggccaaggcgggcauauugccugaacucaggaguucgagaccagccugggcaacauggugaaaccuugucucuacuaaaauacaaaagaaauuagcuggguauggcagcgugcaccuguagucccagcuacucgggaggcugaggcaggagaauugcuugaacccgggaggcggagguugcagugagccgagauugcaccacugcacuccagccgggugacagagcgagacuccaucucuccaaaaaaaaaaaaaaaagcauauauacauguauauauacacacagacguaccuauaauuuguugugauguaugaauugcauuuuuuugcaaaaauuauauguuuacuauucugcgacaugguuuguuucaccuaacaggucauagucuucucuccauauagcugagaucuggugagcuguauucucccuuuuugugucaguaaggguauuacauacauaaugacccauacauaagaaagaugucaggggaaacugcaacccuacccaaauaguuuguccuucucaaccccuggcccacauagaugugcaguaccuaaaagucauuuaacagcugucaaaucaauugcacggcugcuggugucauagaggauaagcagcagcuggugggcaaguguaaccauccccauuucucugcauggguggaggggggacagcagcagauggacauaguucuacucuuguucaauuuuuaacuguaacuuaagggcuuuccuuuagguguuuaauuuuaaaguaauaaaaagugauuuuagugaaauacuuaaaaaaagauuuagauaaguuagaagaaaagaauuauccguagucccucgcuacccaaauauaauuauuguuagcauucugugauacuucuuuuuguucaugccuuuucuugaaucuguuguuagaaauggcacuuuacaucuguggucuuccucccuaaaacccaucacucagucuaaucaugagaaaaacaucagauaaauccugacuaagaaacuuuuaaaaaaaaugccucuugagaaccccucaaaacugucacagucauuaaaaacaaugaacgucugagaaacugucacagccaagaggagcuuagggagacauaugacuaaauguaauguguuguccuagaugggauucugaaacagaaaaaggacauuuggguguccauacugaagagggauguuaacaauagaagaaacugggugugauuuauaaggaaacuuuuucaacuaucuucaccuuuucuguaaaucuaaaacuauucugaaauaaggucaaauacaucuuuuaaaaaguacuacaauaauacuauguaugcaguuuugaacucugcuuuuucuuacugcgccaucuuuuuaaaaaaucuagugauuguucacuauuucucagaaugaauaugcuuugauucacguaacuauugccuuugcuggggagauguguguguguguguguguguguguauguauauauauccccccuacaaaagccuauucuaauuuacaguuacaccaccuauauauauaaauaccugauuuccuugaacuuucucuagcauuguguauaaucuuuuauaucauaaucuuucccaaaacuaguaucuugauuuaaucuguauuucuuuaaugaaguucacauguaagcauuucuccauuagguuuauuuuacugcuucucuuaagaagucucuguucacauuaauugucccacuugagccuguguuuuucuugugaguuuucuugagcuguuuaaauaguaaacacaaaacuuuuaauaguaagcacaaacagagaugggaaauuggacuuaauaaguauucuuuuguaaugauccuguagaaugcaacuaggaagaggaaaaauuauaauuuauuaagauaaaaacuaauguaauugaaauucauaucaaaagaaaauacagaaugauaguaaggaguagcucauuuucuuuguauuugcuuuauuuuggagcagcauguguauuuuggaaauguugggguuguuuaacaaaauuguuuauacuuccugcguuuauuuuuuaagguauuugcuagaucaaaaauaauacauuuuguaacuaccuguuaacauacaagaauaucucaaaacauuuagaauguaauuucuuuaagcaauaugaauagagccuacaauuaaaauauuuuguuuaguaauaaugaaaaacuaguuguuagcaagugauuuuguugcuagcugcgaaacuagaacuaauaauuaucuuaauccuuucuccccugcaaaaaccccacacacuuuuccccuaaaaauaaagaaagucauguugugaaguagaggauccgguggaauuaaaaaugcauugacccaggaucuccugguaccuggccauggacaggaguaggucuuuauccaugggugaaaggcaguucagucugcugguuugguuuauuuuagcccugcaugccugaaacagacucuugagagaggggcccaggagcacgggggcugcauguucuuuccccaugacugcaaaugccagagauacugugaaacuggacuguggaacucauuaacccgggccugauggcuggcaggcuucacagcuuccucugauuuugacaggggauggaagauguucagacaccuuguguauguaacuuaaucuccuugugagcucuauuuuugcuuuuugugcuuaggcagugucuauuuuuagauauuaaaaagucucucauaucucucuuacuuuuaccuucuuuauaaauuauaccuuuuuuucuguacuaaccugaauuaaaauauuuauacaaaaugauguuagaaaucuuuucaucacagauaaugcaugauacuguguguguguguguguguguguguguguguguguguguguguuuacuagggauggaagaccacauggaaaaugaaauuguuuuuaaaguaaaaguguauguaccaaguaaaauguauagauugggguagacaaaugaucuuuuaaauggagaauguuucagauugcucaacuuaaaauuucuuauccuuuuuuuugaagcuauuaccugagaauggaaguauuuauuauaccagaaucauuauuauaaaccuugguuaguucuuauauugaaagaauggagaaauguucuauucaguccuuuggcauguuucaacgaaagcuuaaguugcggcauagaagaaugaagguguauccccggggagaugggggacaaaacccuuuuaagucugccacaagcucuaaauuacuuugacaccuuguuguauauuaagaaguaauucagauuuuaguuuauuugauaauauaucuuauguauuuuaauauaaagauguuuuuaaaagcuuggcaguaaaaugauuuaacccccccacucuccagucuauaagucagaaucauucuacuagaaucugugccauguucauccuugacuuuagggcacccuuggugggugguacacauccuacaguguacauagagcucaguuaauacagcuuugcauuagaugcaggaggaagggcucaagaucuacauguuucaggagauuccaagcagaguuuguguuugaaguguucacuucagcaaaaguccacagguuuucaugauuugaauaauuccucacugcuuaauguucauuuucuguuaauugaaacauuccuucauucauuugacaaauguuccagucuccaggacugaaaaagggucugucuccauggaguuuacaguguagcuuuuccuaugguuucuagguugauagauacauucuaaaacuaguuaaaacuuguugccuuuauucuccaguagcuaacaacaacaagaacaacaacaacaaaaaucaaccccaaagcaucuucauuaucuggagaauaaaccuacugcauucugugagugagaaaauguagauuaaucuguauauucuguuaauucuugcuaaaaaagagaauuucuuauugccagaguauuauauuuuuuauuuuguacauaauucuugauaggaaagaauagguugugcuguucuuuugugaaggugaaguccucugugcuuucugauuauacguuauuuucagcuauugaaaaagcugcuuaaugccaaggucauguaguaucaggcauugacuaaggauaguuauguggguggaccuugacugacauaucugaugcaaaaacaguucuuacugacaaauugaaucaguuauucaccaccacugugcaaucccccaugauugugggagauuugggguuuggagauacugugacuucagaggaagaaagggggaaauuaaaaagaaguaagagaacuaauccuggaaacaagcugucacacaagcuugaggguagagcugggucagggagaaggggaguauguagaacuuccuuuuugaaaauauuuuccuuguuuucagacucauuuuugaaagcauuuugauaccacagcauauuagagauggaugagagaucaagagaucaucucauuuuggucuaacacuaauauuauguaaaggaaacuaaagcuuguuuauuuagagugacuuguccagggucaggugguuaauuagugacagcauauaugcaucuagagucuagaaacuuguucuggguuuuuccugugagacuuucucuuucucuggagugcucauugcugaugggugaugguugcacaugaagcuggagaacugaucgaugcuauaugggggaaagcuuuguguguccuugugaggaauuucacucuaugugugugugcuggagagcuagugcugauuuuaagcauggauguggcugggcgugguggcucaugccuguaaucccagcacuuugggaggccgaggcagguggaucacgaggucaggagaucgagcccauccuggcuaacacggugaaaccccugucucuacuaaaaaaaaaaaaauacaaaaaauuagcugggcaugguggugggcgccuguagucccagcuacuugggaggcugaggcaggagaaucgcuugaacccaggagguggagguugcagugagcugaggucacgccacugcccuccagccugggcaauagagugagacucugucucaaaaaaaaaaaaaaagcaugaauuuacuguuagguuuguauuuagaaagaacacuuugacugugauuuggagaaugggguguauuggaaguaguggcggugguaaaugggugaauggguauauuaggaagcuacugagaguuguucaugcaaaaaaugaugggaaccauguaaacaguggaaguggaaaaaaagugcggcugguuagagcaauauuaaagaggaagagaaauaggauuuagugauuguauauuggugguaggauggggugaaaggagggagagaaaugaaguguuuugguuuucuaggguacauaacaauucaccuuucuaauuaauggcuuaaaucaacagcaguuguuuauuugcccacuauuuugcaauuugggcagggcuugauggauggcucaucuguacuccacauagugucugcaagagcuggaauuuucaggauggcuucuuuacuggguggugccucggcugaccuuguggugucaucuaggggcuggcugggaauggcucuccuuuuggucucuccccaacgcuagcaugaccugccuuacagcaugucagucuccugguagucugacuuccugcaugguggcuggcuuuucccuagagcucaauaguagaaacuguuagccuucuucauacuggggugcagaagucccagaacauuaguucugcuacauucuuuuggucagagcagccacagggccagauugcauucaagaagaagggaaauagcucccaucaaagaauuuaugggugcauauuuaauccaucacugucugcccucuggccacaaauuauuuacauuucuucaaaggcaaaacacaguugcucacucccaagaugcccagcagucucagcucauuauagcaucaggcuccgacucagauaccagaauugcauucauuaaaucacguggggguguagauaagguggguugggugugguuucucaguugcagaggugugugaacuaaauaaaaggacaaguuauuugucccccagccccccauauauaaaacaggaauauggggaugauauaagcccaguagacaccccuguuccaaauggauguggggcaguugguuacaguacuguagaacagguacugguccauagcaguucugaaauucagccaauucucagccucagcucucauugggaaugauuuucugugauuuuuggcuccauccucuguguugucccuccauuccaguaagaaacagcugauguuugcagccaacucuuuuuuagcaugcuuccugccuauagaaguuuggggguuuggaggccuccuuuauuuugggagaucuuauuucauuuauucuugaucuccugaccucgugauccgccugccucggccucccaaagugcugggauuacaggcgugagccaccgcgcccgccuaauuucauuuauucuaagcuaguguaguacccccaaauuuuaagaacuuucuguauaucaaauuacagucuacucuguuugagaaaagucacacccagaauaucuuugaagauaagauugguucuucucuacuuuaggcugggugucagguugcugugggacagccccuuaaagucuuagaaacccccuugucuagauaagugggucugggagacagguccucagaucuuugaggugagaaagaaaaaggagucuuacuuucuugauacuaaccauggguccuuuuuacugucagagcccuauuuugguccuugaccugaggcuacuuuauacuguaaaaaucuuuugcugagagggacugcagauggaaguagcuuuacuuuuggacccauaacguuuuggguccuuuauauucccucugauuucugcuuuucuuagcuugucuugcuucucccauacuuuaucacaggcaguuaaaggaagccaguuauacuuccagcuuucuguugggaaauccucuuaaguugacccccaaguucauuagauacucucucuguuguguacauuacaacaguuuuccucauuguuugccaguucacagcugguaucuucuucugucccgccuucaguagccguuuccucacuagcagcucccacuuucagacccacuagccauuuccucgaggcccuucaggcuccacacaaaacccauucccaaagccaauuccacauguuuuagauuuucuuaugccagcacccacuucuagauucugauuuuugucuuguucauugcguaacaaaccaccuccaaacuuaguggcuuaaaaugauaacaacguuuauauacuuaguacccugcaauuugaauucuccuugguaagaacagcuuaugucuacuucacauggcaucugccaggacuagaacguccaagguaggaucuucccucuugugugugaagccuugacugaguggcucaaacaccuggggcuggccaggcaucucuuucucuccauuuggccucuaugcugcaagcuuggccuuccucacagcgugguggucuuaugguagucaugacuuuuguuauagcugcuggauauuuucagaguaggaaaguggaaguagccaagccuuaguaccucggcuugaagagcucaaaauguucauuuaauugcuucuauuaaucaaagcagccaccuaaccagggaagcagauaguaucacuuuucagugggaaaacuacgaauaauuuguagccaucucuagucuacuauacgaggguaauuccuagguuuuucugguuuagcauugguagauuaugauacuauucccuugaacuggguuuucugggaaaggucaugcuucauuuuacauuucagagaagccaacuccaaaacaaacaaaugaaaaacaaaacaaaacaaaacaaaaaagcaaagcaaaucaaaacaaacacaaaaacaaaaagccaaacaggaaaagaaagaccugucagcuuuguagacugacuuaucuuuucucuccuugccgucuccacacaauauaauuauauuacuguuuucacauuuucuaccauuuaucucaguuuucucuuuuucagcuacagagaguaucccuuacauucu[450 bp omitted]cucuauuucuuagauuguauggcuuccuguuucuuauuuuacucucuuguuuugcuucagcauaucuuuaaguaagcucucuaaaaugcuuuuauguguaaaaucucugaauuuuuucucaucugaaaaugucuauucuuuaaucauaauuuuuuucagugucauaggcaaagaaauacucaagugcucagaauguuguucccuaaggaugcuguaaauacauuuaaggguguaugauuacuuguuucuguuguuuuccccaaauuuguuuucugaucuuauauuccugcuucaucauuguuuuuuucuuuuucuuauuaauauuuuugaauuuuaggaauuacauucagacauuaguuauuggguuuuaaaaauugauaauuaauuauacuagaugacaaacuugugaaauucuccuuaacuggcuuuauuaggaaaucauuauugugacacaaauacaauaugccuauuuuagaaaaaucuguaaaauuuccgaaauaucuacaccuuucagucccuauuuaagaaucucuuuacuuuuucccuggugagauaaaguuggauuacuuaaaacuuuucaggacagcuuugucuuuuaaaaacauagucaacaagaucuggaauauuuuaggccuuuggcuaguggugcuuuuuaagucaguucuguugccccuucuuugaaacagcugcugagacaauaaagguugagauauaaacuccauuaacagcauucguggcuggaauaaaaauaugcuuuauuguuuuaguauaaugaauggaacugucugggaggccgacugauuuuuuucuacgucuguugagaugugaaauuugcagcuuguggguuuuaaugaaggaaacuggauuaaacauuuaccccuuacauaaauuauaagcaggugaaauaagccuguggaacaccuugugugaaagcaggagcuacauuaauagcaggucaugagaaaaacgagggacuuuguugaggaaguccagagccaauggguugcagaaccaaccugauccugcuuauaaauaaagaggcuuaaacaagccagccaauuaaaugggaggggcacaacaacuuacugcuuguggagccaugauacuuaccaagguaucauuucuuuuauuuauuuauuuuuauguauuuauuuuuuugagauggagucucacucuguugcccaggcuggagugcagugguacgaucucggcucacugccaccuccgccucccggguucaagugauucuccugccccagccuccuaaguaucugggacuacaggugugcgccaccacaccuggcugauuuuguauuuuuaguagagauaggguuucuccauguuguccaggcuggucucgaacuccugaccucaggugauccaccugccucguccuuccaacgugcugggauuacaggcgugagccaccgugccuagccguaucauuuauuuucacuguuggauugugaacuucauaaacuaugauuuugcuguuuccagcaacucauagagaaauaccaggaaucuuuauaaauagccuuugauuguauacagauuaugguauuagaacguuggaggaauggaucucauauugugacuuuugcaguuuaccacucacuuuaaaaaacauucgcgaaaagggccuucuaguuugaacugagucuuguacauguuuguuccuguuuagauauaccagaaagaggcacggcgucuguggugaggaguugcuaaggaggaaguagcaguagauauaucuguuuuaugccuacccuuauccacuguugaguaguuaccaaccaguacauuucagguaacuuguaccuuuguccuaccaugucugucucaggccuccuuuaacacaaaggaauggcagcauucuuuuuagaacauauauucuaauuggauaaauauuuuuugauuucacacacacugccugcaaacauacuucuguacuuagugccuauacuccuauuguaaaugguuauuuuuauacuugguaccuucuauacugaaugcauucucuaugcagugauccugcaccccaccucaccuguaugcucugucaaauuguagcaagguuuugcacauugcaguugcucaauaaauguuuguugaaugaaauuaauuggcuacagucuguuccuguuguuucccuuuaacuuaaaucuacacaauauuccuguauugaaaguacaauaacauuauuugcagugcucagaaucauugccaaggauauauuugauuugcacguuauacugagaaguaacaaugaacaaaugaaugaacaaaacagcuaaccacauacuuuuuaauuuuuuuaaagauucgcaaaucuagcgucuauuguauuugaaauauaaaauauauuuauguuugcuauuuaauaauaagguuuauauuuuggcaaguauuuggcuuguaggugguucugagcauucuuuuucuuuucuguguuuuccuuaaaauuaaacaaaaauuauacagcugaaacaucuggcagaucugauuuaauacauagccaaaaugaccauuguucuuuccaugauugucaauucuuuugaugaccucuuguguuuaauaaugucguuuccuuuuuagacuucacaacgguuauggcuagauuguaaaucuguggaaucuaaacuaugguucugcuaaaucuuuguuaauaaaugaggaaguaaaaugaauaugaacuugagcucaaaauuaaugggucugagaugacaguaagcuuguuuuaaauaucugaguuugcauaucagcucuguuuacuagugucaugacuuuucuuucucuaaguuaauuauauuucucuugucuuauaagguaauuguaagaaucaacaguaguugaaaagcacuuuguagcuauuagcuguauauaugagauuauaauuaccaagucauauuacauaauccauauuucaaagcaauuaacauaggcauuuucagaaaccaaaucauucugauagacugacucauauucuuccucuaagaaaauaaauaucuguauuacucaagaaagaguuuaguuuuguuuuuuuguuuuuuuuuuuuugagacagaguuuugcucuuguugcccaggcuggagugcaauggcacgaucucugcucacugcaaccuucgucucccugguucgauucuccugccucagccuccagaguagcagggauuacaggcaugugccaccacgccuggauaauuuuguauuuuuaguagaguugggguuucuccggguuggucaggcuggucgcgaacucccaaccuuaggugauccgcccaccuuggccucccaaagugcugggauuacaggcaugagccacugugcccagccaaagauuuuuuuauaucauuuaaaaaauuuuuccccaagaauguggaaccuacaaauuucucaggucuggguaacucuaaaccgcuguauuguugcacugaaaaauuugcuguuuguaggucucgccugugcauagcaagccaaguggcuaugaguggguagaauauuaucugguggaucgaaugcggcaaaggauauucaccauccauucagacuuguaaaauguuuggagcggagccuggcagacaauaugucccauacaauuuuuauuauauaaauauuaagaacugagacaguauuaauuguucuacugaaaugaugauuaaauguaauauuccagagaccagccugggagaaugggggugaaaugugugaauguaaggguguuagcagugucuaagagaugacuaucuaccucuuguuuaaagaguuugguagcaaaaggaaggaaaaaacaaaaccaaaugcaguaguaagagcaaacaaagacugaguguguguguguguguguguguguguguguguguguguguauuuuaauuuaaauuuauguauuuuuugacauuacaaaagagaugacgcccauagagaagaaaugacugcaggucuacauaaggaaggguauacuguaggauuuggaauucuagcaaaauagagauggauuaagggcucagcaaaaugaaaggaauaacuguaaaucagagaaaaaaggcuagguacaguggcucacuccuguaauuccagcauuuugggaggccaaggcaggaggaucacuuaaggcuaggaguucaagacaagccuggcaauauaucgagacccuaucucuacaaaaacaaaaaugaaaaacauuagcuggugugguggcgcaugcuuguagucccagcugcucaggaggcugaggugggaggaucacuugagcccaggaauucgagguugcagugagcugugauucugccacugcacuccagcugggggaacagagagagacucugucucuuaaaaaagaagaaggugaagaaguaggacgaggaggaggagggggaagaaggggagggggaggaagaacggaaagaguaagaagaagaaaaggaaaaggaaaggaaaaugucuucaguguaugagaggacagaaggagggacagugcgauauuaaaguggaaugaggagcacaugagaacauugaugugagguugucuugcaagugccagugaauuaaaaguggauugucugcugugagggucuucucuucuuucagaugacuagagaauaaaugaaauauaggaaaugaucagcugaggggugugauggagaaugaaugcugguaaggaaguagaaauaaagugagaaggaggauauacuaauauuuggaacauacuguuugaacuuuaaaauagggugauuuuugcauuuauuuugugugcauuuuaaaauacggccuuuugguuauuuauccaacacauauuuauauguuuaauuauucagcaaauauuuguugaaaaucuuugguuuuauagggcuucuguuuuaucaugggaagacagacauuaaaaagauaaaaaaguacaauauuauagcaugcuaaguggugagaagugcuuaggauaaaaauuuuacaggaaagggguuggggagaaaggaagagaaggacugagaaaaagaaaugaugaaagacuggaaaaagaaugagagaaagcgagagagaggguuucagugaguguggccaauggaguugucacuggaaagacaacaggugaguaaagaucuaaagagagggacaggacuuccauggccacaggaggaagccuccugcucuguggaggagcagucaggaggccacauggcuggaguggacugaguaagggagaguggcaggcgaggagcucagagagggaguagggcaucagauggugcagggucuuguaaaccagaagacugcaugaaaugacuaaguggagcaaguguaaauagaaaagaggaaagggccaaucauagagcccuggguagccccaaggauuagaguucugagagaugagaaggaauaagaaaaggagucugaaggagagccagugaaguggagaaaaccuagcacagugaaguguccugguagccaagugaaagaaguaugucaaaguugaggaagugcucucuucugucaaauguacuccaugggucuaauaugauagggacugggaauuaaccguuggguuuagcaauguggcagucauaccggcugcuuugcugggguggcgggaguaauugccugauguuauauggguucaagaaggaaagggaggagagaaaucacagauagcaaaugcaggcaacucuuuuggaguuuaacugcaucuaggaggagagaauuggcguaguaguuagaaaaggaaguggggucaaaagaauucuuuuaggaugagagauaaaaauaguguguguguguguguguguguguguguguaaacugauggggaggauagaguagagaaggaaaaacugauguuguagaagagagaggggagaacugcuacagcagugucuuaagugugcaggaggccaugacaucugauauacaaguuguuuguguguguguguguguguguguguguguguguguguguguggugggggaauaaguggccuuagcuaguguguuugugcauaguaucaggaaagaaggcauaguguaagcacaguuagaugugaaggucagaacuuguggaagcucucuuuggauauguauccaaagauaauauagauccucaccuucccuccccuccccuccccuccccuccccuccccuccccucccuuccuuccuuaucuaucuauccauccucacacaaauaccuauacauacaacaugauuuucacgcacuaaauagaagagaaagaugagguuuuucucuuuugacaauugcugccuuauauuccuugaaguuugcuguuauuuucuggucuuuuuguaaaucucuuugaaggucacaugcagcauccuuaagcuuccaucauuccaagucuugaggaauuacuguuagcaaggcagagcguuagauuccaguucccuuucaucuuuguguuuuaacucuggggcugccauuacuaaaugagaaugggaaucuguaagugagugaauugcugaaggugucagugaaacagucuguuagugucagaaauuaguauuagcaccuuugagaauacucuucagcagccaugguguaagcccuauuuuuaggugauuccacauccuaaucacucuggauguagucuuguaccuaaucuccuggacccagaccucuugaccauugagaccugacugucaauuuaaucucuguucugacuucuuuucuuuucuuucuccuguuuuuuuuuuuuuuuuugacggagucucucucugucgccuaggcuggagugcaguggcgcgaucuuggcucacugcaaccucugccuccugggcucaagagauucucuugccuuagccucccuaguagcugggauuacaggcgcccgccgccaggcccagcuaauuuuuuuuuguauuuuuaguagagacgagguuucaccauguuggccaggcuggucucgaacuccugaccccaacugaucugccugccucgcccucccaaagugcuuggauuacaggcaugagccaccaugcccagccucuucugaccuuuucauuuuaaauuuuugguuuaguuaccugucuucaguacuuauuguuucuguuacuuguagggcccagacuucugguuugcugagaauuuccuaccaucuuuaguguuuuaacuuguaaauuuucuggccuuuucugccaacauugucugcugguccuuguccacaucugacuagcacaaucguguugaugccugauauuguacugugugcaguagccaaccacaguaccauaauugguugugauuuuguaguuauuuuuauaaauuguaauaauucauaugacuaauuuuaucaaaaugauuuccuaacauuauggcaauauuuaauuggucaaaauauuauuuuucuucuauuuuauuuauuuaaccaguuuaauuaacuguuucucauaauuauuauuuugucauuaaaaaauaacaaaaacuaaaaccaauucuggagauacaauaguuaaauaaaaccaagcuuuucuacaaacuauucuguuucuacuuacagugcuuuucugaagaagcaaaguacauuaaaaaaacuaauaguagccucagaauuaaauaaaaguacacagaaaaaagaugugguuguggccuaacuuuaaucugaaacagagacaguaugaugaauaguuuugucuuuuuuuccaaaaucuccuuucaaggcuguuuauaauucauuuuuggcuacagguuagcucauuaauaugaacaugaucagucuguagaaugaauacuccuggaaauauauuggaaucaaguaagcagagugccguccuguuuuaaguaugacagguuaagaaaagucuggaauauugcaguaggucuguuauuuuuaaaaaacaaucacaugcaaaaaauuugaacccagaauagaugaugggcagcaauagcuacuauuuuagugagcacuuaugcgccaagcaugugucugcucucauuuaauuucacaaauccuuaaaauaauaauuugaagcagauaucaguaaaccacuuuaugcacaaaaaacuaaaguuagagcugcuaauaauaaauuuguacaaggcuacacaaaccaauaaacuggagagcugguauuggagccuguuugaacaauguuggaaggcaugaaauuuuaauuauaaccuauaugcacauauggugagcagaucauugaauugggucaguguugucauacuuuauuacuguggacauguggaagacuugaggaccauaguacucaagugugguuugaagaacucugggguucccugaaauauuuucagggggucagcaagucaaaaguauuuugaucauaauguuaagauguuauuugucuuuuucaccauguugacauuugcacugauggugcaaaagcaaugguagaugaaaccacuggcaucuuagcauguaucaaugcaguggcaccaaacucuacuaguggucacuguauucaucacaaucaauaauucauagcaaaaaacccagccagacccacuucagaaugaucuucaucugcuuauugaaucaguagaauuuauucaguuucuuaaaauuuaaccuuugagaacacauuuuuaaaaauauaauacaugagaaaaugggaauggcauaccaaauagaaugcucauguagaggaaaagcauuugcacaauuuuuugaguugugugguaggcagaacuauggccccuuaaauaugugcuugccuucaucccaggaaccuaugaauauauuaccuuguaugucagaaguuaacuuugcagaugugauuaaaguuaaggaccucgagaugcagagauuauccuggauuauccaagugggccuaaucuaauaacaagaguucuuaacagggaagaggaagguagaagaugggucagagagaugugaugugaggaggacucaacccgcuauugccggcuuugcagguggaagaagggggccacaaggcugggaauuugcaugucuuuuagaaacuuggaacagcccucaggugacagccugaaagaagaccauaaagaaaugaauucuccccuagagauuccaguaaguaucacagucugccagcaccaugauuuuggucugaugagauuggugcuagacuucuguccugcagaacuguaagguaauaaaugaaguuugugguacuuuauuaaggcaguaacagaaagcuaauacaaguuguaagcugaacuagccucuuuuacauggaacaccauuuuuacuugaaagagugacucauaacaaaaugugcuucuucagucuuggguguuaggcagacauagucuugaaaaugaacaaagugaucuugccacuuaaagaaaaacaacugacaggguguauuuagacuuuuggaaaaacuucuguuugucacugugagcuugauaguuugcugaagacuuugaugagauugguggugauauuagugaaugugaugucuugauaauaccuaauagaauaugucaaaauuugcauaauucagugaaccaauauuuccccaaagaucaguguaugaguuacaaaaucaugcauuguuaaaagauucuuuugaagugcaagguaaagaaguggauuucaaugggacagaauguagaaaguucacugauauaguuucagauuucgcauugccacaaaccucuaaggaacgaucauucuuugguggauagugucaaaagauaauauuaaccauuaucugacaaagcucugaaaauuugcccuuuuccauuuauauauacuugugggacguuagauguucuucaugucauggcagauugagugcagaaacagauaagggaauccagcuaccuuuuauuaagucaaguauuacaaaaauguuaauauaaaucuuugcacaaacuuuuuuguuuuaaaagugaagcuauuuucauaaaauauuuauuauauaauuauuugugauuauauuaagugaguuaauaaauauuuuaaauuuucucaguuauaauuucuaaaaugauaaauauugauagaucaaaccauacacacgaaagcccuuaguggccucucaacaguuuucaagagugagaauugcuguuuuagaaaacacuugaaaaauaaugauaaagaucuaaauuaucaacaaggaaaaauaccuacaccagguuuucaagcacaaaaaggagaucacaaaacuuuuuguuuagaaugagucugcguauucaaaauuuuauaccuauauuaacuguuuuaauauugagaaauggcggaaagauguucacuaaaauuucaguagugguauucucuggaugaguguuuuuuuuauuuguacuugucuuuaugguuuuauuauuucccaaugagcauguaucaugaaagaaaauagcaaaucugaaucccagcacuuugggaggccaagguggguggaucacgaggucaggagaucgagaccauccuggcuaauguggugaaacccugucucuauuaaaaauacaaaaaauuagccaggucugguggcggaugccuguagucccagcuacucaggaggcugaggcaggagaauggcguggacccaagaggcggagcuugcagugagccgagaucacaccacugcacuccagccugggugacagugugagacuccaucugaaaaaaaaaaaaaagaaaaagaaaaagaaaauagcaaaucuguauuaaaagcacauuuauuauuuuacaacaugcauuuuuauaagaacugugaagccagguaaaaaguguauaauuuauucaugaaaacuucucuuucauugcauucuuuuccagagcuacuaaaugauagucaugguuuuugguccaaauuuauugcucaaggcuuuaaugcaguaguuggcauuuauauguuuaagauggucucauugguagcuuggcccaguagauauugauauucauuaaugcagcaguguguuaacuucacucauccuuuuguuuucuguuuaguauuuauggguaagccuuguaggguacaauuaaacuuaugauguuuauaaaaauauuauaaauuguucagguucauagcaggacacgagggcuuuagggugcacacuguuaaucauaagcaaacacugucacagaaaugcaguguuugaugucuaguuucuguucuaaucucauagucuuugauguuaucaucucaagacuggaaaaugucauauucauuuucuugauccaguuaacaugauuuuaugaguggguucaauaaauuagcagaauauaggacaguuucuuaucaguaaaaugaggauaauaauagaauuaccucaaaggaucaaaggauaguugugaggauuaaaggagauaaaauauauaaagcauuuagaacagugcccagcacguaagugcuccguuagugauagcuauuauuaucuagaaagugcacacguaaguucauagcaaauauuauuugcaaagagcuaacuuucccagauacucacguucaaauuguucauguauuugcuuuagcgauggucacgcagaggcuguuaucagcgucucuuuuuagaacaggcaccugcuuuucaggugacacucuuaauuugauuaauacugucuucucauaugaaaacacucuagguucaggcaagaaccuguuuaguauugugaucuaggagggugagcagaaccaccauuuucucuuugauucuuugcuugcuuauucauugguuaguucacuucacaaacguuuugcgugggagccaugugcuaggccuugugcuugggauagguaaggggcaugagacacaucugugggagaggaagaugccauuggguggcuaaauauagugccauaagugcugugagggggaagcacuggguugcugugggugauuuagaggugugcauugcugccacaggcucuggguuagggugccuuugggaagggccauggagggaaguuuuuuugaggggaguugugagcaaauaggccucccaggcugcugagcagugagcagucuaugcuuuguuccucuuuguuccuccuucucugaggacaucuuauuaucugcugaugugccuuaugggcaauuugcauggaagauuuauuagucauguuuuuauguucuucacauuuuauucacugggcugaaagaagcauuuguguuuauccaauauuuauaaggcaauaaaauuuaaaaauuuuuaagaauauuuaauaaaggcauagagguuucagaaagauuuuucuucaguuauuuuaaccauaacuggaguuuuaaacauuuaaggaugauuuuuguuuguuuauuucagaguuguggaaggaauaaucuuuccaaaguucuuuuuuuucugaaucagcccacaaauucauagauuaaucauaagaaaaccauuuagcugguauuuauguaaagaaauauguuaucaucacugaauuuucaaaucuuugggcucauauuccuguauuuugcgguggcaaccuuuuuuuuuuuuuuaaagaaacuuuuuuuuuuuccuuuaucuuuucugguucccaaauuaaaguagaauuuuggagaaacuggaaaguuacugucagguugacuggauguagugcugcaggguguccagaaaggaauaugcagcucauuggaggugagguuuuugagauggagucucgcucugucgcccaggcuggagugcagcaaucucagcucgcugcaaccucugccucccggguucaagcgauccuccugucucagccucccaaguagcugggacuacagacacccaccagcaugcccagcuaauuucuauauuuuuaguagagacgggauuucaccauguuggccgggcuggcccugaacuccugaucucaagcgaucugcccgccucagccucccaaaguguuaggauucuguaaucccagcacaggcgugagccacugcaccuggccuggagauaaguuuucuuuuuaucauuauuauuauuauuuuuuuuuauuauacuuuaaguuuuaggguacaugugcacaaugugcagguggugugcugcacucauuaacucgucauuuaacauuagguauaucuccuaaugcuaucccucccccuuccucggagauaaguuuugaaaugguuuaagagcuggagagcagcagaugagaaagaauaguucaggaaaacugguaggccauguacccaggaaauagaugaugaaguaagaaugagugcucagcaaggaauugagaaucuuguaggagacauaaggcaagaagaccaguuauauacaguagccccgcguuaucagugggggacacauuccaagaccccucauggaugccugaaacugugaaugguaccaaacccuauuuacacucuguuuuuuuccuguacauauguacauacauacauacauaugguaaaguuuaauaggcccagcaagaaauuagcaacaauaauaauaagacagaacaauuauaacaauauacuguaauaaaaauuaugugaauguggacccucuccaaaaugccuuauuguacuguacugcagguaacuaaaaccacagaaagugaaacuacagauaaggagggacuacuguacgaguccaaauguauuaagugcaaugaggauaaaaacaaaauguuuuagucauuuauucaguaaauaaauaaauugguugagugccuacuauagccacgguugaggugaggguaagaucaauucuguuuaaagaauucagaauucaggauaggcuuuuguuguuuuuguuguuggggagacaaggucucacucuguugcccagacuggaguguaguggcgcaaucucagcucacugcagccuccaccuucuggguucaagugauucuugugccucagccucccgaguagcugggacuacaagugcucaccaccacucccugcuaauuuuuguauuuuuugguagagaugggauuucacuauguuggccaggguggucucaaacuccuggccucaagugagccgccugccucugccucccgauauguugggauuaugggcgugagccucugugcucgaccgaagauaggcuuuugauagaguucaugacauuuaacuugcccuuaaaggguauacagagauagaauucuaaugcagugcuguccaauuaaaauauaaugugagguucauguaaacuuucuaguaaacagauuaaaagaagucaaaagagacgggugaaauuaauuugaauuguauauauuauuuaacccaguacgcacagaauauuguaauuucagcauuauaaucaauauaaaauuauugagauauuuaacauuuuucacacuaaguccuugaaauugacucugcauuuuacaugucaagcacauagcacaucucaauucagaagcuaacuuuucacuggaaauaugugaucuaaauauagaguuuauaaaauuuaacaguugaaaaacaaaauucacauacaguuuguuccagucauacuuuaaaguuuuccaauaacugaauagggcaucuguuuuaaaauuuuaauguauauuaaaguuaauucaaauuaaaacaucuuuuuccuagucauauuaaauucaucuccacccauggcuaaaagcuaccauauugaauaacacaauuuuaaagagcucgaaaagaaaguuuuguaggcagaaagaccaguauaugcaaaggugucaaggaaaaaaguuggagcaguguugaggaagcagcaagcagcccaguguaauuuauuugaaaugagauagugagagaaaaaccuggaaugauauuugggagucauggaugcuuagucuccaaauuggaacuucauguaaauagacauuggacacucacagguuaaaccuuuugggaaaaacuuuauaagaggaaugagaggcugcauguuuugauuuaggcugauuaaucuggcugaauuguuuaggguggauuugagagccaaggggaaggagagaggcuggaggugaggauauuaacaaagagcuaaucgccaaguggaaagagcuaaugagagccugaaguagaaaagugcuggagauuccccauccuaaaaagauucccuuuuacugaaucagccucccucaauggguuuccuaguguucaacucuuucugugcuguuacaaauauuauguugugucucuaguauauugucugcuaguauuucauuuauuaauuucccaucuaucuccauagauugguacuguaaacauguggccguacagcacuuauuucauuguaucauuguauauuauuuuguguguuuggaucuauucauuuuagagucugagccaucagcgaagagagaccauuucauuuucauguuugcaugcuuagcgccuagcauacuuagggccucugguguucugguugcacugagaagaaauucaauaaauguuucuugauuugacugaaccugcaaugauaguaguuuguggauggcacagacuuggggaugccaauaacuuugacucauaucugggcaauaaggaagcaacugaaggugggggguucauuucaaggugaagugcuagagguuucaagucaaauuuuuauuggggaaaaguugaagcaacaguuugaagcaguuucugguaugccccuguuucuuuuuaagcauacacaagaaauuuaaaucauuggagaaauccuauuacuugauauaggcaaauauauuaccccuuacaauuuguuuaaaauuagaaauccuaaaacugauggugaaaagccagguauaguuauuucgacagugaaugacugaguggcaguuauaggccauucacccacuggacaaauagggacggugaggaaggacugguguuugugggacaugaugauuuccucauaauaaauuggagacuuuuuguacaucauggaguuaguugauaaugaagaggagguggagaaaaauaguuaauauuuauuaauuuuauuuacaaguuaauucauccacuuuauuaacauuauuaagaaccuauguuagauacaauguuaggugcuuuauacaaacuuuauucucacaguuuuuauagguuacagguauuaucccuauuuuauagaggaugauacugaaguuaagagaguuuuaaaagugugccaaaaaucacauaguaagugaucuagcugggaauggaacccagaucugucuuacuguaaaauuuugaccauuuauaauugggcauaguagauguuacagagagggcauuuuggaguuaaaaaaagguagggggaaagguaaggaucuuuuucuagaacagaagcuccucuucuguucauuuggauggugaugaugaaaacucuuccaguggcauaacaccagaaauuauggggacugcauuaggcuagcuuugucaggacucccauaggagguggucuuguggaaaccaugauaaagaauaagaaggugugaauauucucccuuuuuucacuucuucacauaacguagguagaguuaacgugugggaacauaaaaugccgagaaggugaaaugaaggaaauagggauugauuguuuguaaauucaguguuucaugccuugaagauuaaaaaaaaaaaaaucuuaucuaguucauuaccguucuagagacagacagauuuaaaaagugucugccuuuuuuuuuuggagauggaguuuugcucuuaggcccagacuugaaugcaauggcgugaucgcggcccacugcaaccuccaccuccuggguucaagugagucucuugccuuagccucccgaguagcugggauuacaggcaccagccaccauguccggcuaauuuuuuguguuuuuaguagagaugggguuucaccauauuggucaggcuguucuugaaccccugaccucaggugauccacccgccucggccucccaaaguucugggauuacaggcaugucugccucuuaauagaagggucagaugaggcuaggcgcgguggcucacgccuguaaucccagcacuuugggaagccgaggcggguggaucacuugaggccaggaguucgagaccuaccuggccaacacagugaaaccccgucucuacuaaaaauacaaagguuaacugggacacuucggagguugaagcaugagaaucgcuugaaucuggguagcagagauugcggugagccaagacugcaccacugcacuccagccugggcaacagagcaagacucuuucucaaaaaaaaaaaaaaaaaaaaaaaaaaaaaaaaaaaagagucagaugaacaaaacugauauacuucaacacuagcuuucuuuuagcuaucuuaauuuuaucaauaaugguaaauguguuguuuaguugauuuuuaucaacuaaaacugggaguuuuagcugacccaggagagugaaagggcucucuuugagacugauaaucauuuucugacaugaggcuauuuaaggacucaagaacuucuaaugucaauuaaccaugaaauauuuuaauagugcuuagucuuugcucaauagguuggucugugcuauguuuguaauagauguaagucaaaucgacauuuugguuuaugagauuccauguuucagaagaggcuauuggauucuuaaaguguuuauucagucaucaaauauuuauuaaguauugaacucauguuaggcauugugacagacaugggguauuuaguggugaacaaaauauauauuuuccugcugucauauucuuugaaaucuagugagguuggcagacuuuaaaaagacaguaacacaaaugaauauacugucauacauuuugauaauauuugucauugcacauauugauuucauugaacacuagagauguacuuuuuuagacauaucuugaaaagcugugugugugugugugugcauguguguauguauaaaaauucacguuuguguaaaucaaguaauaauuuagcuuugugauuuugagcuagucauuucgcuucucuggauuuuaauuuucuuguuuaucauguagcaauuuauagaagaucuuuguagaaguuucugagguuaaauucagucaugauguuaugugauugagauguuuauauacuguuuuuuuaauguugcucaacaccuaaauuaguucauuuuguaccugaaaauagaaguaagacuuguuaaauacuaaauucacccaauuugcaucaauaguuauaaaacugccauacugcaaauguugaacguuuugcagaagcuuaaauaugaagcuuugaaagguauuguagaaauucuagauucuaaguucuauucaaaaccuguuuauuuucuucagcuggauauguauuugaugugaaucuucuaaacuugaaacaaacacuugauggccaucaguuuuccaguuuauuaguuuuuaauagauaauuuuuuagagcacauuuagaaguauagaaaaauugagaagauagaccaauuuauuuucacaguggaaguaauaggcccuaucuuggauaguugugagaauaagaauuauugaauguaaaaguuuuagcauagguccucauuccuacacagcuaucauugugaucaacuuuuucccuucauuaugcuaacuccuacacuaaaagagagcuagguaucuguuuaucuuuucaguuaacaaaagagaaaauucuauugucaugcccagauuuccaucuguaucacugaugacuaccgagcacaaaucuguuacaccauuuaauguuuucucucauuguuuagauaauuaguucagugaucuuuguuuccuuuuucuaaccauggaauuuuaugaaaaucuagagaucaagaggaagcaacauaagaaugaguaggugauuuuuguauuuuuuucaaaagcugaucauuuuaaaacaaaacauuccaaaaguuucuagcuauuaauauagaguuaauaugcauuugaagaauuuucaauaacuuaaaccaacuuuuaguaaaauugaacuuuaaaauauauugacgugcguuuauuacauaagcugguauguguggaaaacaaaggcaaagauugagcaaaagauauggaguaaaaucaugcugauguauuuuacacuaacaaaaagccacauauagccauaguacuaauguacuacucuuuaacauauuacaguaauuguaauuuauggcuuugaaacuuuuaagguaugaaacccccaaaucauguuuauauuugaaagagaaacuuaaggcaauaaauaauuuguagcaauuagaaguauauuuugcaugccauuaauauauaauuguaugcuacuuuuauauauucauuguagcaaagauucaccagugaacucuaucaggcccgguuuaugauagauauguagauagauagguagauagaaagauccugguuuaauauagauagauaaauggauagauagauagaugcacacacacauacugauaaagaccaaucagaaaauauauauauauauaauauauauuuaaaagaccaaucagaauauuuaucuauauuauauauauaauauauauuuuuggguuggucuuuaucagugaagucauacuugaauaguuaguagaguaaccgaaugucuuguuuuugcucauuuguguuugagguauaguuguaguguccaugggauggugcagugguauuugcaucacauaauuguugcaugugggcccuuuuguucccauugacuuucagggccauuuugaaaccugcauuaaagaaaauuucugagacauuuucuucuagaaacaagcaugguguuagcagauucaaagcaugguguuagcagagaaucagaaaauaauuuguauaucagaccucuucguucuaugguuuuggagaacaaagucucacaaguagcagauggcccuagcugucauucacauagagcuccagcuuucauaaaaagguauguuucccggauacaaucuggggccuauuugccauuuaacggccucacucuguuugaaguuuaaaguucuccacugugcugcgccaacaguuuuugauauuuauuuagcagcuggcuaggaacuagagaaucuuguguugcacugaagacuugauguucacacuuugaaucagacagaaaaauuuauauuauggcuaauauguacuguuuaugaagacagagauguauauacaugcuccaaaugauuaaaaugaaaaguuguaaacaacacaguuaacccucaguggcucguaaauuuuugugacaggauaaaugcugguuacacacguggugcuauucucuguguuuggccuauuggaaugcauugaucuauauuuguaagcugaaaugaaauuaagaaauuuaauuuauauuauaguuauugauuaauuacauugcucugugacuguaccagaauaauacauacagaaacauauuacugguugaaguaaguuuuagaugguuacuuguggguuauugcccuauuacuguuucuauagaaauguaaaaguuuacuuaaaagucaccagaaggucaggugcaguggcauaugccuguaaucccagaacuuugggaggcugaggccggcagaucaccugaggucaggaguucgagaccagccuggccaacaaggcaaaaccccaucucgucucuacuaaaaauacaaaaauuagccagacaugguggcacaugccuguaauuccagcuacuuagaaggcugaggcaggagaauugcuugagcccgggaggcggagguugcagugagccaagaucgcaccauugcacuccagccugggugacacagugagauuccaucucaaaaaaaaaaaaaaaaaaaaugucaccagaagaacaugauuguauuuggaaaagauauuuauaaauuucaguaugucuguagaugcagcuuaaugauauuaccaucagaugugcuuuguuaucuuuggguggaaaggaauaguccugugacagucuuugaagguugaucauaagauuucugguuuuuuuguuuguuuuuuuucaauuucagaaaguuuugaaacaccuaguucagccuuacuuuucuuaaggacauaucucugcagcuuugacuugaguucuuucuuuuuagaagcaauacguaacuuaaauauuuugacuugcauuuauccccagcuuuucuucguugaagagcucugauguauugccuugucucgaaugcauaauugaucauuaugaaaagaauacagguuguuccuguugucuguucuuccuucuucucuaguaacggaauuuugaacuagguaaauggcuaucuagagucaagacuacauuuccuagcuucucuuguugcuaggagugcaccugcuucuggccacugggguguaaguagauuuguuuuguggcagcuugcuuaagaaaccuuccuuaaauaagagagaauccauuaugugugugugugggggggguggggcaguaggggaauguccucuauuucuuuuucuuauuauuaauuccuucuuuguauccugcucccuggaauacaguugcaacuauuuuaaaccauggaguugagguccccaagacagagaaacaagauagaaggcaccugcaccuuugauauuuaaugacaagcgaugaaguaccaugaugaaaacagccccaaaccccuaacuacacuuucauguuucaugugacagggaaauaaacuucuguuuuguguaaucaauugcuauuuuggguuucagucauugcagaugaacccaaucccaacgauuggguucaacagguuauauauaacauuaacugauucuuuaacuacuguguuaauauauauucucccagaguuguguacugguuagaacucuuagacacaagggugaaaacuaucaccuaugugaaaggacccugggaguggcccccagaauuggaggagacgaagagcucauuuaccacaccucuaaggauguucacagccagggacuggaccccacuaggacucugucucuccacauuuuggaucuaauuucauuuuccucuugguuuuauuuuguuacugcagacugcucucugcagugaaggaguaugguaccagacuaauuuccuuaauacuuguggcuucagaugggacacagcugugucuugucuucuguuguuggaaaaauauuagggagcaacucacauuaccugguuugggucacaugccaguugcaccucuuuaccugucacuggaccagcuuggauuacuugcaguuuauuguggcuacuuuggaggcagguggaugggaagauuggaccugggggagggugcaaggauuggcagcauccacugaaaccauuuguucuaaaugaagugggugcuguuuugacaaaacagugucuauuauagcugauacgucauuuauagaugauuuacaauugggcucaucuuauucuuucuugaaagcaguccaugugugaaaaaaaaaugagggcugcgaguuugcuuugaauuugguuucugacuuugaaguugugaaauuuggcaagacugcagcucagauaaauccuuuguuugggaguuuugaugaaaauuauuucaggccccauuaucacauuauacaggcuaacuguuaggaaccacugaacagauuuccuuauuuucuuugaucuucagucucauugauuauaauggaagcacugcuguaaucauuaaucuuuuuaauguagaccuaaggagguguuuuggauguuaaagaauuaaggcuauuaugcccugaaaaauacuuuagugucacaaauucuacuugaaauucuaaggugagcgcuucucuaaggaguuaaaauuugacauuuaaggaguuaaaauuuuauguauguuugacauacauaaaauuugagaaguaaaaauucuuuugaaagggcuuugggauacugaguuuccagaauguacuugaaauauuaacaagugaugggcgguaaauuaauugaaaggucauggugucaucggauugaguucuguggagggagagaggacaucuccguccacagggcaugcauucagagugggcagggccuggcgugggcugggcaaaagcuagucaugacacagcuccugcuuccagguggcuuucaagcaauauggugauguuucagagacuucaaaaauagagguguauugcuuguggaaguauuauauuuauuaaucugauuucaagucagauaugugugaggugcguagaugaagcauauucuuucuccaggaugcugaaagucucaagcuuuuuauucuuuucugcaaucaaagaugaaaagaaaguuuuguuguuugggucacguaaaccaucauacacuuucucuugguaucguuuugccagcccaugcaagagaaggggagggaagggagcguuugauauuuaaugaacaaagaagcauaccuuucaacagccagugucagcucugaaaaugccuuuucugaucagaaccuuucguagaugauguucacuagagucccagacaggaagaaggaacgagggccagaaaggcagucuugcugcaagaugucauaggauuaauuuuucauuccccaggagcagccacagcaggcacgcuccaugaggacccgcauuguuuggaggaguugaccucuacugugaggguuggagguugugcauuuagagcuccaauaugaaugguuacuauguggggagacuagugccuuuccuucacccacaaaaagugcaaguccgggucagagauuagcauccgguugcuugcuauugccuuuccuucuagccuaauuuuggagagaggugaauguguguuuucauuuuuauccccggauggccugcgguuaggauuuuucuucuuugaagaagggagguauacgccccuuuagcaguuaaugauaauguuuauaaggaccugaagucuuugaauaaaagcucaagaaugucauauuauuuucaucugcaaggugaauaaucuguuaugaugguauaaauaucugaaguaauguggaaggacaggacaaaaauagguuucugagaaauguguggcguuuuuuguuuccugauaauauuacagcuuuaucuacugaucucagcuagaguuugucauguccagaucccucugggcugagccgucgcuccuuugccuccuuuuccaaggcccacuucauugcacaauuaagccuugcuuaaaaccuucucuucucaugaauucagacauuucauaaguuaaaacuaccuauuaaauauucaguuuuaggauuuuguuuagauuacuuuauacuuccuauuucaugaugaaggaccaagacguauguuuccuauuauguuuauuguguccugcuuuaaacucucuagcaaauuaaaugucaucaaguccugauuuugcuguauucaaauuuuuucagucuaacuuuauuuuauuaacuuauuaauuuuauugccaaacuugucuaaucagcuaaaauucuaguuaauuuacuuuuuaugggccuaagaugagagcaguaguaauaauauuuuauaaacagugggagcauuuuuuucucaguauugugagaaccuuuaaaaaaauuuuuuuuugguuuaaacuagucuaugugggaaagcucccucuaguguuucuuggagcaaguacaagugguguugaacuauguuuuucaaaaaaugagccuuagggccaggcuuggaggcucacgccuauaaucccagcacuuugggaggcugaggcaggcagaucacuugaggucaggaguuugagaccagccuggccaacaugaugaaacucuguuucuacuaaaaauacaaaaauuagccgggcauccuggugggcgccuguaauuccagcuacucaggaggcugaggcaggagaaucacuugaaccuguuagguggaggccugcagugagcugagaucgugccacugcacuugagccugggugacagagagagacuuggucucaaaaaaaaaaaagugagccuuaaauaauaggacuaauuuuauaaauaaagagcaucugguugaauaaauagauaguaggcugaucucacauugaaaaugcuuugcaguuggguagagggaugugcuguauuugaaaacauggaucucgaaaauaaagaacguucuuuauuuuuccauauagaaauguuccauauagaaaauggaacauuaacuuucuugauuacauguuuaugagaugcuuuacuuucuuguuuugauaacuuuguuucuaauuucgccauuuuagaaaucaugcccauagaaauauccauaucuaaggaaagaaacauaagguuauuuuucauaagugacacaaauauuuuaaaaucaaaguauguuauucuuauuuugagaagguacacaauagaguauuuuugcauaacuacaugcaaacuuuuuucaaacuuuauuccuuauauaaauauuacuuuuauaggagagcucccaguuucuccuaauggcagagaaaacaguuuuaccuacauggguucauuuuacaggggcaaaccgcucuucuaauuaguggcugauuccugaguuuuaccuaaaauacuugaugccauguaggggucacauuuagcaauccagagaacacaggaagcuugaggauccuaaagaugucuucaccucacaacuuagcccacaaacagcccagaauuaaauuuuauguugaugcuuaauauucuguuagaucuucuuccccauccucaucuuagcuaaugagcaagcuugcuauuuuacagagaaaauuaaagcagaggagaaaugcuauaaacucccaucacccaucugccugcaccugugccuuucuauucugccuuucccuuucaaacugccaguucaguucaaccucuuccuugggccuagauucuguccccucuugccuacuuaaggagauugcuccagcaauucugcccuguuucuugaaaucauugauuuccccuucaccauuauguauucucuauuggaagcugucauuucuuccaagagagaacccugucuugacucacuuguuucuccuacugcugcccuuauagguugucuguuccuauugcuuugaauuucguucuugaaauuucuuuugaaccuacuccauuaaggcuuuuguccuuagcucccaccauuuuuucuugucaaagucaccugugaucucguguugauuacucuuuucuuuuggaaaccuuucuuacuugacuucaggaugccauucucuccugguuuuacaccuggcucuugcuguauuuucuuucauucauauuucucccucuuucaaacuguaagcacuguggcuucagggcuagauccuggagauaacccccucuguguuucugccuagcugucuaugucucugucucugucuuucucucucugucuucuauacucuugaugaacucaucuaaucucauggcuuuaaauaccaucuagaugcuaauaacuuccaauuuucugucucagcccugaucugucccuggagcuccagacucauauaaucaacugccuacugacaucuccucuugaaugucuauaagcuucucaaaauuaauguguccaaaacgcggcuccugaucucuuaagccaucacccaccugcagucuguccuauugucgcuccauuuuuucuaauuccuguggcccuaaaccgugaugucauccuugccugcucuccuucuccuggaccucacauuggauucaucaacauaucaucaugucuguaccuuuacaauuauauccagaagcuggcagcugccuaaccaccucccuugcugucgcuucugugugagcuaccaauggcucacccuggaugagugcaguagacaccugcccauuacccuuguccauauuccacacaguagccaaaggguucuuuugaaagcaacuuagaucaugucauuuccacacugagcacugcacuguaccaggggcuuucuaucucaccaagaguagaagccaaaauccuuucaagccccugcaggauuuagaucucccacgucucccacaacugccucccccauaaucgcgugcucacucacucccauccagccaugcugguuccucacaguucccugaacauaccaggaaaauuugugcuucagggccuuaguacuugauguucugucugcccagaacauuccucccucugauauuuauauugcucaugaccuugcugacuucagaugucuacucauauaucaucuuauagagaguccuuucccuaaaauugcaaugguuuuccucaaaauuuuaugucuuuccaaauuucugccuucccugcauuauuuuucuccuuggaaauguucacuaaaaucccuuauauuuuacuucucuuguuaauuuuuucuucccuaucucgccaccucaauuuaaauuucaugaaggcaggcaauuugauuuagccauagcuucucacuuauuucaucuucuuauguagcacacauuggaauuauauuuugguuuaaauguuauuaaaugcuuucauugucgcagcacugugucaggcauauuuucacaucuaauucauuuuucuuagguugccuuucagauaaacauugugauuuccauuuugcauaugaaaaaccugagaccuaggggguaucauaucuuuucuguagauaaacauagauacuggacccaggcuuuaaguagaaacccuuuaacagcaugauguguaccuuucuaauaugugaagcuauggacugcuuccuuuuaaaaauaauaauuuugauugugugugugugugugugugugugugugagacagggucucacucugucacccaggcuauauaaugcaguggcaugaugugaucacuguucacugcagccucgaccucccaggcucaagugauccucccaccucaacuuccuaacuagcuggggcuacaggcaugugccacaacuccuuccugguuuaaauuuuuuguagagacggagucucccuauguuucccaggcuggucuugaacuccugguuucaagcaguucuccugccuuggccuccacaaaguacugggauuauaggugugagccaacacaccccaccugacuuugguuuugaaagggaauuggaaagugacgguucuugccugcuccuuugucauaugacuucuucccaagcaugccaucuucugucuuguuacaccagcacuaaacucagccacuuuuggggagauuuuauucucucucucuuuuuuucucucuuuuuuuuuugagacagagucucacucuguugcucaggcuggagugcaguggugcaaucucugcucacugcaaccucugccucccaggcucaagcgguucuccugccucagccucaggaguagcugggauuacaggugcacaccaccaugccuggcuaauuuuuguguuuuuaauagagaugggguuuugcuguauuggccaggcugguccugaauuccugaccucaagugauccaccuaccucgccucagccucccaaagugcugggauuacaggugugacccacuacgcccggccucauucucuuuaucaaaucaugauuccccagauuuuuuccugugaguuacucuuuuauauuuucuaucugaucacuuuuacacauuuguaacagucauaggauaagaaggcacaagucguaccuuuuacagaaggaauucaacuggagaagcagugagacagcaugagaggagagaacuuaguagaaugguuuaagaaauguuucucugacaauuuggccuaacuuagaggccaucaaaaaggcagcaguuagaaaagagcugaaccauaaauggguuuggagcaaaguugccaagaauaucuaagaacuaaagccuggucugagaggaaacugucuuggcucauagcccgaggaucaaaaacaaagcuacuuguaugacucugguuuaagucacagagauacucuugcuuucuuuggccccaauaguguagucucuuguaaucucguucuuuuccucuucagugguuugacuuuugauguuaacaguuuauugccacaucuguaaaauaagacaguggggaccggugauuccuuaaggagacccuuaguuuuacaguuuuacaguucuaucauuuucaaaucaguguauuacucuauucuauuuugaaucuagacucaguuuuagacuucuauuuuacuuuggaaaauuugcuuuaaagaauaauuuagauuuuuaacuaaauacaaagaaacucugaaguauuuuaggauaaaaguuaaaaugagauugucaaacagcuucacccuaaaaaccauagcacgaacucggugugcuucuaaggcuacuggagcuggaaaaauggcuaggaaugauuaguguuuccuugaauacaaaugaacugauacuuggcaucuauauaucuucccagcauuuuccauuauaugaagaugaaguuuuaaaaagcucaauuaaaaauuauaacauuaaaugaccaaaucaaucguuucucaaaaugcugcauuuuacuucauaccauuacgcuuucaacaucauccccguguugccuggauagucuguaaacuaaucuuaaugguuucuuaaacaagcagaauuaauuauaaaggaaaucuacccuuccccuaaagccacgcauuacuuccaaaccaaauauauuucuuuuccauacugucucuguuugagugagacuaguuuaaauugcuauucuuucucauuaggcaguuuuucaguuuacuuguucccuaauguuuuuccucaacuuuuuuuuuuuuuacacuucucuaaaucuugcucugccuacuauaguuauuauaaaagauuaauaauaucaagcagugaagcuuauaucaauuguaaaauaauugauacaguucuuuuuuguuuaaauauguuuuaggaagcuuauucucacgcugauauccgucauaucuauuuuuaaacauuuauugaaguucaucuguuaucagugaaccgugugaauaaaaaagacauuguacuguagauuaaucuucucuuauauccauaauuaguaagcaugggacacuugugauuauuuaaacaguauaauaaagacuacagucaucaaaauuaaaauguuucuuuuuaaagaaagcuaaagcuuugcucuuuagucccaaacaaucuguguauuuccugauugcagagucaggaaauacuuaacuuuugaagcaauaaugguuacuccugggaaguuuuauaauuggcugcauagugauaacguggacuuuaauaaauacaaugaaaauaccgccagcuuauuuagaaagagagaacuuagagcuaauacugaggacuacaccaguuuggcaaaaucauugcucuucgugaccaccuccaguuuccagcuggcuuccugaucaaagguaucuuuccuuagugcuuuuucacucuccagauuuucuccuguguuuguucaggucuuugaacaucaguguuugguaguuguagaauuuguuuuauuuugaaaucagguaaaauguaguuuauaaaauguuaauggguuuuuugaaguauguuaaguaacuaugauaaccaauuaaugagaaagaacagcaugacaucaaggaaucuagaagcaauauuuuuuuuuuuuugucuagagugaggaauugcuuuaaugucugagucuugguacuugauucuaaauuguuuuagugaggucacugaagguguaacaacaaaauacuagcuaaagguggcacugugcuuuuucuaaauauaaugagacccuuauuucuguugaauugauuccuguguguuaauggaaauggaucauuuuaacaacuugcacacuacuucagguuuaaucauaaaggugauuuuucccucucuugauuguacauuauccugccuuuauauuggcauuaauccaaaaauuaacucacagaauguggaucucgaugagaccuuaucaaccaucuaucaaguucccccauucacuuugcucuugaggaaguuaucuggcagaggugcaacaacuauucccagaggucuugagcaaaauauuggggauagaauauaaaccugucagucccuaguuugguugagccucuuucaguaucauuguuuuguguuaauagauuaaaugcugccacugaguagaaaucuugccuuaaauugguguguguaaaucgucauuaggcucuguggguuguaggcagauucugagcagcggaauuauuuguagcuacaauauguagcuaggguguguagcuugaggugcucuauaacauuuagagucauucuggaaacauaccgucacuuccuaguuugggugaauggugagcagagugagaagccacugcuuucuauuuuugggugugacagaucucuugagucaccaacgggaauuuacuaaacugucucaguccugaagaauuuauaucagaguucuagguaguuuuucacuccuauauauaugacucuguuugcugucagcauucauucaaguucuucugagcccagaccauuuuccuaguggccacagggaggaauucuaguaagcaacaaaauccccccaacucagucuuucacuuaagagcuuaugguacgaugguacaggagaaagagauauugaaaagauacaacacauauaagaaggauucaaauucguucaacaauauuuguaaauguauguauaaauauaugucaguuaacacuaugcuacaggagaauccuaugauuccaaaauauuguauguauguacaaguacuugauagaaauuuuauuucucuugcauuguuucugaugaaucccuuaaguaaaugcuucaauacaagauuuucaugauucucugaucacucauuuccccgcuauggauauuuuacugugcuuauaugagcagugugccccuucugguguggccuaagugaguagucaggggcuguauaaugcuaguguuuauacucuguguuucacaugaggauaagcaaaaaaaaaaaaaacagagcuguuguuagauuaguuuugcagagucucugcaacccaugucauucaaguugugguuagucauaaccugagaaaagguaguaaagguaacuagaaccaguuuuguguuguaauauuagcaucuuaaauuauuaaagauuaaauuauguacucaguuuagaauucaagaugauaaacuuugcuuauauaaauuggaucacuuacagaauuacauuuagguguugaguuuuuaccuguagucacagggaaggauccugggagacuacagaaauucagccacaaaucaguuuuucauguaaaaacucuugauauggcgguagagaaauucaaaagacuugacacaauuaagguugaauugacuuuaugugcaaucucaauuguagaauggaacucugagguuguauguaaaucauuuaaauauuuguaacaagauaaaauaucugcaguaaaaucagugcuacaggcuauauuucugauuccguacucuguagagacacuuuuggaggcauacuuggguuaaaaauuagaugaaaaguauuuaguggaaaucagacaaaaagauuuuggguuaaaaaucagauuaaaaauauuuaguaaucagaugaaaaguagagagaaagaagagaucauucuccuagggcuuugcccacuagaaucauuuuauuuuuugcagguuugcacgguugagugucagcuagcucacucuccauagcuuuggcccuugccagguaagguaaaucacauacuaaggcaguaagaaaaugaugaaggguugagguugcuagucacauguuagcacagauaccugacuuugucccugagacauggcaaguguucagggugagucacugaagcuauagcauguggauuuuauccuuucauaggaaauacuuggucuagcaagcggaaauucuuguuauuuguaaacuaugaauguucuagcaguauaucccaaauaauuacaacagccccuccuuauccacaguuucagucaccuguggucaucugugguccgaaaauauuaaauggauguggcaauaaacuguuaacaucucugaacucagagaccuugugggaggaaugugccuuguauguuggagaaauagcaaggaggccauuguggcuggagcugaguagaagggaauuuaguaggagauaaacucuaggaaccaauugccaaucaggaaaucuuugaauccaccuacgaucuggaacugcaccgcccccaccaugcacacuccccacccugccccuuugaguucucccaccuuuguggaucgaaccaauguacaucuuacauauacugauugaugucucaugucucccuaacauguagaaaaccaagcuguagcccaaccaccuugggcacauguucucagaaccuccugaggcugugucauggucaugcccuuaaccuuggcaaaauaaacuuuuaaacugauugagaccugucucagauacuuuuugguuuauagaauguaccacauuuuauuuaucucuucacuugcugauggacguuuggauuguucucaguuuuagaguugugaaccagaaaaucugagacaggucucaguuaauuuagaaaguguauuuugccaagguugaggaugcgcaccugugacacagccccaggaaguccugaugacauguccccagggugguuagggcacagcuugguuuuauacacuucaggcagacaugagacaucagucaauauauguaagaaguaccuuggauccgucuggaaaggcgggacaauuugaagcaaaggcaggaagacucaaagcagggagggaguuuuuaggucauaaacaggugcuaugguuacauucuuuugaguuucugauuaaccuuuccaaaggaggcaaucagauaugcaucuaucucagugagcagaggggugacuuugaauagauaggagguagguuugcccuaagcaauuuucagcuugaguuuuccuuagugauuuugggggccuaagauauuuuccuuucacaggguauugggacaaaagugccuuugaauauuuguuuguaggcucuuguguggacauguuuuccagucuuuuaauuuuuaggaguggaaugccuagguaaugaaguaggucuauauuuaacuccuaagaaacugccaaaccauccucuagaguggugugucauuuuauaugucuguguacaauguaugagaguucaguugcucccauguccuugcuggcagucuucuuuuuaucuuagccauucuaagagguauauagugguaucuuauugugguuuuaauuugcauuuucucugauaguuaaugcugaugagggaugucuagguuuuaaucuccucaucaaaaaagguuauuuuguccucaugguuggaacuuugguuccuuucagcugaggcacaaauaacuuuuaaacacaaucaaaagacauauuaugacauaauagguuggcaguggcuuauauaguuucaugguuuuguuucugggagacucauuuaaagugggaaaauauaauccugcuauucaauuucaauuuucauuacauuuuaauuuuaucuugaagucauuuaugucaaauaauguaaguguaugcucugucucguguagugucuauuacuuuguauauuauuuaggaugaaaauacauuccaugugguaauaauugggcuagguaaauguaaauugucucaaaacuuucaacuagaaucaggguuuuaauuuuuucccccagguuccugauguuauuagcagcauaaggcaauuaucuaaagcggccaugaaagaggaugccaaacccagcaaagauaaugaggacgccuuuuacaacucucagaaguucgaaguccuguacuguggaaaggugaccgugacccacaagaaggcccccucaagccucaucgaugacugcauggagaaguucagccugcacgaacagcagcgccugaagauccaaggggagcagcgcgguccggacccaggagaggaccuggcugacuuggaggugguggugcccgggucccccggagacugccugccggaggaggcugacggcaccgacacccaccuuggcuuaccugccggggccagccagccugcccugaccagcucucgggucugcuucccugagcggauuuuggaagauucuggcuuugaugagcagcaggaguuucggucucggugcagcagugucaccggcgugcaacggagaguucacgagggcagccagaaaucccagccgcgacggagacacgcgagcgcacccagucacguccagcccucggacucggagaagaacaggaccaugcucuuccagguacaccugaucggacgcugucugcccuugccccaaaaggugccagauggaaguagcugggcauccaguuccucccagcuccaccucuauauaacgaauaaucuaacuuuuauuuguuuuccccuucaaagcagauaaggcagguggaggaagagugcagaggaaaguagggaaggggggagaggcagacguggaguguggaguauaagaauuaagggaguagggaaggaagaggaggaggaagcaauucguagaacguccuggacaccugguagagagaauaagaaucuauaaccagcauuugccuuggggugauucucaaauaaaugcuuaaaaaaaaauuguaggcccggcgcgggggcucacgccuguaauuccggcaccuugggaggccaagguacgcggauuacuugaggucaggaguuccagaucagccuggccaacauggcaaaaccccgucucuauuaaaaaacaaaaauuagccggauguggugggggcgugccuguaaucccagcuaaucaggugcugaggcgggagaauugcuugaacuggggagucggagguuguagugagcugagauugacccccugcacucgagccugggcgacagagcgagacuccaucucaacaacaacaaaaaaauuguagaaaguaaaucuuuaaagauaugaaucugagagagugcgauuuggcauggagaaacaagggacuuuuuuucuagagaagaaaaaacuccagagacuuguauuuguauuuugagucgaggacacaccaauuuaugcugucacaccaaaagacguuaaagaaacaucauuggccuaaaaauguacugaauuggauacuaaaauaauuugaugcaagcuguaguauugguauaaaagaucauucuuaauucuaaacauuuuugaauguuguacaggguauagaaggugucagguuccgcuuaaaauaacuuaauuccuaacaauacucuguagagagucuuuaauucucagcuugugagauuugaguuuccuuggggggaaagaaaagagugacugucuuuuuuaaaccuauuuuaaagauuuccuaagaaggagauuccggaguauuuugguaaauaguaccgguguguaauaucagaaguuugcuuuaucggaaguucaugaggcuuuuuuucacaaaugauaauauuuuauuauagaaaaagcaucccaaaugcaggauuucauaaacacucguaggugaacaaguacagcuucaaaaguaaauucagaguaaagaggcaacacuuacaaacauuuugccuuaaggagaaaaugugauguucuccugcagaaguaaucccacacagaacacaaauguggcuccauaucaugaaggcaucagauuugcuuucugagcucaguaugcccauuucaacaauugaaaaugauggcaagaaguagcauugaauauauuacuacuugauuaaaaaaaaacacaccccugauuaaaaaaaaaaaauuaagagacagggucucgcucugucauccaggcuggagugcagcagugugaucacagcucacuacagccuugaccccuggaaguucauauuuuuucuuuuuuguugguggugguuuuguuuuuaaugaacucaagguaugucauuaaagccucucuagucuuuggugauguauuaacugaauuuccccuuuucuugggguuaucagauuuguucuuuuuuuaguuagucacaguccuuguuguuaauuuuucugaauggguuauuuucaaagauuuuaauucauuagcccaauuacagauacauccuuuugcugaccauuuagaagaaaguaugauuauaacuuauuuuuuaaaauuacuauuuuuagaaaucaugaagugaggaaaguuugcauauuuuuuaaaaagacaguuguuucuaaucugaaaaauauuuguaucuuauaauaauugaagacuaacuuaauuuucauacguuuuuugacagaggaaagaaacauuuuugaggcagcugauauuugggguuaaaaauauugguuggauuagauguuuaagcacauaugaaauacauauaucugggauauugcauuugaaucuauauuauuaguuuaauauuugguuauaaaguaagauguuagauccuuaugaauugaaauuaauuggaaugcuuuuauuuuuaagguugggcgauuugagauuaaccuuaucaguccagacacuaaaucaguugugcuagaaaagaauuuuaaagauaucuccucuuguucucagguauguaucaaaguauaucauaguaugugaagagaccaaucuuguuucagaauuaacaauaaaauaagugggcuugacccccuucaaauuuuaauuuuuuuugaaauuuaaauuuuuauucuuaaagggaauuugucuuaaacuaagggcuccuggguuuuugucuauggcagcaccaaaauccugcccaggucccuugguaucuauccuaacaguuuguccucauuuuagccaacucuuucucauuguaauaccaucaaaucccuuccagugauggaauuuuugugguggugaguucuuuugaaaauaccuucacaguuaguuccuuggaauguuggccugugggacuuguggguauaacugagucaugcuugcucuuuauaccguaguagguaguaaaaggagaacgaggguuucagcuuauuuuaauguaaauacuaaacuuugaaaauauuuuuguauuuuuguucuuuuauuuguuuuuaauucacaaacuguguauuuaaauguuuuuuaaaauaauacagccaauuauguacaagauuauauuagacauugaagagauuacaagauuaaaaagaacuuuugaagaugucagauagaaggaguaucuaaauguaaauguagggagguuaaaaaaugcaccucuaaggagguuccuggaauugagaauucacuucuuuucugccuggugacuuaacuuaccuucaaggagcuggaucuugccaagguccauauauuuuaauguugaaaagccacgccggccuaucuuguuuucuuuaguuacuaucuuuuuaaagauaauuugaaguuagcauugcuauagguaugauauucagacauucuucccuuugaaguuaacaagacaguuuuuguacuuuuauuuauuuauuuauuuauuuuuggagacagggucuuccucugucauccaggcuggauugcaguggcgugaucauggcucauuacagccuugaccuuuccggcucaagcaauccucccaccuuagccucuccaguagcugggaccacaggcaugugccaccaugccuggguacuuguuauuuuuuuuauuuucuugaauuuuuuguagagacgaggucucauuauguugcccaggcuagucuugaacuccuggccucaagaucuuccugcuuuggccucccaaagugcugggauuaacaagcaugagccaccaugcuggccaguuuuuguacaccuuaauuguuugccucagucucagcuaauacaguucacuucugauauuuuaauauacuuuauauuauauggagacauaaaauuacauuguguagauaaaaauuuucuacucugauaacuuugucagcaguugaaauaaggagaaauauauuguaaauuucuacauuccuacuuaaaggacacagaaauuuuaacugaaaaguauuuauuaagcauucuuguaauuaccaauuuacugguugucccugggagaucguaagugcugugagggcaggugucuaaggcuguggugucauucuguagcacaucagagucagauguacuaagacagagcuuaacccugagguguucaauacauguugaaugaaugagcacuuuacacauggugggccuuaugccaaauacugaagagaaagugaugucugaaccgaagcaguuccuaucccagagcaccagggggcauccucaaaagcugugccucccaccccacacuccucaagccuccuggugagaaaacucgcaaugcucauugggcagcuaaaagaaaaaaaaauagaaagaaaaaagaacuagccaaaccaaaaauuggaaguucagauacaauuucuuguuucuccuuuguauuuuuuuaaagucaagauuugcauucugauauucugguucagaaaaagaaauaaacagaagcaggagggagauuuguggaaagcccugccuuucauugagguaauugucagguuagccaucugcuccucacugaguggcuggcucugcucuuauuacauccuuccauggaacugaacgcauauaauguggcuguuuucaggaacagccugauuuuuaacagugcacaucccaaaugcuucuuucuucaaaaucugucggacuguuugccuggcaagcauggggacuacgggaaugguuuucuuuccuggaaacauugccauugccucaggacucuccgagcuaaugagguccugugaauuuuucccauuuagugcuaagcaaguaaaggguauucuuaagucacuaacaaguuguaccaaauugaggccaguguggcuggaguuggggaggugagaagggaauguuauaggagagaaagccagaggaaagcagaugaggauggaaagaugaaaaucgagguuguguaucuaaaggucauauggggggcugguagucaccgugcaaauuuaaucuguguggaugucauauccauacggauugcuuacuuucaccucaagaauugcagccucucuccucuguacugacuuuuucuuuuuacaggaauugauuuccuuuuucuauuuccauuggauagagcuuauuauaacaaaauaggggcaaccauuuaucaaacauccuaggaauuauauuucuuaguucuaaauccaaacauuccugacaguagaugcuauuacuacuguuuuauaaugagaaauggaugcucagagauaguuaugagcaacccagcgcaauaucacauaucucacaauuaguugaaugaagauuucagcacaaaucugacuucaaagcauguuuuuccuuuucacuuggauuuaggugauuuggggacaacuuuaaauuuuuugccuaccuggcuuaucuaaguacugugcuugcuauuaagguguugucuacuuaccaguauguauacauucagacugaaugaaaaucacagaugauucugauuuuuuuuaaugggauauagggagguuauuuagccuggguccaggaaguacaaugauuugucacuguggauaauuggcaccugcaauaauuucuauaacauaucagucuuuuaaguguggcugcuugagugucuauaaagagacaaacauuccaauaauucuaugcauacuuuagggaauuccauaccaguuaauuugaguauugucaguauuaguuuuucucagauucuuagccucagauaagaacaggguuuaugaugaauaucagacugccgugccaagaagacaguaaacugaaaacuccguuacuugcagacauggaguagcauuuuauuacaagacacaguggaucauaccaucaauguuuuuccuccuguggccuugagucgcagaauguuuaucagaagcaaaacagucugaguuggucucaccuuuuauuuuauguaucaacaggccacugcaugaguuugcuauggcauuauguccccccuucauugcugugaaggagaaauucguagaacugugaaagcaaagaacugauguugcuuuccauauuguugaguaaaaaauauauauucccauacauuuuuauugcacuucuuccccuccaucuaggguauaaagcauguggaucacuuuggcuuuaucugccgggagucuccagagccuggacuuagccaguauauuuguuauguauuccagugugccagcgaaucucugguaaguaguguuauugcugucugccugcuccugcggacacaucugucgaacagaagacuugucucuuaggagcccaagccuugcaauauggcuaucuaugggaaaagaagaaggcgucuagaaauauguuccuccccuucaaagcagcacagcaguagaaaagcaaaaacaaauugucaugguaaaauauaugccuacauacuuuuguggguuuaauaaacccagucauggaaacuugagcuuuuuaaaaggcaggaaaagacuaauaauaggagaaaagcuguuacuuuuuucauugcucauaugagaagauaaggaaggccauugaucuuuuauuuucuuaacugcuauaacauugcagaguagauaaugcuuauaucagcagaacagagagcuauuuugguuuucuucuuuuauuuuauuagccccuucuucauuuuugaaauaucauauacuuuguggucuuacuuuaaccuuaauuuucuucuuuggcauuuaaaagucaauucucuuuaauacuaccccucuccuacucucaacuaaagguaauuggaguucaaggcauuauguccccccuucauugcugugaaggagagauucguagagcugugaaagcagagaacugauguugcuuuccauauugcugauuaaaagauauauucccaucaauuuuguauugcagaguucaagguaauuggaguucauauguaaggcaggcuuggacauauaucugagcggcuaagaaauaaguugauuuuuuuccccucaaaguuuuuacucauucuugcaccuaugccaucuucccaugucauuuuaacacaacccuuuagacauauacaucaccauucuuagaaaaguuuacagaaaauuauuuucuuagacaugugauccucccaccaggauuucucccagggaaacacauacaacuucgucauauagaaaucagucaggcagcauugcccuugugcccuuggugaauaucacaauuaucccugcccgacucucgccuuccacauucccaguguggacacugagguuaggaauaaugaagaaguaggagugaauuuguucaaaggcacuuugugaccagcagccucuggccuucaucuuuuucucuaaaagauagaaaacucccaucacuaacacuuuccuauucuagaggguuccauuugaguuuuguucucccucuaaauaaccacaccuaugcaauauccacauguugauauccagaggcuguugcuaaauggguugcauuuaggacuugagauagaaauuugagauuguccuuguguaaaugacagugaaaggcagguuggauaaacacccgggggaagaaagagaaagaaagccaaagaaaaccgaugaccuaacacuagaaaaugccaaccaaguaacaguuugguagaaagugguauccuaggauguuauuccacacaugccccgcuccccacccauccccuacacgcccacaccucacuccuucucugugucccuccucuacucuaggacugauccuucugucauguucuggauccccccacucugcuaccuuucuaaaaacuaucauauaccccauauguuuuauuuuggaagcaccauuuaccuaacuucucuacuuacaaaugcuaauguaucucuuucacauuuuaugugcaguuguucaucaaauccuauugacugaaagauaagaaugucucuuuucuccauuucucccccauuuccucuuugcuacccgauucuaggcauucaucuucuuuacuugggcccuuguguuaauguccuaacuagucguccugccacuggcuuaaucugccaucucuucauuuucuacauuauguuagaguuuuauuucucacaaaauuuccuccuuggaaccugguguaugccucacuguuaagggacaaaaucuauauuguguagcacacaguggggcucacuucauucucuagccucaucugauguuauucugcacuuagaccggaauacuaugcccuuucaugaccuucuucacauaugucguucgucuuacaagcucuucucugggucagaccacaaagacugcuucgaugguuggugugauacugcuuuuaguuuggcuugcuacugaaacccacacguguugguuaguuccugggaccuaaggacuugagugagaggcugcagcucucugaaggcccacuguggcucacaguaguacagcugaaacucagagguccccauucacugcauggagugaggagugugccaugugagaggaugccagaaccagggcuugcugccuuucauacuguccggcugggaaggaagccaugucagccucaagaaucugccuguuacuaagcaaggagagugugcaaugcuuuaguuaucucuuuuuuuuacugcuuuuaauuuuggaagugaagcaggccuggcucugcccuacuauagucugaguacccuuccgcuucuuuucuacugcauauuuuucaggacccagcuuacauaucacauccuaccgaagccuuucuugacccccuuuuuugcaggaauugccuccuuuaguugugcuauuguuaguucucuuacuauacuuuauuccuaggucucaaacaguucuugccaauccccacacucacuuauuguugcauaaccaccuacucuacuagauugugaguuucacagauuuuggacugucucuuuuacguguugugucauggagguucuaggauagcaggugcuugguacuuuuguauuuugagugauugaaugacugcauuacucugaacuucaggcaaucauuuucuaggugcugguucaucugugaucacuggagaacuugcacuaaaaggaaaaugauguaaaacuuuguuacuucuaaucuuuuuuacagguuuuguuuuguuuuuaguuuucauuuugcccucaugcauguagaaugaguuuuggaaacagggaaucacaguagaaagucugggaacaugcugcauuuuuccaccuagcaugaucugugacuaaggcaacagacuugacuggcugugaaugccuuccuacuacuugaagcugugucagaauccgagguuuggcauaauuauucuuaagaacaggccuaugcuaggaucucucaaaccauguuuaauuuuauugguaagcaucuuaacugaauagugaggcaauagaacugcaagccucaagaaaaaaauuaaacguaaauuuccuucauaauagaggauggcuuaagcagcugauacauagaccaaaacaaaacagucaauuaaauauuaucagucuaagcaguguuaggagugaugugguuuguguaacacaauguauugcaacaccacaccugcugauuuaucuucucugaguaccaagaauacacaauuaacauuuucuuuugcuucuuuguaauaauugcuaugaauuuguaaacaguauaguguucugacgggccuggagggcuuugcuggaaauuuagaugaucaauucuuccuuuucuccugucuuugucucucccaaccuucucccuucuuuccuucucccucucuuuucuuucuuucuuucuuaaaauaguuguuggugagcagcuucaucuuguuuaaccaacccuugagauuuguagaaaauauuauuucuucaaaagugcuuucucuaaaauagguuuaaagaguuugaaaaaaguacagguggacugcuacuuacaaaugaagaaaaaguaaacuccacagaugcagaccaaaauauuuagggaaaguauaaccaaaaggaaaaaaaaagaaaaagacccagcugcccaagacccagaauuuguaugggguuaauaguuaaugaaauaagcaugguauuucauuagaaaugaaauauuagcauauugauagagggaugagauacaaaaucugggaaguuaucuuucucuuacaucugauauugaguauauuuguaaauuuacaucuguaacaauuaaggaucaagcaaagugggaagauagcagguaaagagacagggugagguuuccaaucugcauguuuaaaucaugaggaaaaguugcagauguuucagaaaagagcaguacucugugaaaguuucucaucuaagaaaaauggacauaauuggcaucauucagccuagggacaagaaguauaggucuuagcuucagacauaugagcugucaugugagaauuuacacguaguauaaaaugcgauaaaaugugauaaaugggcuuaaaaucuaacaaauauggagaacacuucaauacaugggugguuaauuagccauugaaguagaccugguuguuaagaauuguuaaaauaggauugaugccaaagacuuggaaccaaccuaaauguccaacaacgguagauuagauuaagaaaauguggcacauauacaccauggaauacuaugcagccauaaaaaaugaugaguucauguuagggacauggaugaaacuggaaaccaucauucucagcaaacuguugcaaggacaaaaaaaccaaacaccgcauguucucacucauaggugggaauugaacaaugagaacacauggacacaggaaggggaacaucacacaccggggacuauugugggguggggggaggggggaaggauagccuuaggagauauaccuaaugcuaaaugacgaguuaaugggugcagcacaccaacauggcgcauguauacauauguaacuaaccugcacguugugcacauguacccuaaaacuuaaaaguauaauaauaauaaaauuaaaaaaaaagauuuuuacaauaaguauauauauacccccccaaaaaaauaggauugaugccauucuuuauuggauaauuuaaaaauuuaaauuuuuuucagagaauuagacuagauaauauuugaaguccuucacauccugugauucuuagacuuauucucaaaugcuauaaaauauguaaguuugauauauaguguaaauguuuaugagcaucgucugcauuauagauuuuccuucuaauuuuguaaauugggcuuuguccuaucuuauguuuuuugcuggaaauuuaauuugcccagugguagugccaaaaauagguacuuucuuucuguugguguaugauugauuuaucuuugcccauuccuuugcuuuuaaccuuuugacaugaccuauaacuuuguugcaguuguaucuagacuaaaauaauuaaguuauucacgguacacuaauuugaacuuuuaguugcacugaucucauaauagaauuuauaggucauuugggaaaagugguagauuuuagaaaauaaaguauuuauaauuuuagaagucaaguaaguuuuuaguaauauuuguguacaggagaaguugguagccacauuucagacaccaugacccagaaauagcaaaaacaucaaaaguucauuauuucuacuagauaccuuuuacaaggcgguauuauuaaaugaugaauaacuuauauggaaaucauuuauauuacuaguagauugcuaaccccuucaguguuuaaaauaaauaagaaacaagaaagaauaaauaaaggaacaucugcacaaauagcuuuugaaugcguuaacaaggcaaaugaaauaaaaaugcaaagguauuaaacauguagugcuuuuauuuucaagaauuagaaauuauuaguuuuugcuuauaguauaaaauaacauuuuaucaaaaauuacuuuuauuaauggaaugauaagaaauucauaagccuuaagguugcugauauaacaaaacguaacugaauaaugacugacugcuugguguuugaucucuucuuucagaaauaguagaagaauagucuguuuauuucaguuuccucauauacugaaauguagaaguagauuacauucuuuaaauaauaauuuauucuuaaaucaggccauaggggaaggggaaaagaauauaaaaaugugcuuaccaagcaugguaaaugguuuggaauaucaaagcuaguucggaugaggcccuuagugcucaaugucucuguuaugcagguuucauaauuugaucuaaguccuacagaauguaggaaaauuacacuuuacauuugugauuguuuccagaaaaggagauacaaccuaaaauugguuuaacaaugcauggggaugagcuguuaguugguuucaaagaagcauccaggaaauaaaaaggcuagauuaaaacuuuuugacugggucauggaggaacaaaaaagaaguuaacugguaguuugcaagcugcuggccuaauggugagacucagcuguuagaugccucuauguaagaccuucuuagugucacaaaucagaaguggaaugauaauauuaauaaaucagaaguuacagggauaagccagcauuagucacagacuuuccccaccauuguuuaaauggaacucauuuuuauccagaacuuuacuuaacacuuuuuguuugcuuuuacacuaaaaguaauccagaaaaguaaauaggauaccuauuaacaaagugaauguuggaccuauuuuguuguuucauauaaguggcagacaaaacuuccaaaaggaucuuuaucugauaaagcauauaauuaaacagaaggauuaacuaauuaaacucucugugacggcauagcccucaaugcaauuugaaaauagcauuaaauuuaaauuaacagagcgguauuauauuacacacauugaaauaaucuuacuucauccagcuuucaauuauauguaugaaacgucuaacuccaagacuuaguauuuucucucggcuaacucucuagucaucaaaauucuauuauuuuuauuuagucagcaucaacaaaggcucacauugcuguugaauguugaauguugccauguaagccaacuuuuauagaccugaguuuuguuucuuccuguagguugaugagguaaugcugacucugaaacaggccuucaguacggcggcugcccugcagagugccaagacgcagauuaaacugugugaggccugcccgaugcacucuuugcauaagcucugugaaaggauugaagguacaguuuaauguggcuuuggcaaaagagaaguuugcuuuggcauuugggaaaugagaaagucccuauugucauugaauaguucuuuguuucgaugugaaacaagaacccaaagaaucauuucucauguccacucaaaugugagugggcugucaaucucugcuaggugcuugacacacacacacacacacacacacacacacacacacacacacucucucucucucucuacucucucuccucucucucucucucauuucugaaggcaaacucaagaagguauuuguauuucccacaguuuuuaagacucugcuaaguacauggugggaacugaccaaauauuuguugaaugaaugaagagagacaaaaccaucacagaaugucaaguguuuauuuaauauuuccccuuuucuccuuuacuugaugaugaguuccuuuucuaaaaauguagaacuuuagugaagccugcuuggcuuuugaaggacauuugucaaugacagagauaauagaggugauaauauaaagcaguuuuuuuuaauauguucugagaaggagugaaggccaugagaaagagaugauccugugacucaacuuccuuuucguuuaucucuuacuaacaacaacacaaaaaagcuugaaaacuacuauacaagacaaaaaacacaauuuaauaaacacuagugaaaugucuacucuggaccaggcaaugugcuaggcacugggggauacagaaaugauugagacauggacuaaucccaagaagcuuacagucuagagugggagacagguguauuagcaauuaaauguaauucauuaugauagguguuauaauagaugggaagagugcaaauuauuaauaaacauagcagagauuggucuagacacuggaaaugcaaaucaugauuucuguucaguaggcagcagaaucauaggcacaaggcagaaucagugaugaauaacaguauucguugaauguuuacacaacuaugugaucaaacacagguuuuuuuuuuguuguuuguuuguuuugaggcacagccuugcucuguugcccaggcuggauuucagugaugugauuaugacucacugcagccucuaccuaccagcuucaagcaauccuccugccucagccuuccaaguaauugggacaacaggugugugccaccacacccagcuaauuuuuuuaaaaaauuuuuuguagagauggggucucacuauguuggucagccugguaucaaacucuuggucucaagcaauccuccuguccuggccucccaaagugcugagauuacaggcaugagccacugugcccagccaaagacuauuucaauguaauaggcuuaaacaauuauaauuguaauauugcagaauguacauuauuuucaaacacauaaagcauuuaaaaaaauggaacauucuuagcugugugauaaaggaagcauguaaaucugugugucaacgggugccagucacucaggagauaguguuggaucaauuagccaucccaaaagggcaaagauugcuuauauucauccugcuuaguaauacaugcuagauggaucaaaguccucaguguaaacaaacaaaauauuaaaaccauuaaaagaaaacaagaagaguauucuuauuucuugaagagagauuuauuaagacacagaaaugcaagaacaaucagaagaagacacugacauauuugauuuuaugaaaauuuaaaguguuuacauagcaguaacuguuuaggaguuauaugaucaguaacaaacaaggagauagcagauuggaauccagaauuuguaagaacuuuaaccuauaagaaaaagauaaaaccacgcaguaggaaauuguguaagucauauugaaaaauacuucucagaaaaggaaauuaaaaguuccaagaauggaaauguaaggaugcugaaccuuacuggaugucagagaaaugaaaauggaaacaacaauaagauacucaucagauuaacuguuggagaaauuguaugguuauguaauacguuuguguaauacugaugggaguguagauugcuacagccauuuuggggggacaguuaauauaaacucauuaaccuaacauugcacauacucuguuaucuagaaguuccaugucuugauaagaaaaacuuuuauguaaguacagaaggugacauuuaaaauguuguguuacuuguaaauaauggaaaauuggaaaugaucuaaaugucgaucaauggcauaauuaguaguauauucacauaaugaagcaguuaauaggaaugaauuugaacuaugugucaacauggaugcaucuuaaaauuguauuguugagugaaaaaauaauuugcuuaauaacauacagcauauauuuauauauauggaaaaguacauaguauaaugccauaaauuuuuuuuuucaaaaacuuugaucuacacuccgucacuuucaggaaggcagucuggcaauuccucaagggucuagagccagaaauaccauuugauccagcaaucccauuacuggguauauacgcaaaggauuauaaaucauucuguucuaaagacacaugcacacguauguuuauugcagcacuauccacacuagcaaagacuuggaaccaacccaaaugcccaucagugauagacuggauaaagaaaauguagcacauauacaccguggaaugcuaugcagccauaaaaaaggaugaguuuauguccuuugcagggacauggaugaagcuggaaaccaucacucucagcaaacuaacacaggaacagaaaaccaaacacugcauguucucacucauaagugggaguugaacaaugagaacacauagacacagggaggggaacaucacaugccgggggccugucaaggggugggggucuaggggagggauaacauuacuagaaauaccuaauguagaugacagguugaugggugcaccauggcacguauauaccuguguaacaaaccugcacauucugcacauguaucccaaaacuuaguauauaaaaaaaacaaaacuuugaucuacuuuuagauuuacagaaaaguugcagagaguuuccaaauauuccuuacccgucuuuucccauuguuuauaaguaauauuuuccuccuuaaauuuuauuuuucaaaccauacacuguaaaauaaauuaguucuguguaggcaaaguuaaaaacauaggaguaaagaaacaacuuuguauuucuguuuuuaaaauuauuuaaacagacucuagguguguuuuaaaauaugcuuucuaauacaaaacagaaguuuuaaauucucauaaaaguaggcagucuuugucagaagcuggcucuaaaccuauaggggagcuaucacuuauacaaaggacuccguguagacauauagcuggaucuugauuuucuggagacugaaguuuuuauaguuuuaaauaucuuuuuuuuuuuuuuguauuuucuuagagacgggguuucaccauguugcccaggcuggucucaaacuccugagcucaggcaauccgcccgccuuggccucccaaagugcuaggauuacaguugugagccacugugcccggccaguuuuagauaccuuuuuaaagaaaaagaaaaguaauaaacaauuaugaauucagaauuguuagggcccuucccaaaaucucgaagggacucugaaacuuaagcuuuaugcacuucaaggcaugcauguaucugaagggaguaaaaagaaggacuugugagucacucaggguuguuuuccuaagucccuggaucacacucucugauaggauuuuuuccuuccuccuuuuuauguugaguaaagauagcaguaagacagcacaguacucugauauuaauaguaagaacaaagguaguaacaguaaggcagauccucuguaggccucuccaugugcgaggcacuauuguguuucacauguauuagcccauuccauccauaugaaaaaaacugaaucucuuuuacacaugaagcagcugagacacugagacccguagugggguaauaacugcuguauucacuuugcuuagaaggggcagagccaggauuuggacuugccuaauuggcuuccaaagcaccuggauaccuuuucucuaagagaguauccaaaggcagggacccucagggccuggaagccuccugguaucuguguguuuuccaaacaguuacuuucauuuaaguaagauaacuguuaauucuaaguuuguuuuaugcuuagguacaaaguacaaagcuggaagaaggaucacauuuagauaaacacaaauuaauaaaaguauuguuagugaggaagauauuuuaaaaaaccagauaguaguauuuuauuucacucauucagaauuguaguauucuugucaauacauuuagcugcauugaguucuauuuuuaaugacaaaaauaagauaaaaauaaaguagauaaguauguguaugugagccuucaucgucuguccuuguguucacucuuacuguuuaucccaggaggaacagucagccaucucuguggacugaagugaauugaggggguggcaucgaaggggaaugcuguuucccaaggaccaaaccucagaaugugaaucugaaaagugaugcugaguaucaccgagauagaccgauuauccuaauguugguuuccuacauuaacaugcauaguggauaauauacaugcuuucaauaucaguaauucgccagucagugauuccaguugcugggaggaaggaaguccaaucagauucauggaagagggagcauguauaguuugaaagaaauaaacuccagccaauuccaauucuuugacuaacauagaggacuaaagaaacuuccuaguuuaugaauuuaguuacauacuucaaauaacuaccuucuuuauuuuucuuuuccucuuuucaaucuuuuaucuuccauguuagucacuugaguaauaaacaacaggaaacaaaacaaaaacaaucaugugaaucauuaucauaauauguugucuaagccucugaaggagacuuucccagcaaauaauaaauugugauaguggccgggcacgguggcuaacgccuguaaucccagcacuuugggaggccgaggcagguggaucaccugaggucaggaggucaggaguucaggcccagccucuccaaaauggugaaacuccgucucuacuaaaaauacaaaaauuagcugggcaugguggugggcaccuguaaucccagcuacuugggagguugaggcaugagaaucacuugaacccaggaggcagagguugcagugagcugagaucacgccauugcauuccagccuaggugacgagagugaaacucugccucaaaaaauaaaauaaaauaaaguaaaauaaaauaaaaauaaacacaaaacagggcacgguggcucauguaaucccagcacuuugggaggccgaggugggcagaucaccugaggucaggaguuggagcccagccugaccaacguggagaaacaccgucuuuacuaaaaauacaaaaguagcugggugugguggcgcaugccuguaauccuagcuacucggaaggcugaggcaggagaauugcuugaaccuggaggaggaaguugcggugagucgagaucgcgccauugcacuccagcccgggcaacgagagcgaaacuccaucucaaauaaauaaaauaaaauaaaauaaaauaaacugugauagugaguggugucauaccaucaaaaugaauuuaguuuucugucugugaucaccaagacuugcaccgaauuuugcuguacauugcacaaagaaauguggaguggaguuuuuggaaacuuuuccucuaguucucauucaguacugcacagugguuuaaagcaggccugguggccguguggcugcaguauggcaguacugugugcuuucuggcaagugugaagugaauucuagaucuuuuaaaacaauguguauuuucaggugauccuccuguauacuaucuguagagaucuugauaguuauuuaauuuuaaaaaguagcucaaaucuauuaaaucaguuuacuucaguugccuggcaccucauauuuucuuagaaaugaauacaaugagaaaagugcacaauguacuuauagacuaauacauuauuuuaaaauucugugaugcaacuuagcggaacaaauuauaaguauuuucggccaauuacuuugucuuauucuuuguaaauaaauacaaagaauacauggaaaacauucaaauuaugucauaacaucauguaauauauuuaguuauaaccugagaaugauagcaaaggcagccuuauaauaacaaaugauuuuaaaaugccagccuaccuauaagguuuauuaaauauuauauauauccagaauauauauauauauucucuucauaaucaaaauauaguagcaauacucuaaguggaaccuaacuguaaugaaaaucugcucuuuuucuuugaaucuucuuuugaagaaagagaaaucuguucuuuaaaaaugaauggucuguugaauuacugcaaauaugaauuaaacuuucuuuuuuaaaaaaaaauuuaaaaacaaccuucucaugaaaaaagauuuucccaaggacuuaauauaaauuauguguaagaaugggauagguuugugaauaucaugauauaaagaaguaaaugauuucuugauaaaauaauaacauugaaaguucacuaaauacuaaugcuauccuuaaaacuuuauucucacagaacaagagcugcaucggggaagagaucucugucaaagccguagucuugccuuuuaauauuauuacuuguucuuucuucuuuaaaugucaaguuguaaacuuaaaauuuuuggccaaggcuagucuuuagcuuuuauuuccaugugaggucuuagguuaauguuaaaucaucugugaguuucuacuguggcuguuuguuaguguaaagugguaucugguugugcucaguaucgcuuagaaauucauuguuaguaauuuuuguuguuguuguuuugagauggagucucacuuugucgcccaggcuggagugcaguggcucgaucuuggcucacugcaaccucugccucccauguucaagugagucuccugccucgccuccugaguagcugggauuacaggcccccgccaccauggcuggcuaauuuuuguauuuuuaguagagacaggguguaaaagaacuagaauuugcuucaugcuugucagaacgcacacaguccugccauacuguggccacacugucaccaggccuguuuuaaaccacugugcaguacugaaugagaacuagaggaaaaguuucugaaaacuccucuccaccucccaaaguguugggauuacaggcgcgagccacugugcccggcccguuguuaguaauuguaaugccaagaucacuacugggggcuguugauuuugguggagagguuuuucaucuaguuuuaaucauuucaauguaguauuccaagguuucuuguaggcaggaacacgucuccuugagaagauuuaaguucagagccugcuugggaagaggugaaguguaaugcauucucugccccuggaucucugcugcuagacucuguuuaauaccuucccucaucauuuuccuuaggucucuacccaccaagagccaagcuggugauacagaggcaucucucaucacugacagauaaugagcaagcugacaucuuugaaagaguucagguaacauuauuuguaggucucauaaauaagacauaaggaaugagaauuggauccuguuuuuaugcguuccuguuuucauucugcugccuagagcuaaagaugcaugaccuagaguacuacuggauagaauagaaugccauuuuacuuuugcuucugagcgaaguuaaaacucuuagcuuuauuuacguuugucugcccgacagaauaaaaggagggaagugguguugccauaguguucuuuugguuugucuguugaacagaaaaugaagccagucagugaccaggaagaaaaugaacuugugauuuuacaccugaggcagcugugugaagccaagcagaagacacacgugcacaucggggaaggcccuucugugagaagauauuuccuacuucaccuacuuuuguuguuguuuaauaauuuuguuaauucuucccuuuguacucucagguucuuuagggcuaaaguccuaucagaguuuccugaacuacccccucacucccccgcccagcauuuuaauaguuuuauagguuuuuuuguuuuuuguuuuuaagacggaguuucacacuuguugcccaggcuggagugcaauggcacgaucuuggcucacugcaaccuccgccucccggguucaagcgauucuucugccucagcuucccggguagcugggacuacaggcaugcaccaccacacccggcuaauuuuguauuuuuaguagagacgggguuucuccauguuggucaggcuggucacgaacucccaacuucaggugauccccccgccucggccucccaaagugcugggauuacaggcaugagccacugcacccggccauuuuauagggaauuugagcaggcacugacacauugagcuaaacuaaugauggucuuaaaauguaaaagaauuuguggguuuugguuaaaaaaaagcauuaauaguacauguucgugauuuagaaugaacauacauuauuuuuaguuauauuaaucuauuauuuuauuuccaauucauaugaacauuuuauuucaucgaaacuggagauagcccaaauggugaaacagcaguaauaucauguaaaugguacccuagcugcaaacugagggaugguauuuuugugcauguggucuagaauuuauccucugcugcauauagaagaagcaggaccaccagccguaacaucaaaggggauugugaaauauuuacucuugauaacacuaauucagguuauaucuuuauuucacuauauucagaacaaaucacauauuguuaguacacaguccuucauuuagucacagaacaagcauuucuugagaaccuucuaugaguuaaacuaugugauggaaaaaggugacaaaaaaaccugaugaaugaaucauguccucuccagagaauagcucaaauauuugaaaggggaaugcaaacagaucaauagauacauagaauaaagucaauaaguggcuuuaaaaaagaaucuguagugagcacaaaaguagcugugucuuugcuuuggagcuggaguagagaguaagagaagaggagauucaagaggaaggacauuuugagggaguuggaauuuuaggagagauaaacuuugcugucagaacaguugaggaacuguacuuuuugggccgggugugguggcucacgccugugaucccagcacuuugggaggcugaggcuggugaaucacgaggucaggaguuuagagucuggccaacauagugaaaccccgucucuacuaaaaauacaaaaacaauuagccggugugguggugugugccuguaaucccagcuacucaggaagcugaggcaggagaagcacgugaaccugggagguggagguugcagugagccaagaucaugccauugcacuccccaggcgacaggagacuccgucucaaaaaaaaaaaagaacauugagcacaaaguuauguaguagugugcccaaacuuacuccaugcaggcacuggaauuaggugcugguuuugagguugugcuuggggauuggugggggaaacaaggcugggaugauaggcagaaugagaugaggaagggccuuaaguuacuggcaggccugacuuugucauggaaggauuucaaguaagggagugagaagaucagauuugcaccacaaagagaaaauucugcuguucuucugaugguagauuuauuuaugggggagguugcuugguugaggggguuaggacuaagucauauucuccaguugggagaauguuuuaauagaauaugugauaagugauuuaauuauugcacaaaucuuuaucgaguacagacuguacuaggaaacagugaugaauaauggcgacccuucccugccaucuaacuguuuaggaggagaaaccaaugugaaaccaaauacauuaaaauaugaugugauugguauaaugauguaugcacaaguuagagguagcauugguacauaaauagcuugaauaauucgucuugaagcauuuauuugacucagagaggccaagcuagagcccuagagaaguggggaaggaacugagugaagagcuauuuaggcggcauaaucauuaggacuuagugacuggcuggaagaaucuguaaaggaagggagagggaguugcugugaacaacgucaggguuucccguguggggaaauuugaugaaacagagccgggaaauaaagaaagcagacgagaguggggcaggggaugagaauaaaaaauaagaauucaauuuggaaauguguuugagauucaauuagaaaaauggauuuggugcccauagaggaauuugaggugaugaguaaggagguugauacauuuggugccuauagaggaauuugaguauaaauauggaagacaugagcuuuguuguggaccugaaguuaaaggaggauguucacgagaugugcauuucuuugugauggagaaaucacaaagaaaugaucauacaggaggagauuuuaacaauauuuucauguuuucuugcucguagcuaagcuucugccuccaucacgcucuccuuuccuucauuuccuuccauuuauucaacugguauuuacugagcaguuacuaugugucagauauuugcuaagugcccauacaguuuuuguauuuuugucacauuuguuuaucuggaagccuuagaauaaugaaugaucccagugcuuuauacacacccugagcccuguccagcccacauguauacccauuguuuuuuuuuuccucuccuuuccuuucuugguggggccuuucuugcaucuguaacuucuuaacugauuugauggagcuggugcuagugugggcccuuauugccuccuacauagacugugcugaagccucgaguucaguuugauguuucagucugauuuuccugucuuuuagauguguuuuugaacacuucuuuuugauaacucucccuaaaacauuacauucacagggauuucccucagcuuauaaauuuggauugcuaauucuuccuauuuaccuggcacuuaagaacauucaagguuuuauuuuccagccugaguuucucguguuaccuucuacugcucccuucuauuaggcaggugcagaaguaauugcaguuuuugccauuaaaaguaauggcaagcaauauuuuaacuaaauacaugcccugacuuucucucccuuaagcaauccacccuuuaggauuuugccaacaagcauccccaguucuggggaagucuucaucccuuucuucccgccugucugaauccuguguauucuuuucuuccuguuuagacccacagccaaucuuccugcuuugguauuugauacuuacacgugcuuuguguugcuauucccuccccaagcaaaucauaagguuucucgcuugaaaguuuuuugcuacuaaggaccaugugauauacauaguagcugcuuacuucaauggauaaaauacauagagaaccuaauauaguggacacaucauagauucucacccaguuugguucuauacuugugaucuaagacauaaaugacccacucacgaaugaaaauggaauuauaacagaggcauuaccagaauccaguuuuguuuggaaaaugcuuuguucuuuggaacuuguguucuguguuuuucuugguaauuuggauauaaaguauacaucuuggaaagggaugguuauagauguuaaucagaguagcaguaguaaaaauugacauaucaaguauaauuuuugcuaaaugcaguaggaguguauucauggaaaggaaaggcaugaaggaaauauuuuacaucugucuuuuuauuacauacaauaugaaaaauuaaaccccuuuccuuauaagcauuauguucacagugugggaccuaaauuauuacuuauuaauagagcuacugaagaauucuuguguuuuuuaauagcuuagucuuaagccuauaauuaaaguuucauuuaaccuugaguauuuccaaacuaaaauguaucuguuuuucuuuuuuuagacuauuucaaauaguacaaucccagaaaaugcaacaagcaguggaagguucaaacuugacauucugaaaaauaaagcuaagagauccuuaacuagcucccuggaaaauaucuucucaaggguaagauugcaccaauggucuuucaaguaugcauaucuguguuuucuaacaguuuagcuucagucucaacaggcucacugauuuccuuaaaacaaaaaacaaacaaaaaaaaaaccuaagauaacuuuuaaaaauuauuuaacaaaaggaucuuuuuuucuuuuguuuuuuuguuuuuuugagauggauuucacucuugucacccagauuggagugcaguggugagaucucagcucacugcaaccucugccuccugcauucaagcgauucuccugccucagccucucgaguaguggagaucucccgccucagacucuugaguaaggcagagauuacagguguacaucaccauguccggcuaauuuuuguauuuuuaguagagacagguuuuuaccauguuggucaggcuguucucaaacuccugaccucaagugauucaccugccuuggccucccaaagugcuggcauuacaggugugagccaccauccaugcccagcucaaaaugaucuuuuuuuuuuuuccuugagacgaagucuugcucugucaccaugcuggagugcaguggugcgaucucagcuuacugcaaucucugucuccuggguucaagcgauucuucugccucagccuccugaguagcugggacuacaggugcgcgccaccacgccuggcuaauuuuuguauuuuugguagagacaggguuucaccauguuagccaggauggucucgaucucuugaccuugugauccacccacgucggccucccaaagugcugggauuacaggugugagccaccgcaccuggcccaaaaugaucuuucaaaauaaguuugcuucucagaucgagauuuauucuggggccuuuauuugaauucgagcaauagauauuuaguaguagaaauauauauguauagaaaaggggaaauagaauacugaugcucaauacuauaagaacuuuaaaaaucauuucccauagaaaguuauaaagaaauucuucuuuugcccauuguauuaguucauuuucgcauugcuauaaagaaauaccugaaacuggguaacuuguaaagaaaagagguuucauugacucacgguucugcagguuauacaggaagcauaguggcuucugcuucuggagagaccucaggaagcuuccaaucaugguggaaggcaaagggggagugagacaucucacauggugggaucaggaacaagagagagagaaugaggaggugcugcauacuuuuaaacaaccagaucucaugagaacucaguaucaugagaacagcaccaaguggauggugcuaaaccauuccuaagaaauccaucccugugauccggucaccucccaccaggccgaccuccaacauugggaauuacaaucugacaugagauuugggcggauccaaaccauaucaccgauucuuaggaacuuagaggaagugcugaaaaaaguauaaauuaauggaaauuuauguauuccauuuaguaaguauauauauuccauuuuaaaauaagcaaaaugguuccccuucaacuucauuuuccucuuccugaacaauucugccuuagagcuauuaggugaggucaagcuacguggguguucugggcuguggcaugggggacccacuguggcucagagcagggagacuguccauaugggguguggaauguggggauggcccgaugcagggugugggagccucuugcaguaaggagggaaucugcagagaaggggaaccugguuugggagguuguaggaggcagcauacuggcagagggaaggcccagugcgggugucagagccacaguggaggggagcgagcauucacagggaugggugccuaagcaggcugaggaugugcacguguugggguggcagccccagcagggaguggcacagccugggugggaugaggacagugucugugcaguggccauuguggagauggguuauauauacacagggacugaagaaguaaguaaaugucuuaaggauagugggguccagggaggaagaaauuacuaauaugaaaaggguagaaauuagaaugaacccuguguuggauucaacuuggagguaucacacuaaagaacuuacucauguaaccagauaacaccuguuccugccuggccgacaugguaaaaccccgucucuacuaaaaauacaaaaaaaugagccgggugugguguugcgugccuguaaucccagcuacucaggaggcugaggcacgagaaucacuggaacccagcaggcagggguugcagugagcugagaucaugccacuguacuccagccugggagacagagugagacccugucuaaacaaacaaacaaacaaacaaaaaaccaccuguuccccaauaaccuauggaaauaaaaaaauuacaaaaauaaaacuuggagguaucaauauaaaaucaugaauuuuauauacauguaaauauagacauauuauauauacaaucauauagaaauauauauguaaauauaaaaaauguaaauguaaacauaaguauauauguauauguuccuacuagacagaaccaagauucugagaaacauggcuaauuucaguacugcaggaaaaguaugaucccagaacaucuugguguuuuagauaguaggaaaauauucaaagaaaaauggugacgugucauaaagacauaaaaaccuugaaagggcucccacugggacaauaugagcguugacauaaaugauagcaacagauaaucuaaccuguugcauaaaauaggcaacuauuuucugauacaaaaaauaaaugaauauauugaaaguuuuaucauaaauaagauauuugcuguauguaauuaauauuuauuaauuacuaaugggaaaauaacuuuacaauggagaaggcuggcaggcaccaccaagugaucaaauugaacaucaucagcagugggacaaauugcagcccugugccaccugauaugaagaaacagaacugcuucugugguauuccugucaaauaggcagugcuugaaucuaaucaaggggaaaugucaacaaacccaaauugagguggagucuacaaaauaacaagccuguuaucuucaagaaagucaagaacagguugaggaauaacuccagacugaaggacccuaaagaaacacaaaaacaaguggaaugggagauugugaauuggauccuuuugcccuaaaagccauuauugggacaaccaaugcaauuggagugaagucugaagauucaauaguauuacuguaucaaugucaguauccugguuuugaaaguuguauuuuaguuauauuggagaauguccuuuuuuauagaaaauacacaguaaaguauuucagggugguggagcuuuauauugguaacuuacuugaaaaucguuguggggaaaaaaaauuuuuguacuguacuuauaacuugccucugcauuugagauggcuucaaaaugaaaaaagagaaacaaagugaucguuuuaaaccugcuuaucacacaugccucacaaagcccacccaggguguuuuuuuaaauuuauuuuuucugcuugcuguuuucauguguuaaugaauagcucagguuauuaauggaucacaaguacugccauuguacagucaucaauaagggcucuuuucuguacccagcacacugccugugaaaaccaaguaguaagacugguugggugguagguguuuuaacuccugugaacaaaguuucaaaagguacccuugaugacuuuuuaaagucucuuggccuuuauguuaauacacaaagaaaaauuucaccuucaguguauaagugucuuccuuagugaucucucagugccuuuaaagaggcaaaugagugguaaaaauucuuagacuuugagaggaacuuugaauuaaccauugaacucuauuugcaaauguguauuguuuuuaaaaacauuauuuccaccuguuuaaccuuaguagcauuauaagaauauguuuaguuaaauaguuggauacauuuugauuuuuuccaugcuugugcaauagagcauuaggacacaguaacuucugauaucccguguuccuaguuuuguuucuuuguuauggcucaaaauacuuuucuaguuauuucucuuaaugauagagauccuucuaacuuuaacagaagcccugcagcaagcaugaucaauugugaaugccauuauuuuaucaguggaaaacugaaucucagaaaagaguaucuaggagauuugucagaaguaugccaaugcaaauuucauaaaauaugccuuuuuccuucaaaauuuauaaauuaguaaaauccugguccucaccccagaccuacuuaaucagaaacucucggggugggguccaguaauuuggguuucaacaagccuuccaggugaggcugaugcaauuacacuuacuuaaggcacguguaauucuuaaagcaccagcaucagaaacagcaucagcuaccugaauugaacacaguguuuagugaaaauuuuagcagaaaagaccauuuaaguaggugucaggguaccugaauguaaucccuggcccuagccgauuuuauauuuaugaucuuggaugaauuauuugccuuuucuaagccauaguuuucccauuugugaaauggauauauuaacacccacuugccucauguaauugugaggauuaaauguuaguguguuagggaaauaucacaucauagauaggaggugguauauucaguaguaagcucaaaaccucugucauuuacaaaauggcaaaggguauuuaggguguuccuuuaucuccauuuaguaccuuggcauccugcauaauacuugcagugccaacuuugaagucuuuuuugcaugccuucaauugcuguaaugacauuuucagcaagggcacagccaaucuguuuugaucaagguggauacuguagcuuuuguuucccagagugaugccaaaugacauaaauuuugcgaccuaacaaggucuugcuuguaccgugugcaacagauugcacuuuuugggcagguuggcagcuccccauguuguauuaaagguuacauagcaaaagggguuuuguauacuucuaaaacuugucuuuuuuuuuuuuuuuccugcugaguuguauaguagaaaauucacacuccaguuuuggaguuuagcucauaauugcugccauuuuuaaacaucaaaauauuuuauuuagcuaacuauaguuguuuaugaaauaggauccauuuuuuaaaugcaaagaaacucagcucauuaaccacuaaaaagcgaguccaagggaaagggccugacacaugaauuagcaaaucacaauguaguaaaacagaaaaagcugucuguucaaaggugaaaaucagaaucauguaauggcuaucuguugcuuuuauuuuuucaguuguuuuccaaaacagaaauauuuacuaauauaaauuuuauuuuauuuuuuugagauagggucuugcucugucacccaggcuggacugcaguggugugaucauagcucacugcagccucgaacuccugggcucaaacagucuucccgccuuagccucccaaguagcuaggaccauggucacauuccaccaagccuggcuaauuuuauuuuuauuuuuuuuuguacagacagggucuuaucauguugcccaggcuggucucgaacuccuggggucaagcaauccucccaccucagcuuccuaaagugcuaggauuacaggcaugagccaccaugccaagccaauauuuacuaauauaaagugcaaguuauuuuaaaaauaguacucauuuucuacuuucuucagaguaauauccauugucuuuacuuguugaaaugugugaagugguagaguauaauuuuaaaguaacuuuguuuuucuuugugcacaaaaaaagcuuguguggguaaaacaccacuaugaguaaaauaggugauuucaguuguuuuucuaguaauaggaaugguuugauacccaucugacuacuuugucuguuaagaccaaauaaccugucugagauaaccaggcaggugggcguguaaguagcgcuaaaaauaacagcaaucucaucuuuacuauauuuuccucuuggcuacacacacuaacccaauaauuuauuagccacaaauagaguuuuuguuauuggaaggaugccaauuauaacauagaacugaagaacugaaaagaauuugaugagguucuaggacauuuacaaaauuccauguaaccuguguaggcuaauuagcuuuauuuguaauucucuuuuucacagagcuuuaguuuagggauguaguaguaacagcucaggagcuucacuuuacaauugugcuuccugugucaaaauugcugcccuuucuuuuaacuagcuguguaaacuugggcaauguaaucuaucagaacuucagucucuauaucugugaagacgggcuaaauaaccauacuuaccucacaacugguaugaggauuaagugagcuaaugcaguguaaaauccuuaacguaguauauggcacaugauaagcguucaauaauauuaggugcagcuauuaauuuuauuauuguuuuaguuauccuauaguaagccauuggagauaaagcuauaauauaugcagauaagaauaaauauugcuuuacgaaacaagauaggaugucauaaauaaaacacagucaucugaaaagaagaaagaacuguuuaaacuuucugauaguagauguaaaaagaaaaauucaagagaaggcuaggaaacuagaguugaaaaaaggccuuucagaaaauggagcaaacuucaaagaaauggaaaauaggagaacaagguaaaaaguuaaaggauuaguccagaaccaaacaguaggaguuccaguaagaaaaaaugccugcaaggaaauuuuuaaagaaauaauuuuaaaaauuucucagagcuaaagagcgugaguuuccagauuuagugaacucagaaagugcacaacagagugacuguguaaaagucaugcuaaggcacgucguugugaaauuucacaaugccaaagggcaaacuuagauucuguuccaaagagaaacagcaggucagacacacaggcucuagaaucacaauggcuuuagacuucugaaacaaaggacauuugagcaaugcuaagauauuuggaagcaaaauuucuaacuacuacaauauacgauauccagccgaacuauuagugaaauacaagcauagaauaaugacauuuauggacauguacauuuuuuaaaaaauuuaguucccacucucccuuucucagaaagcacccggagaaugugccucacccaaaugaggaauuaaacuaaaaaaggagaagacaugggaccaaggaagcagaaauuccaacagaggagagagucaaaggaaauuucuagguugauagugaaggaaaauccugggaagcuuuguagagcaagccuauauuguaacauguccagauuggggcagaaacacagaggucuccauaaugguagcuuaaaaaaacaagcgggggagagagagagagagaaagagagagaggagaggagacgugaggggagggaaggggaggggaggguaauugaugguugguguggugauguuugaccauauugugaacuguaggagaguuuuguaauauauucguguuugcugaaguagucacuaacuccaugaaaaacaaaauauauaagauaugagguguaagcagacauaaucauaguaaaauaugucgcucagcugcaaacaauacuuacaguccuaauaaucuaagcacaaaguacugauuuaaccaaaauucgugauguaacuauauugaaggaagaggggaagaaagguguguguggggguuggggggagguggaacuggguauauaaugagguaagaauauuaaauuucaucuuccagaguuaggaagucaauagauacuuccuaaaauggaaagcuuaaggaacgguaggauaagcugaauaccagaaauaucaauauaaauaauuucaagguucgcuuuuggggagugggauucagagugcaagagaggggguugaugaccaccacuuuucauuauaaacuugauagcacaguuucacuuuugaaacuuugugcugauauuacuuugauuaaaaauuaaaaugaaaugcaaccccuuacccccgacccccaaauaaaccuaagaauguuugcagacagagucgaagccuggaaaguacuaugcaaauguuaugcauuguuaaaaaauuucgcagggucacugucacauggaucugacugguguuuccacucauucuuuuuuagaacuucgccacaugcucuagaguuguguggaacuccucagucuguguuuugucuuuuaagaccuuguagaugaugagguucccaaccugacuuguauccucuuuccuucuauaguuggccucaguuucuuccuauuuaaagugaggggggaacagaaagaauaaucucuuagguucuuaggucucuuagaucuuaggugaucucuuagaucucuuucugagaucauuuauaaaauccacaccaaaggacuaugugaaaaaaaauugauaaccaauucaccaguauugaagcagacugauaucuagucuuccagaauuaaaugauuucuugaaauaguuuggcauuauggaauaaugaaugaugcaaaaccgauaaauuuuagaaugugguuuucuuuuccaugugguuuuuaacugauguuuauuauaauccuauaaaugaauuaugauguuuugaucuagguuguauguauuaagucauuuucugcauagcuuuucugguuuguuuugcuguaucuuccauauuugaaucugagacagaguuaauuggggcccucacugaacuuauggaugaauaacguguaaucuuguaaccaaacuaacuucaaaaagcuuggucugaguaucuaguuaucuaacggcugauuuaaaaauaauggaaauagaucagaaauaguuauuuuuacugugcuguaaugacuauuaauaaagccaacaaauuuaagugaaccacaaaaugaucaauuuaaugcuaacauuaagagaccaccuggaacuaccuuuuauaguuuugaaguaaaauuuuaaaucacacgaagcacuuaauuuuauucuuuucacucagggagcuaacagaaugagaggucggcuuggaaguguggacaguuuugaacgguccaacagucuugcuucagagaagguaucuaacuagagcuuguuuacacuaauugcaacuuaacaaagucagcaccgauaugguaauaugcaugcuccauuuuuuauuaugaaugcuuuauagcuuuuuaaaaaauaaauauuugagacuuuauuauuuuaacuaagaagauucuaggcauuagcauguagcuucuuauucccuuacaggcuaacugugcucuguuaggcuuuuuauuguuuggagauaguaugcuuuggacaacaguauuugagcaacuauugauccaaugccuuauaaaaaaugagccauauauuaguaauuauauacuuguacagugauuuuauuuguucccuucccguguuauuuuccccccucauuuuuuaaaaaucauuuuagcugcaacacugggaucuucuuuaucucauugacaacucucgguagguuggguuuccuguuuccugcguagugcaguaugucaccugaggcacaugcagccuauuuuuuaaaauggaaauauauuaaaauauuucuguuaaacuuucuguugauggaaguggggacuuaguccagcuaugagucuauuaucacuaacccauguuuaucaagcuaaauauuucuacaguggugccuguucuggaaaguuuuaacagcauaccugucuaaauugagagauuuaugauuucuacccaugcaauaugagaugcauuccagcauagcucgguuuucauucauuuccuguuuuucauguguuuuaaaagaaauuuaccucagggaacauguaauugaauagaaacauccacggugagggaagauacuuaacagacuuuauuuuccggaaggcuuugccaugagacuuggacacuuaggcauuguaauacuguuuuggcaguacaggaagcaugcaauugauaugucacggaagccaggagauacggaaacacagacuccacccucuuuuggucaugaucuuuuuuucaucucucuggcaacagugagagaaguacaguagcucuagcguuucaucacaaagugucaggggagagaauagcuuucacuuuuuugucaucccucucacuuucuggccugucuuuacggaugcugucuuacagcugcuuauccaaagauaaguggguuguggugauacugauuacagcugcuuaucagaagauaauggguuguagugauacugauuagccuacggcauaaauuaaguaaaagggggaggaaaaacaguuuugucaugacucaggaggaagaugaggcacacugucacuuuugagcucuguguuuuggcaggucugccaugacccacgugggaaauaaagggcucccuuccgcuuguguuucaggacuacucaccaggggauucuccaccagggacaccgccagcguccccaccguccucagcuuggcaaacguuucccgaagaggauuccgacuccccgcaguuucgaagacgggcacacacguucagccacccaccuucaagcacaaagagaaagcugaauuugcaggaugggagggcucagggugugcguuccccucugcugaggcagagcuccagugaacagugcaggugagucugacccucuccagaaugagaccuagauucucaaggcacacaguuuugauuacucuggagucaagguggauugugaauuuaugcuguagccaacuuuuaguuuugagaaacaccauaaaaacaaauuaaguuaccucauuuacuaggcgaaacaggcaagguuaaggcauacacaaaaagaagaguuaauucguuuggguggaaacucuuuuguuuuuccuuucagaaaaauagaaaaaacaagauaaccaugcaguuguuuugucugaaaaccugcugauaacacguuacgcagugucuugaugaugauucuagagaaacaaagucagcagauuugaaaauaacauagcauuagaacuuccuguuagcuuaugauaaaauaccaggguuuuaaaagucaccuaaguuacuuucauacaugagauaauauuuggcuauauuuuguuacauaauaaauuaaagcugaauaugaaaauuguuauaaauuguaucuagaauaaggugauauguauaaagaagaguauauauaccauaauugacaggcaguguccacuuagaaaagaucuuacacaguauuuaaaacauaauuuaacaaaaaguugcuugauauuuggugagaaacaguaaagaggauaaacuuggaaugauuuucuucuuucuguguaacacagaucaaauuuauaucuuagaacucauuuuguuucucuucuuuaccuaugaauuuguuacggaaaauaggguuaaguaaagaugcucguuggagagaaaaaaaaaaacacaacucgauguaaaaggagaaggcuaauuuuuauaucguguguuacaaaauuugccugcauuucuucuaaggauacaguuuuauuuucauuguuguuuucugaaugacucgaaauuuaaaaaugagauauuuuaugauacaaaaaauaaaguuaacagaguucauuauucucagauuuuuuugcuguguguguaaaggauauuaaguagucauauguauaucaagauauuuaaaugaucacuucauauauauuuacucaaggcaauagaacucuuuuuuuuuccaggaaaaauuauuuucaauaauuaaagacaucaaucauuuuagacuauaaauaucucaauccuucccucuguuuuccacauuuuauaauguauaaguucaaacaauuucuaucacuauaaaaagaugcucucugugucauugugaaagcuugcuaugcaaagaaucuucuagauuuugggcuuucgauuaaaccauaguggcacaauuccacuguccucaggaaagaacacggacauuaauguuuguuaagccaaaggcauuaugauaacuuccaacaaccaaacauguuguucuuaaauauuuagaaggguuuauaucuuuaaaauagucaaagucuuugaacuagugauaaucaguccuuccuucuggaacuuguuuccuguaauuauuugugcuuuccugcuuuuuucccuugaagugucuuuugcaugugaaaacaaauacuuuuuguccucaaauuguuaagaaauuuuuagagacaaacacagaugcuuagacauacuguauagauaaggaauucaaauuguaaaggaaugaaauuaggucauaguuaucuaaauagagaacugcaugcuucuucuuuuuuuuucauguaagauccagcccugagccuugaaaggaaagauuaaauuaauagcaagaaccuguuuauaugcuuuuucauagugaaugaagauuuugucaaaauauaaauuaagacauauuugcuguauuuucuguacucagcaaucuuucgucaguucgacgcauguacaaggagaguaauucuuccuccagucuuccaagucuucacacuuccuucucugccccuuccuucacugcccccucuuuccugaaaagcuuuuaccagaauucagguagacuguccccacaguaugaaaaugaaaucaggugagaucaguguccucuguuugcaaagcaaaauuuucugcagugauauacugauauguuacuaaaaagugguugauuaauuuuggagugacauuuaugcaucccuguguugugcuuguucuaaucuguuucuaauauauugguuucaaucccaauuaauuuuauuaagagaacuuuuucaaccaguaguuucaaagcuuuuugaugauaugauaucuuuuugaauuaugcuuuuuguauuguuuguguguuucguuuucucaaacuccagagucuaagcuuuguauuguuagcacaacugaugcuaacauauacuaagugaaccuucccugauugugccuuuuuuuuuccuuggccuuucuagacauauuuaauggaauccaaaagccacugauugacauaacuguacuaaacugauagauacaauaaugucuuuauuuuuaaguauauagaauauuuccuaggcauuucuuugauuuuucaaugacagacuuuucuggaucucaauauaaaucgcauaaugguuacaagaucauauggauagcaacucuuagauagcaugagggaucugugaaggaccucuugaaucuugugaacgaccucuugaaucuugugaacauucuauuuuguuuuguuuuuauccccaguauggaaaauguauagccuguuaaaucuuauucuuguucuuuuaguaacacaaaauuagacguagugauuuuuggagaauugcuuuuuuuaaaaaaaauuaaaauuauacaugcaauaauauugaucauucaaauucuuaguggggugcugcagccucuagaaaguaaugggcuuacuugggaaccuuucuaaauuuguuggugucauagauguuugugagauucauuccuguuuuuguguauagcuugacuuauucacuuuuauugcuguauaguauuccauuucauacauuacauuuuauccacucucuugcugauggauauuuggguuguuucuuguuguuugauaauuggcacuucuuguagucaggagaggaauacauguuauccacuagccugugugccauuaacaucuucuuagauauucuuuuggccuauuucucuuagacauaguacaugcuaaaaguuaauauauaacuagguagcacucacucacuaguuaaaguagacuaauccuugaauuauuccugagggucuuuuguccaugugugccuuuuuuucacuuuaagaaaagauaacuaauacuggauuaauauaauuuugauccugaacuuuccucugaauuaguacaaagucauguuccaacagugaauuugauuuauagugaagaaaguauaugaagaauuuacuuuagagugcuuucagggacgaccuuauggaagaaauuucaaaggaaauagccacaaaacuaguauaagauauauagaauaugaaacuaauuuagagaaccaagaauauacauaaagauaucaguuugccguaucucuauaauacggccuacugauaagaauacaacacuuucaaccaaccuauuugcauuuucuuauuguuauguuuguuaaagugaguauauggagaaucccaguuuccuuccugagagaaccaugccugaaagugacaauuagcaauacccauuaagaucaaagguuagcuguaacuaggauguaaagcacaaaagugguggcuucugucuauacagauuguucauauuguuuaauauaagguuauucauuugcuuucaggaguuccugcuuaguuguauguguucuuuuugccaauagcuucccaaagcccucuauaccucauucuaauagaaggauuuugaagucaaagggcaaauacacauuaguuuuggguugaaaaauuucaccuuuuuguagcuguguuguuuuaagugguguauugaaauauauggcaaacuuuuaaauuucuaagaucauuaaaaaauccuuguuuucuguauguuuuaauguuuucuuggcuaugugcaauucuaaaaaucagagaguacuuguuuguacccuuuucuacacuuugaaaguuugauagcagaaaaugaauaggccaaaaguguacuuaaaaaauuguuuucccaggaaaggacaccaauugaaagcacacagcucaauggauuaucacagagugaacaccacuauuucucuucaccccagucaauaaauggaaugcuagcagcaugccugcaacuucucccaugucccccaucuaaucaccauccccaugcugaccucagauaucuuagauuaguggugcuuggcuuugaacuuuguauaaauggaaugauacagccuauauucuuuuaucucacaucuuucacugacauucguuugugagauuuaauuccucuuuuaaugagcauuuuauuucauucauuuuauugcuauuuaguauuccauuuaauauaucucaauuuuuccauucucuugugaguagacauauggguuauuucuagguuuuuggcuucaaaaagaguccugucuucacuauuauuauacaugucuuuaauuguaccuacauaugaauuauugaugaauaucuacacgguaguaaaauuguuggacaaaaugcucucuuaauagguuuaucugaacuaguaagucacuucaacauaaauguucaaguuagaagauuggagaauuuuuaauuuguauuuugaaacaauuucaaauuuauacuaaaguugcagaaauaucacagaggauuccuguuaacccuuuauccagguuaaucaacuuuuuauauuuugcuacauuuguuuuauaauuuuugguccauuuacauauauauauacauauauaugcaccgcuauauuuccucauucuaagccauuugugaauaaguugcaugcaucguguccguuuacucuuaauacuuuaggguguauuuccuaagaaaaaggauauucaauucaagagcaugguuucugaaacccagugguuucugaacucuacauucucauuaucacuuguuuuagagaggauaucauguacacauaauuacuaugauaucuggaacuauucagaauagugaggggagaagguucauaguacuaucaguuauaauuuucuugucaguugaauacuuaauaucuuauuaguugcauaaaaugaaucucuaaauaugcauagucaaguagggaauaggguaggguaggagauacgcuaacaauaccauuacuuuuuuuuuuuuuuugagauggagucuugcugugucgcccgggcuggagugcaguggcucaaucucagcucacugcaagcuccgccucccggguucacgccauuuuccugccucagccuccugaguagcugggacuacaggcgcccgccaccaugcccggcuaauuuuuuuuuuuuuuuuuuuuuuuguauuuuuaguagagacgggguuucaccguguuagccaggaugaccuugaucuccugaccucgugauccgcccgccucagccucccaaagugcugggauuacaggcaugagcaccgcgcccagccuacuauuacuuuuuuaaaagcacauuauuuugaaauuuuaaauucagauuaggcauccauuuccaggaccacuauccugaauuacugaaaacagguuacuauuuuuaagcaggcugagaaaaaggagccaagaucuuuuuaauaguugguuaguagauuuauuugcacauaacugaaaugauagaggagagggaauguguguauuuuuucuuuuaccucacuuugaauuaauuuuucaaaauuuaauguuauuucauuguuuaguaaacuauaauuuuauauaauguuaugguaauuuuuauaacaucugcuuauuaaauauuaucacagacauauuuguuacuuuuuacagugcuucucagguuuuaagccugugcuuaaaaauuuauuuauguugaaauucauugcucagaaguaaaugacagucaaaaaaaaguaaaugauagauacuacuucuauucacugauaaaacuuuucaaugagaaaauaaaaucuuugaugaugaaguacuuugugguauaguuuuuguucuauauuucucuuguauucagugaaaaaaaaagguauaauuauucauugugguucauuauugaaguaaccuuaccaugacuuauugaugacuuauuggaaugccuuuuauccugaauccugauuuggacauauuugugugugcuaauuccauuccuuguuuuccuguuguaccagacaagacacugcuucagaaucaaggugauuagaggucuacguauuuuuauuuaaaaaaaauucacagauucuuccaacugaacaucauccuuaguuuaaaaagcaguuuuguuugucuccugaaugcaugccaucuuucugagugcucugagggcuauauaguagggaaaaugugacccuugguguaaucaaagaccaugaauuaccauguaaaauguugauugcagacagaaauccuguuucuacucuauuccaugcugaaauuuccuuagagcugugcuguggccuucaaccaaagccuaauuuuaauuuuaaauuaauagaaguggauuugcuaguuaggggguacauaugugccuaaguggaguuuauuccaaaugccaagaagaugcagaaaugagcauccuaaaagaaacguacucacaaaauugaaucugccuuucaacugaagaggauuauucgucuauuucuguucaccuaaauuccugucacguuggucacuuugagacacugcuaaagccguucagaccucccauuugucuggacacaggaaacaccuaguuccuuauuauggaaguuugaccacaucuguguugacaucucuugacucacaugcuuuuuuuguggugaacaucuagaaucacugcuaacaaccacugcaaauaacuguccucugcuuuauuccaguuucuacauguugcuuuuaucaugagcccagugaaaaagauacaugcccaucuuccuauuuggggccacuauuuagauuucuuuguagcuagagugaaaauauaauauuaaguaucgcacuagacugagauguucaaggagaaaaaauccucagaaaauuauuuuagcaacaauuauaagauuaaaaagugacuuuuuugagacugguaauuggcaagucucagucaugguuagguguaagaccauuuaaauaauacuucuuaccuauucuuaaaagccuaauggaaauguuaguucugccuuguguccuuuuagguauggaauuagcucuguuuauuacuuuagaguuaaucuagucuaugauuuccuuauuuuacacauggauagauugaacuccaaaaagguuuuauauuuugcuugauuuuuuuucagcuuaggucauaaggauauaaauaaacauaugagauacccagagauguuuuaaauuccaauauacuaaacuuauuuucuuaaaaucugcaguguguagaguuuaggaaauaaaacucuuuguuuuucugcuucuuucaucuacacguuguuccacugacuaaucuaucucuuuugacucauaggucaaauacuauauauugauuuccacuagaauaguuuaaucucaauuuuacuuaauuaguaaagauuuuccauaggauaacagacauguaugcaguuaaaagccagaaccuauauaaacuguuagugcaccugaugcaauuaugaguuaaauuauacuguggauccuguagaaaaaauaugguuucauuucuaugaaaugaaauuguuuuacuuagcauuucuuaaggcuuacaaagagaaagcuuuuucagcuuucgguucaauaguugcuaucacacuaaugaaguuuugguaucuaucuuauguugaauucauugugauuuagauacagauuuagacaguguuuugucauuuauuuggacuucagagauagagucuugcugugucauucaggcugaagugcagaugcugggaguuucaacugggugccagaggguugggggauaggaggcagguugcugcucaguauaacaccaccuuugcaagacugguccugacagaagaguuugccuuugugcaaaguauaucuguguugcccuggcaggaaguaaaauaugacuacauccuucuuaaaguugagucucugugaguggucauuagagcaucuccauucuguacaauagucaaugaauucuuuuaaagcaggcaaguagacauuacaauucuauguuaaaauaagaagugggauguuaauuuaagaguugaucuggugaagacuauaacugcuuguucaaggauauguuaaaagauuaucuugaagcuuugacaaguucauauuauagcauuugauggauccuauauacaaaggacuuggaaauagccuuccuacccuauauugggggauauauguaauacgggacauuuucuccccauaugaagucugaauuuguguucacaaacugugguucuuaauuaacuggugagugguaagagggaguauauauacaauauaccagucaaaaaugggugggaguucuccaaguuauguuuccuuccuagauauucauuuuuuaacuuugucaauuucugauagagguaaugcuggcacagaauacuuuuccugaauauguaucuugggaaggaguuuuauaauacacaugcuuagauuccaaaauacaaaagaagaaggaaaaaauucuauggaaacauaagggaaugguuauaacuugcuucaucauuuaagaaauguaaagaugauuaaaauaccaguguauguauauucaacuauauuuagguguuuuuuuauuugguccuucuauuuacaguuaaaaguguauacauuuuggaauguaauuauuucaaagcaaagaaaaggaagugagacauuuacauaaacgagcaccugauaguacucugaaguuauuucucuguugauauaaaauuaauccauuaaaaaauggaaagagaaguacccaaucaaaaggcuuagugcuaauuggagacuuaauuuuucaccagaaaugcagaggauccugggggucccaacagcuuuguuuuugugguccuauagagcuuuguucagaacuaaugcaaggaguauuuacacuggcaggaucagcugcagugccuaaugcuggauucuggaccaccuagguuugcauccugguuccuucacuuuauuauccgugugacugugggcaaguuacuuagccucuuucuacuucaguauugcaccaaaaauggaaguaguaaugacaucuaccuugcaagguugcugugaggaugaaauuaauucauacucguaaaauguuuagaacaaucgauaccuggcaugaaguaugugcugagagucuuagcuuuauuauuauuacaguaaacaccacguguuguuuuauuuuuguuuuuacucaaaaaguagacauuaugcuuucuuaccuaaguuuaaucaaaggaaaaguuaaugugauaacuaauguuguaauaaaaacaaacaaacaaaccaaaagaaauaaacucccuccacccccaucccaguguaguuuccaaguuggguuauaggaauuuugaugcaguguuucauuugguuuugauucuugcaauugccaccuuaagaaugucagauugcugacuaaaaguaaaucaaacaggaaacugcuauaaguugcauaauagcacugacugcuuaaauguuuauugggaacuugacuucugaauacagaucuucucuuauuaaaagcagagcugcuuuugccauaucucagcaaccaacuacuuuuucaagaugucgauuuuuaguacaagauaaagggucaaugguuuguuauguaaguucuucuuuucaguauauuauuaucuucuauuuugacugcuaauuuuuuggcuuauuacuagucaguaaauuccagacaugggagaaaaauuugucauugggcaguuuauauuauaggauuuaaaauuuuagguuuaugaaauuuuugaauaucagugggcuaauguaaauacuguaugcgccucuuuuauaacauauugcccccaaaacuuuguauuuuauaggcaaucaugaaacugauauggguacaacucaguuuuauuuuuaguacguucuaaacacuugauaugucauuagcagugaauuggaaggugauucuuaaaagcuguuuuaauuccagcauuaaaauauaaacauuucggaguccucugauuuggucaacucugguuuguuagagcacuaaaaaagucaagcuaaauuaauauuuguugaucuuuugcccuguggagcauugacauagugcuuuuaaauaaguauuucauuuagcuuucaaagcuuaaaguauaaauuagauggcuuuauguaggaaaggaauaacacuuacuagaaaaaauaugcuuuuuguuguuuauuaacaacauugucauggucaauaccuaccagugccaucaacaguucagaacauacuuuagaaaaacaaagcuauuaggacuugacucccaauaaaggguuuuaagaagguagaucuuuuauuuauuccugacauguuagccuagccaguauuuuugucuguuucacuuaaacuucugaguuaauauuucauuuaguuuuauaaaauauuaauuuauucaguagauauuauucagugcuuauuauuuaccuguuacuacacuacaagcuagaaauauaccuaugaacugggcauuuagcaaauaacugccaucaaggucguguuacaaaaaugaagauaaugaguacuucaacuguauuuauuggguuguaacuauuauauauagaacauuugaaucauauuuuuaaaagggaaauacuugcauuaauguuuuccaaagugcaaguaaaagcaaauauauauauauauauguguguguauauauauauauauguguguauauauauauguguguguguguguguguauauauauauauauauauucaauauucaggaagguuuuuuguuuuguuuuguuuuguuuuuugggacagagucuugcccuguugcucaggcaggagugcagggaugcgaucucggcucacugcaaccuuugccuccuggguucaagcgauucucccaccucagccuccugaguagcugggauuacaggugugcaccaccacaccuggcuaauuuuuguauuuucaguagagacaggauuuugcccauguuggccaggcuggucucaaacucuugaccucaagugaucugccugccucggccucccaaacugcuggaauuacagauguaagccauugugcccagccucagggaguuuuucuaaaaaaaaaauuuaauuauaauuuuauuuugacauggagccucgcucuguugcccaggcugaaaugcaguggugcauucucggcucacugcaaccucugccucccggguucaagagaaccuugugccucagccucccaagcaacugggauuacaggcaccugucacuaaugcccagcuaauuuuuuuuuuuuuuuuuguauuuuuaguugagacaggguuucaccauguuggccaugcuacucuugaacuccugaccucaggugauccgccugccucggccucccaaagugcuggguuuacagguggugagccaccgugccuggccacugccucaggaguuuugaacaauggacacauauuaggguuauaguguuauccaggaugcauaauaaccagaguuugacuauauugagauauauguaucaaguacuguacuuucuaaaguaucacgucauaauacuuacucucugcauagcagcucagaagucuuuuuuuuaacuuuaauuuagccaauccagaaguaauguuuccauaaaauagauccagacuagaaugaacugaauugccugaguaaauaaagauacgauaggcagaugcugaauugcucuucucacuauuaauugccucaacacuauugaguuccuuugaguaucugagaguggcuguucugucugagcuuuauuucugaccucagcacugaccuuuugauuccaucaaaagucuuauaccuucauuuguugguaucaucaccuguaaauauugguauccuuauuguucucucaggcaaacucagacugugaaacuuaaaaauguaagauauuccugccacuaacagcaacaauuauugugaggucuuccagcagcaaauauaauuggucucaaaaaugauuuugagucauaccgaccuuuuuuugcagauaggccuagcauaacucaaaguggucuuuuuuaggaaaugaaauuuugacaauagaggagcauuuucuuaugcacuaauauagaaugaugugacacuacucccugucccccaaaaauugagggaggugauucuagaaucaauuaauuucaauaaguuggggaauuucuauacacuguuucccuguuggagagguacagugcaugccaguguauuaacagucucuaacaaguacugcuauaaagaaaucuguuaacauuuuuuaacaggcuggguguggugccucaugccuguaaucccagcacuuugggagcugagacaggagaauugcuugagugcaggaguuugagaccagacuggacaacacaaugggacccggucucuacgaagauuuuuuuaaaaaaauagccagguguggcggugugcaccuguagucccagcugcuugggaggcugaggugggaggaucucuugagccugggaggucgaggcugcaaugagcugugauugcgccacugcgcuccagccugggugaaaaaaugagaccuuaucucacaaaauaaaugucaauaaaaauauaaaaagaucuauuuuuuaacuuagccauccaaucuuauuugaccccaguuuuuucuuaguauaucaccuaccaauaaucccaagguugacuguucugcuuauauucagguuaucaucugccaugauucaacuguugguagcugaccauucagagacacaucuuaacagucguaggcaauuagaaacagucuuuauugaccuguucuauaagagcucuaacaaaagcucuuugugaggcuuuuauggaauauuuaccuuguuucaaauaagcuauucauguuauuuccuuagcaaagcaugaauucaugacuuaagcaaccuguacuccuccuuauaagugcuucuguuccucagauuagaacuaggacugguuggcugcuaaggaaugaguagaaacaggggagcuucucuugacugggcuguggccuagauugcuguuuccccaggaugugguggccugggugacuagugugccuggugaugcauugcuccauguugccuguggcuugugcuugcccgugacagaacuugugaauggcuugugcuaccaguugguugugaagugccaugaugugcagcucuccuuauaagugauauguuuauuugcuuucaacagugauggagaagggagaaaaaggaccucaucuaccugcagcaaugagucccuaagugugggaggaaccucugucacuccucgccggaucuccuggcggcagcgcauuuuccucaggguugcuucucccaugaacaaaucucccucagcaaugcaacagcaaggucuguguugcacucccuaaggaauuuaucccucugagugucagaaauuagcuaauggaaugcacgugcuguguauaaagagauuuaagugauuacaguguagaaauaucuuucuguaugugauacagugguuucucuuucagguaucauuagaaaacauuaggcauucaauaccugcuuguugaaugaaugaaugagugagacaguuuccaaaaaccuguacuugggccuacuccacaagguagacggaacugugauagugcuaggaaagaagcuguauguccuuuuucuuucuuucuuucuuucuuucuuuuuuuuuuucccagagauugggccuugcucuguugcccaggcugggguugcagugguguaaucauagcucacuguagccuugaacuccugggcucaagcaaucaucuuaccucagcuuccaaagaucuuuuuauuauuagaaaagcaacauagccuuuuauaagagccacacauaaaacaaacugacauagaaauauugagcaauaaaggaauauauacaauauacuaggcaaauacugagcaaaagagagcacaggcagcucucuuugaguaauugaccuauuaaacuaaagcaaaagcauccaaagaggcaagcacauguaacaguaaacaaacagauagaacaaucaugagaacauacauaaugauguagcuuugagagcuagaaaauaacaccuaaaagaauucuggagugaaaucgauaaauuaauagcuccugugggagauuuuaacauacucaucuuuagaaauuaaauauaaauaauauuugaguaacacaaauaaauaagcuugaccuaauauuuauagagaacuucgccuccuauggagaaaacucauucauuuuuagcacacuuggaacauucauaaaauguaauuauguaccuguccacaaagauuuuuaaguaaaucuuuuugaaauccaaauaaucauaaucauuuauacaaauauucucugaccacaaugccaaaaaaagaaagaaaucaaggauuagaagacaaguagaaugacauguguuugggaauagaaaacuacucuuagaagcuagaaggaagaaaauucaaugcuuagagccuuaccuauugaaacggaucuagggagcaguuaaaagccaugaauauauugauauaaaaucaagaaggccaaaaauuaguuacacugaguguucaacucaaaaagcuaguaagagagccagguauuaaaauuuuaaaacaacaacaguaaaacguauggaaguaaauaauaaaaguaaaggcagaggucaaugaauauauauaaaaaaagaagaaaauagaagaaaacaacugguauuacuaaagaugaaguuaacucugcccgagguggucagaaaaagcuucacagaacaauuagauguuuauuuaaacucguugcuggaagaaccaugcuuuagaaggaaggaaugacgaagcucuggagucauuugagugaacuuugcagaucagagaaucaugagaaauucagcaugaugaaugcaaagaauagaagauugagauaugaggcuggaaaucugaguggagaccagaaucugaaggaacuuaaaugcuagucccaauuuguucuugcgauauaagcaaccauugaaauguuuuaagagaugugauuaugguuguuaauaggaaaaucauuggcaguaggaagggagagaaugagucaccuguuaagggaguguugcacauggaauacugcacagccaugaaaaauaaugaaaucauguccuuuggagccacauggauguagcuggagguuauuauccuaagaauuaacacaggagcagaaaaccaaauacugcauguucucacuuauaagcgggaucuaaacauugaguacacauagaaacaaagaagggaacauuagacaccgggacccccuugaggguggagggugggaggaggaugaggauugaaaaacuaccucucagguacugugcucacuaccuggguggcgaagucauuucauuuguacauuguaccccagagucacguaauuuacccauguagcaaaccugcacauggaccccuucaaccuaaaauaaaaauugaaaaagaaaaagaaaaagguguugcaggaggaaugagcagagggaguacugugcucagccaggagaggcccagcauugcucaguggcuaugcuccugacggauucugaugaucgauguagaccuucggagaucacugauaccuagccacuuaaucucguuccucacagccagagaauauacguaaguaaauugcagaaguguuggacucaggagaggccaguuaguuuuggggcaccucucuuacagagcucuuuggguggaaagaagaaguggugaaaugaccuaugcuucuguuucaucaugacagggaaaucuggaaggggaauucagucuagugaauuuacuuaaauauuagcugcagaaacuaaguuacagggaaagcggcuuugugacauuuuuaaguguagaagaucagaugagaaugugaauucuacagaaacuuggguagucuggguuacugcuaaggaaugccucucacuguguucuucucugcagauggauuggacaggaacgagcugcugccacuguccccccucucuccaaccauggaggaggaaccgcugguuguauuccugucuggggaggaugacccagaaaagauugaagaaagaaagaaaucaaaagaacugaggagcuuguggagaaaagcuauacaccaacaaaucuuguuacuucgaauggaaaaagaaaaccagaaacuugaagguuagccauuuuaacagacuaaaugcuaugaugcuaugauugaaggguguauguuaaaccuaccuuucucuccccauacauacuauccgcacucaguuuuggacuguaugcacacuuuaagaagaauaccuacugauuauaauuguugauuuccauuuugugaggugguuauaacaugggaaaggucagcuuaagauauuugugguuuuguuuuaaauggguuugcauuuuaaauagauuuaagacuuaagaaacucuuagaguauauuuagguaaaauagaauguagauaauauggaaucaauguauuugaugugucugaaaguucauuaucuuagugucacuucuaaaaaauccuuaaauaugagaaagcaaauuuucuuuucuuugaaugugauuuucaaguuucagguuaauuacauucauaaugggagaaauaugccuaccucaaguaaauccuacuuacauuguauucaauuuaacuauuuaauuauaauuaucuguuaucaagccaaaccuauuccuauuuuuuguuaaugcuuuauaaauuuucuauuuaacaaagucguauucaaaucauuauauuuauaaucaaauaauuuauaauagauuuuguacuguuuguggugccuuauugcuaagauuaugauuaccaaaugcuuuggaauguguuuuucagccuuugaaagaaugauauaauuuacuccaguacugauagaaccacauacaaggagaugcuaagaaauccaaaaaaauguauaaauuucauuauuuugggaaaaucacuuaaccugaaagggucucauuuuuacacuuguaaaaugaaacauuuaacauaagugguccguuugacuuuuaagauuauuggcacaaguauaauuuagauauuucucucacuugccuuuauuuuguggucuuucauacagcuuuuuuaguauagguauuccacauuucugacuuuaucaucuaccuuaagauucuuguuacuacaccuaugauucaauuuaauuuuuuuauuuuaacaauauauaguuugcaagagcacauuuuuuaaaaucgcuguuagcagagugaaaaguacauaggauuuuaaauauccuuuggaaauacaucuucuuuucuucaaaauuaaaaaugcuauuacuugucguuagcauaauuuuaaaaguucaguuugauaaauggucugcccacuugagguuucgcaggcuucaaaagaaauugaauucauauuuguaagcaaguaguuauauuuugaacuaacucagaaaaagagguugaaaaaaagguggucauccuuuccucaaaaaauuuaaugcaugaaacuguauuucacuugggaguauguacaaauaaaaucugauauuaaauaucaaaaggugguuucagaaucauagacuauuugaaguagaaauagccuuagagauuacuuagcuagauucuucauucuacaguagaaguagugacuggcuugggaaagguagagaauuaaccuaaggucaaauagugacauacuggcagagcaaguaccaaaacucagguuuauucaucgugguucucgggcuuuccccagcaccccacaguauuucucagcuguguauguuaauauaaggaaauggaauguuuuacauaaauggcugcuguguauucugagaucaguuauacuauaugauuuuacagguuaagaaaggaggugacauuuagaauacauucucagaaaccuucaucgguucucuguuucucugccuacauaacaaagauaaaaaauaguuuaaccuaugaaaauucuaaccaauggauaauuauuucuugauaguucuuuagucuuuucuaguuaaacaguuaagggcagauauuaacugucccuguucaccauuuuauccucagggugugcggcuggcacauaagcagaugcucgugauuauuuuaaaugaucaauaaucuagagaagauuagagaaaaacucuaaggaaguaauuauguuuuguccaucaugaagaaaauaauuaguaaaguuauauauaggaguauauuuguuuuuagccuuaauaaagccacaccuuuuaaaaaauuacuugguuaucagagaaauauaaagcaaauagccaaacagccaagcuagacaguguuagaaagccaucugugguauccggaaggaauaguuuuguacugugauuuaucuuuagauuauguuuggacuuuuaaguaggaauuuuuacugccuugcuugaauaacaguuuguuauaagauauuuuaagucuuuugaaaugguuucaaacacacuaaguaaagaguaacuuucauucugcuguuguuuuugugcugucgaggacuugggaugcaugacaaagauuuguguugcaggagguaagguggccgagcgcugugagcaugcaugaauacagauugcucugagauguuccuguccaccgugauccuaaugaagagaagaaguauacucuugugucugcucuuccuucucuuuugaaaucaguuuuucaugauaaagaacaaaucaagauacugguugcuuuuauagacauuucuuuuaaugagcucugggcggauauguuagaccaucaaauuagagagaacucuauauuauuuuaaaaauagaauuaguguuaacuucagugaaaggaauuuuucuuuuuaaguuuauuacaaaugaacacaggagggcugggugcaguggcucacaccuguuaucccagcucuuugggaggcugagguaggaggauugcuugaggccaggaguuuaagaccagccugggcagcauagcaagaccccaucuuuacaaaaaaguuugucaaauuagccaaguguaguggcgcaugccuguaguccuagcuacccaggaggcugagaugggagcucaggagguugaggcugcagugagcuaugauugcaccacugcacuccagcuugggguacagagugagacccugucucuaagaaacaaaagcaaaaacaaacgaaagagaaaauaacgaacaugggaacacauaagcuaguuuuauuaguuauuaagggcaguauggauaacucuggaaacaguuauaaaaauguaucauguuauggucauauauuuuucaaaucaagaugagcaugagucuuugucuucucauguauggcacauauaaaauauuaacacuucaguggugucaaaaaauggaaaauuauagaaugaucaacacgguuuacuuuuuauacuuagcagagucgccauauguaagauacagaguaaaaccuccuuaggagguuauuccucauuuuuuuucucacaugaaaugacucaaagcuugggacccuuucauguauccucaauuuguuuuaaauuuucuuuuugagauacacuaccaguugauuccugaaagucauuugguaugguuuuacaaauacaaucaaacgucuaaaguuuuacauuugaaaaacacauuggucuuacguaaauuguuuuuuuccuuagcaagcagagaugaacuccaguccagaaaaguuaaauuagacuaugaagaaguuggugcaugucagaaagaggucuuaauaacuugggauaagaaguuguuaaacugcagagcuaaaaucagaugugauauggaagauauucauacucuucuuaaagaagguauuugggauaaucucaguaauuuuuguuuuuuaaagaaaagccugggggauuuuuuuuuuuuguuugauuuguggagcucagauuuugcuuaguaauuuuguccuuguguuuugcuuaguaaaaaaagagaaguaauuuguuucuuccuguaguuuagugacugucucugaggagguagcacaaaccuauuuucagcaugguggugguguuuaccaaggaagaagugcaugcauugauacaaaucuuugaucacugccauaaaaauauuaauaauucagucuuucaaacuugacucauuuucaucauuuggucagaaguauucauuuacauauauguguauauuuacaugacuguguauauauacuuguauguauuuauauguauagauuuauauucuggcuaaguaaucaaucaauuuucuuucauccauucauuucuucacuaauuuuggagaaguugcuuuuauuuagccauuauaucgcauuuauucuuuuauugcugcuaugccauauaagaugccugauauuuaagaauuuuaaauuuaaaaauaaaacuaauaagucaacuuuuaguugcaguuucugugacucagauuaaauauauuaaaauuagaaucuccauagccugcauaaacuguggguguaaaauaaaaauuccaaaauacccaaagaaauucuauaaugauuguuguuuuaaaagccuaugcuaaugugugagacuguugagccacaguuaaguuuaaauuaagauaaguguuauuuugaaagcugcugcauugacaaacuuaauauaguguucuuuauccuugaagauauggaaauccuaaagauuuuuacugaaugcuuuauuugggagacacaauaaugguuaacagaaugucuaugagauguagaucacaccauuuuuuggcaugacuuucaaagauauuuuaggagugcuuaucuuccuauuucuuauuggauacaguuuaaacuucuuggcccugugcccaaggccuuuguacuaguccauuuuuaggcugcugauaaagacaaacccaagacugaguaauuucuaaagaaaaagagguuuuauggacucacaguuccacgugucuggggaggccucacaaucauggcggaaggugaaaggugugucucacauggaggcaaacaaaagagaaugagaaccaagugaaagggguuucuccuuaacaagccaucagauuucaugagacuuacucacuaccacaggaacaguaugggggaaacugcccccaugauucaauuaugucccaccggguccuucucacuacacauggaauuaugggagcuacaguucaagaugagauuuggguggggacacagccaaaccauaccauuguucuauaauaucuacuuccuccuuucugaucucauuuuguuaucucuccuuaccuuguauugugugcucuauuuuacuuugagcacugauauguccuuugcuauuucuugcauggaauguuccagcccucccuauucuccuucuuccuuacuucucuacauucucauuucccaucucccuuucuuuccacuccauccucuucucacuccucuuucuuccgcccuuuccucugcccgucucagggccuuuaugcgguccucuccuggagugacugcugccugcgcuuuaagcccagagcauccuauuaucccucaggucccucaaauaccauuuccucagagcaccaccccugccccccgaccaaaaucaguucauuguacuuuaucauucuuuuucgugauuuauuauacuuaaucauaauuuacaguuuaauaauuauguguguauuuguuuaauguuuuucuuaccccaccacugcacaccuagcaccuaagacaguaucuugcacucauuacuagaugaaugaauggaugaaugaaugaaugagaugauuuuccugagaauggauuuauucaucacucaaugaugaggcauccugacugccuugcuuuauucucuguuacauacuggaugcucaauaaauguuuguuugacuggaaugaaguugcuuuuuguacauuuauuauugguuggauaauaaaacugcccacucauguuaucagugauucauuuagugggcugauaguuaccuucuaaaaaugacauuuucuaugcugucauugauucauucaacaaauguauaagcagcaagguauauucuuggauuuuaucauacagagaugaaaauaugcuugcuauucucaaggaccauuuaagccgggaaaagagacaaaacuucaauauagagcuaacuguaaucuaauaugguaauguuacaguaugagucaaauggugugugaaaagggacugauuacaucucgagauguuagggagagcuucaaaagaaaaggugacacucaagcucauucaugaaagaugaauagacguacaaugggaagucaagcgagggagcuuggaauuccauaaaggcaacaggaggugcaagaaacuggagaagugaaaauaaccacaagcgucuaguauacaucagggacugggaaguaauggugcuuaaaaagguaguuuggagcuauauuguagaggccucauaagucaugccaacgagccucaguuucaccugucggacaauaauacuuucagcuuguacaaacucuggcaaucagucagaagagauuacugucauuaagcauuuccuuaaccagcuggagcaaaggaacccauugccgauucaauguguccaaacugaaaacucuuagugagugaaauaaaguugccugcacugugcagaauugaauucugucccucccagugcuuacuucauuucccuuggcauaaaaaacauagucauaguguccuugaacugcuugugauacauuuugguguucaagcauacuagaguuaauguuucauuauaugugcuaagcauuuucuuuucaaagcccgaauguuguucuggagcauaucaguuacgccuucuuauuguuuacuacuuauauuauuucuuuuuuuuuuagacagagucucgcugugucucccaggcuggagugcaguggugagaucucagcucacugcaaccugugucccccagguucaaacgauucuccuaccucagccucgcgaguagcugagauuacaggugcaugccaccaugcucgcuaauuuuuguauuuuuaguagaggcaggguuucaccauguuggccaggccgguaaugaacaccugaccucaagugacccacccaccuuggccucccaaaguguugggauuacaggcaugagccaccguaccuggccuauucuuucauuuuuaaugcccauauaagaaugcuauuugauucucuauuauaaaguuacuuguugaugacaaauauuuagaguuguaaauuagguuuagcauuuguugcuauccucaagccagauaaagagugaaaauaggcaguaauacacuuugggauaucaggauuuggccucugaaaccagacuuuuggaguucuaauucuaaacugccacuuccuagccaugugaacuuggggcaauuacuucaucucuuucugccucagcuuucugucuauaaaguggaccuaauaguaauugccuaccuuauaguugaguuguuuucugagugcaugugcuuaguagcuaggcacccucaauaaauguuuuauuaaugcucagucagcaacgggugauguuauuguuaauauugucauuaucguaaguguugcgugaggguuuucuuuugcaaggcaucaagagcuauaggauucagcuugucaaaauaugcuucugucaauuauauuguguggucuuaggguggcaugcaguacauacagcugccuguuuaccagaauuauauagugaaucagcugggaucuaucaacuucauuccagaguucaaggccuugguuauuuaucuccuucauuguaggaguucccaaaagucgacgaggagaaauuuggcaguuucuggcuuuacaguaccgacucagacacagauugccuaauaaacaacagccuccugacauauccuauaaggaacuuuugaagcagcucacugcucagcagcaugcgauucucguggauuuagguauguuugucauguggauuauaauuuacaaaaguaaacagcugaucccucuguuaaguuuuuuugguuuuuguuuguucuuggugcugauaaagagcaccuguuggcauaugcagagccguugacuuuguccuuuacugagggcaaguuggccuuauaccugauugacgaucccauaaaugccugcguguuaaaugaaguuuucaccccaaaacuuugccucugcaaagggagccaucuuauauuuaaauuauuauaaaggucauauuauggggugcucucaguuacugcauuuugaacaacugacuuuuuagggcagauaguuguaucuuaaucaaugcugguuuugaaauagcuuagaauagguuaaaaauuuaacaaagguguacuagguauuccuggacacacugcugaaaacaauccuuuauaugucacuuuaaaaagcagcaugauaaaugguuauguugguggaaauuaugacuauacaccuauagggugagugaaacauuaguugcacuaauaguguaggaauggguacucaugaccuggcggagaauuuccagugacagaaucauaaagcagucuuuuuuuuuuuuuugagauggagucucccucuguugcccaggcuggagugcaguggcacgaucucugcucacugcaagcuccgccucccagguucaugccauucuccugccucagccuccugaguagcugggacuacaggcaccagccaccacgcccggcuaauuuuuuuuuuguauuuuuaguagagaugggguuucaccguguuagccaggauggucucaaucuccugaccucgugauccacccgccucggccucccagagugcugggauuacaggcaugagccaccgugcccagccagcagucuucuuaaaugcugauuuucaaauaacuuauggaaauaaaaaugcuuugauuuuuaaagauuguauugucucuaauuuuucucuaacauacuuuauuauuuaaaaauaucuacauuauuagauuaaauauuauauauuggcauuugaccacuuuauuuguacuccuaaaaguugauauaugucagguggccagauauguuauuugggcccauuugggaaaauacaagauuaccuuauguuuggggucaucuuauauuagggcauaugaaaaaucacuagccaaacccuaguuuuuaccucuguuccuuuuggaugacaaauggcucuuacugggaaaggacccagcucaguuaauuauuuuuuugagcccagcggaauuaaaaaggggauuuuacagagaaacugaaaaugaguuuuugugcugauugugccacuaauuguggucuuagacauauuaccuuccuucugagcguccauccucucuacuaaguggggacauugaacaaggcaaucccuauguucccaagcaaaucugugguucucugaccauaaauugaugauacaaucaggguuagucacgauguccuauuaaagagagaaaaugagaucauauuacagucagacaaaaauggagcuagaaucaaguuaauggauagaaaguguauuuauaguuuuccuuaguaaaaauuuuaagugagaaaguaaaaccauaauuuuaaaaauugcuuauuuggcucugcuuguagccaucuguguuucuucagcaugcaauuguuauuuucucauaucuuccucuuacuggcucugcagaauuaaucuuauugguuccuagaaaaaaaaaucacuuuuaagcauaugugggagaaaacauuuuaaaaccuggcacucuugcaaguucuaaaugacaugaguaaucauuucacaaggaagcuaacaucccccuucauuuuuguggcccuagaaaaaugcccauaccaauauagacagcuuugaugugaagacggauuuguuucuguguauagaacucuccuuuuagugaugcaggacucacauugccagcucaagugucucugugguaauuuuauaccuagagguauauuuuagaggggaauuuauuugaaauugacuugacccuuuauuuuccuugauauuuuuagauauugaaaaagaaaagugguuuacauggcucauggagguauuuuaagagcagagagcgaacgauaguugaaaaagcaguuuucuucugaaugacagucugaauguaaagucaaacaaacccaaaaagucccuccagugucauaagaaaagcagaaauaaaccuguuuauagacuaugaagauuuucuuuuaaauaauauaauaugucuuacagacuucugguuucauuuagaagguagucuuuauaugaauuagaauuugccuugcuuuauagucagaauaaaauuuauauuccauuuuccugguauuucuccuggguacaucauugguuuguggauuuuuauuguauuuuuuuuuuuuuuuuuuuuuuuuugcuggaaagaaguacugguuagcauaaaauguuuccucccauaucguauaugugaagaugguaugguggccuggcagaacuuggggugagagagggagagacucuuaguuacauggugacucuaagcaacucucacugguuugggaaagagugucuguuuauucuuggaggucacugaauugcaauuucacuguugucuccaaggcaugaggacauuucaaaaaauauuuuccuucuuuuccucugcaggaaggacguuuccuacucacccuuacuuuucaguacagcuugggccaggacagcugucacuguuuaaccuccugaaagccuauucuuugcuggacaaagaagugggauacugucaggggaucagcuuuguggcuggaguccugcuucugcacaugagugaagagcaagccuuugaaaugcugaaauuccucauguaugaccucggcuuccgcaagcaguacagaccugacaugaugucgcugcaggugaggcacuugugcuucccgaggaaggugugagacuauuaccagaaauccuggcccucuucucaauuauuacaguucagauuuaaagaaauguagagccauugucuuagaacuuggguaaagauuggggcauguuuuaguucacuuagugugggauuugcuauuuagguaaacuucuaaguguaugagacccagaggcagaauaccuuuuccauaaaauuccugaaguaaguaaauaaguaauuuaagaaagguaggugaugaggacccaguccuuuaugcccuaagucuauggguuacauggagaagguaucaaaucaucuuuauucacuuuuucucaacuucucaguugaaaaggcucacagaucuuuuguuuacaaucugaaaguaucuuuaucccuuuacuuuugaguacacaaauagcagauaccauguuaugguucuuuuugaacuuaucauugauaucuccccuccuuuaucuucauguaagauaggccuuuacagaggaaaaagugugaaagccaguggugccuuuucagucugcuuuguguguguguguguguaugugugugugugugugauggaaucuugcuuuguugcccaggcuggagugcaguggcacgaucucggcucacugcaaucucugccucccggguucaagccauucugcugccucagccuccccaguagcugggauuacaggcaggugccaccaugccuggcuaauuuuuuuguauuucuaguagagaugggguuucaccauguuggccaggcugguguugaacuccugaccucaggugauccgcccgccucagccucccagaaugcugggauuacaggcuugagccacugagucugcuuuucuuagcaggcucugaagaagcaccauuaagauuuuccagguauuuugagugggguauuaacugccacugcugucuuuagccuaccucagacucccuguuugcacauuucucuccuaguuuucacuucucuaaguggguugguugcuaauaagcaguuuaaauuuugucuauagauacuuaaacaaccacugccuggcaauuuaaagcuuucagugguuaaaaauauaaaagaagacuuuaaagaggauucucagguuuuuccucccuugaaaugagguaugcaugacucccaguucaucauaauacugugcuuuagauaagaaguaauaguuuaaagaugcuuuuaaaauauacuauuuuuuucuguuucccagagaugaguuuuuugccuuuaauaucucaguugccaauguauaacaaaagaauuguauuuuuagucugagcguuauaguaaaugauauuuuuugagaguaugaauggagaugaaguauuccauuuuucuuuacuuucugaagguaaaauuuugacuggggagauagggcuuugcuaucaacauuagguuuucuggugugaguucauaugauuugauuccucauugaugacuauucguagguuuaacaagucaaauaacaacuguggaaaguuuuauuuuuuauuccuaaagaguuuaccuguaucuuuuuaucuuuuuaucguuuuuuuuuuuuuuggagacggagucuugcucugucacccaggcaggagugcaguggcgcgaucuuggcucacugcaaccuccaccuccuggguucaagugauucuccugccucagccucccgaguagcugggauuacaggcaugcacuaccauacccugcuaaauuuuuuguauuuuuaguagaguugggguuucacuguguugggcaggcuggucucaaacuuccggaccucaggugauccaccugccuugaccucccaaagugcugggauuacaggcgugacccacugugccuggucaccuguaucuuaauaucagauaggaaucagauggucuuguaaggaauucaauaauucugauuuucagaaacaacgguuugguagcuauuauuagaauuucaaagauacagggaaguaccugugaguaguguuugaucuggguccacagauaaaaggauaauagcuaucaguuuaaaaauacaaugauauuucaacuuaaaaauuauucaucaauuugacauuacaaaaauucauguaaaucggauuuauacauucauuuaauauggacuguaaguaccaagaaguauuuuaugucuauaauuuugaaaaugcagauguuuaaaaaucuuuggugacagcauugcuguaggccgcaguauuggggaccuuauucugggagaguagguccuuuugcauuuuaaagugagauauaacacuuuuccacuuucuagagcaggagguacuguuuuggguauagccaauaggauguuuagaagugugcuuaaaugccucuugcaguggguuuggacucacuccacaggauuucugauuucuugcuucucucuugguggcuugggugcuccaggcuucaguuaccuuaucuguaaaauguguaaaaucuugcuucaguuaccuuaucuguaaaauguggggguugaggucuuuuucaacuuuaaauacauguaucuugucacguuuguuucugcugcuuucuguguuaagcauaaagacauuauaucuuuuccucugaaguuuuuggucucuacuuuuuuuucaucuucucuccccuacccuuaucucucucugugcaucuuuccuucuccaguucaccucuuuaaucugcagguuugccuugguaucuauaagguggaauugaagaauuauuuguucuuagaaaauagaauuuuaucauuaaagcuuucuuugaaggaagccugaauuguguucuuauuugcccaaauaucccuugauggaagaaacucucuuaacucccauuugaguaugugcggcaggguaggugggaaauaagauucucuuuaaaaaauuacauguugaaguauugcuucuuuuuauaaucacaagugaacaagaacagugugcuuuugaugacgugcuuucuuuuuaugcugcuaauuagacuuuuuugauuuuugugcuuaccaaaauacuaacucuuuuguugauagaugcucagaauuucucguuucuacgauguaaauggucuaaaggaaauguauguuuuuuuucaacaugauuuuuugagauaauaaucucauuaaaaaaaaacuuugacuccagcuaagcuucuuauuuuauagcuaugacuuccuguggcucuuuaacucccuuuuauuuacaguuuguguggaaacggaguuucuaaagauauuuguuguggauaaggauugaacaaacaauuuuuuguauuuuugcauaguuuuugauuuuuuuccaaaggagucuguugauuuuuaguucuguacucuagaaauaauuguugaauucacaacauaauugguuauuuuuauguauugucauagagcuauuuaagagugauguuuuaauaauuucuucuagugaaagaaguucugcuagauuuaauaaaacauuuuauacauuuuuacaccaaaauaucaagccaauauaacugaucagggaaccaucacuuaucucuuaacuguguggauaaaaauuuaaauuaaaacacaauucacaaauuuguuuguuacuuacuacugcuuuaucuguaguaucacagauaugaguuuaaaaguuucuguaugcugucuuuaugauguuuucugaaaugccaauaaccaacucaguagccaaaugaaauaauuuuuucuuuuaguucuagaaauauucagaaacaacugcacuuuuugccuuaaucacguuugucaugaaaaauaugcugcuggaauaacuugaauauuagaaauaaaucucaagcuucuggcccuguaacauucgaagcuuuaauucucuccuagcagugcagauugucuggagagccagaacucuuucauaaaucacaugcuggucucaguaaauagaaauaagcuucugcacugaacaugguagauucuuuagaauggaggcuuuucuggaauuagucugaaauuagaagggauuuucuaugagguuccugagccaggacuguucucauuaaauuccaaaagcaaugccucccuacagaagaaaaaauuccauuucuuuguauguaugugaugcucaaacacacgugauagagaaacuugcucagucuucuuagauagacuuucagugacuugcuuuaugaauucaguuaagugaacuuggauuuuaguaucaacuuuaaaaucauaaaaauaaaguaauacuacuuauauaugugaauuuguuauuaaauauuagaauaaaauuaaaaucaguguguuugaugcacaugcagauaaaugcauaauauuuuuuuucuucuccaaauuaacuuuagauucaaauguaccagcuguccaggcuccuucaugacuaucacagagaucucuacaaucaccuugaagaaaaugaaaucagccccagucuuuaugcugcccccugguuccucacauuguuugccucucaguuuucauuaggauuuguagccagaguuuuugguaagagauaccuguaauuaaauggaacaguauuauuuauuccaaggacuauacuucuacuucuagccauaugaugccccuauuguucuaucauguguuauacagaauagcaaauugcuaauggaauuuaauaaaugugccuggcuguguucugacaguaacuuaaaaucauacuugucuuacauaaaauugaaauuaaaaaggaaagaggaauugggcuccuguauuugagucagcuguaauggagcucuuauuuucauuugugccuaaaaaucagagaguauacuccuaaaaucuggacuagggacagacuguguauaauuuuccagauuuuuauauacauguuucuacccccauugucuucuucaucuugcauucaaaacacagagaaauauguucuuaacuguaucaauguuguuucuaauggcauuucuuaaccugacuuuuuguuguuaacagaauaacuuuacauccuguuucauugcucaugugacucuucuuucaugccaaugcagugcugggggacagucucuaagacugguggcucagggaaaacacuaaguacagucaguagagcucagggcaaguuacugaguaacugccuugcucuaagcacaguguuuggcauugggaauaaaaagagaguguaacaugguuuauguccccuuuggaggcccuuaaaucuauucacaagucuuuauacuagucuaagucuguuauuuaaaaagcaaaaauuaaaacaacaacaacaacaaccaacucuucaucagagguuuguucuaaugauguuguuuaggaccucaguagccuuagaaagggcucccuuaauuuuuauguucugauaaucuauuuaguagacaugggcaaagcagucaguauucacucacaacugcacuucuguuaaauuggagcuuuuugucaaauuguauuggcgccauuguaggucauugccaguguuugaaaaaaugaaacagcauuuagugaagauauuagggaauauuacaaauaguaaggaaauauguuguuuggagaaauuuguuuugaggauauauguguaauguauauauauaccagauuacaacauaugauaucuuucuuauugagggcugugguuuaaaaguuaaacacugcauuaguguuacuacaauuuauaaaaugcagcaaaagaguaaagugaaaaugcgcugaaucaaauguucaccagauuucucuuguuuauugaauauacacuauugcuuuucuacagugacauuuucucuggagcuuggguuccuauuaauggguauucuauaaauccuuuuguuuauauacauuuuucuucccagagaauaguguaucaaaucaaaaugauguuucagggcaccucucuuuuacuuacccuuggaagcuugauaucaagaguucaagaaacaaauguccucaguaucaguuuuuugucaugagaauacaaaugaugcuguuggcuauacaauagcuguucaacucucuucuuugaauuuauaaaacaauggagacuggcaggaaauggaaagaugcaugagcaagaagaauuacuaugaaauaaugauucuaugguucccucuucauuaaagacucccuguuguauauuauugauuaaagaaugacauagauugagagaaacuuucauaaaaaaguacuaaguacuugauacuuuuauuucuuucuuuuuuuauuuuucuaagacugagucuugcucuauugccuaggcuggagugcagggcacaauaucaauucacugcaaccucugccuccuggguucgagcgauucuccugccucagccucccgaguagcuaagacuacaggcaugugccaccacacucagcuaauuuuuguauuuuucguagagacgggguuucaccauguugaccaggcuggucuguaacuccuagccucaagccauccacccaccucagccucccaaauuguuggguuuacagaugugagccaacacgcccggccuaguacuugauacuuuucaaaaguauugcauguuuguauuuguaggaaagcagggcuuagaguuaggguagcucuuauauuucucuccugauugagguuguauguuuuucauuuguuuuaauuuuucuguuaauguuuuuuuuuuuuuaauuuccuggugugguauagauuuaauuacauagcugguucauuuacuuuuuauuaugguaaugagaguuugaauaguacucauugguuauguuaauuuguuuuuguauuccuguugugaagaaaaaucuaaauaucaauugaauaacuguccuugagguuuaccuagucuccauuaaauuuggcauuaaaaauuacaaguaguucauggacagagauauauacuuuguccuuuuuuacccuggcuuuaucugagauucuuaagaggaauauuaaaacaucugcuuauauguuuaguuauauugcuuuuuuaaaaaaaagcuagaugcuuuugaccaguuuucuucugcaaaauacauaaaacaaguaaacaaaaaccuuuagcacaaauagcgugcuuuuuacaagaguggaugcauaguuuugaucaugaaaauuauaucucuucuuuuagauauuauuuuucuucagggaacugaaguuauauucaagguugcacucagccuacugagcagccaagagacacuuauaauggaaugugagagcuuugaaaauauuguugaguuucuuaaaaacacgcuaccugauaugaauaccucugaaauggaaaaaauuauuacccagguaugauuuaaaugcuaauaguauuauauagcaguuuucucuacugaauauauauuaaaugcuuuagccuaaaaauguagcuuugcuugacagauauuuucaucagauacauuuuauuuagaaaggggacuauugugaaauuucuacacugugacauuuucuaucuggcuaugcacaaaaaaugcuguuuagugcuacguaaugaguuuuucaggaauccuuucaauuuaaaccaaugcuaaaacugaagauagaacugacagagucaagaaggccugagaauaaaaucagauccucuugccuuuguuauauuguuaauuauuuuguaaaauaaacgaagaggacacguggcaggaguacaggcuuuggaauuagaagguauuggguuugcaucuacuucuggcuuuuuaauugguuguuuggcuugcacacaucagccuaaucauccaaacccuaguuguccagaaugggacaguacuggacaaguuccagaaugggaugauacugaucugagagguuuuaugaagcuucagugaggagacuugguguaucagucuuugucccuacaggaaacauucucccuccgaugauucaaaugaaggaaccaucuauaaagguguggguaggcguaaggcaauccaacacagcuguccaggugcgaaggaacuaguaacauagggaagcuguucaaaccccugcugcagaggagcuaaguggaggauauaauaguguuacuaggcccagggagagcuggaaccguggaggaggguucugugcugguuguuguggucuuguugaacuaggcagagaaggaucagggaagaaauacccaacccuuuucuccugccccuucugaucuugugcuggcaucuucuauuugccaaagugaaccagaagccagccagaaaguaaguguggggaauugucugccugccaggguacaauagaauggaugagggcagagaauugaucugagaagcaaauugagaguaaucugcacaccguauguguaguccuugacucuucauagggaccaggugagugguagcuauauauugcugccguucagaugcaguggacaagcuuaagagcagcuugauagauuugacaauuaugcuuuaugagcauugauaaaguuuaccacuuuccugaaggcacuuuugauggcagaaagacgauaggguuuagagaaagggaguuuggaaccuuguucuggugcccagccauuuacuagcuguguaccuaugggcaaguuacaaccucucugagucucaaccucuuccucuacaaaaugggaauaacaaaaguagauucuauuauaguuuuguauuauuuuaggagcaaauauaaccaauauguuaaaguauuuuguacccuguaauucauacuauaauaugaacucuuauuauauuaauacauguaaaauuuuauuuccauuacauggaaucuaaaucacaaauaucuauaaauaguuuguauuuguuaaaaugcucuguaagcugaaaaguguagcuuuuauuuauauauucacuuguuuauaaauuuuucagaaauaucuuucuugacuggaaucagauauuaugcuuuuagagauuugaaaucagauaucaccucccuucuaaaauuaaugaggaaauugccuggcuuuauagauuacuauugggauuaaugaguagaauuuauaggcagguaaauuugaacuugauauuggagagaauuuacuaacaauuagaguugauuacuguggaaugaaaugcugauauuaagggagacuuugaugaacuuuauuuauggacacuggaaaaaaaugcaaauaaugcagaaaaucacaagaaaauaaaaguaacuauaaaucucaacaucuagagauaaucuuugaaacuuuguauuacauguuucuuugcuuauauauacauauaaaaauauauaaaguuguacauaaaugaaaucauacuauauauacuauuguggaaccugauuuauaauuaaaaauauaaaguauuagauuuuuuccaguaacuauaaauccauauuaucauuuuuaaugguuguauaauaauccauuguauccauacccacuaaguaaggaaaagaugaugguuauuugaggauaaccaguuagucuagaaauucucuuauuaaaauucgaauguuugaguaucucuauuaguaaguaguagaguaagucagguuuuuugugguuucuuuucucuucucaguguuaguauagacaccauugcuugaauagcagcuguugucucuccuucccccuaggaaguuuggaguaacuguccucuagcuucaaagcaaacgaccuuccuauuuaguggugacaugggagagcaguagcagcccuaauuaaaccuuacagcccuggacagugcucacagugugcaauuuugaggauucucugugugguacaauauguaaaugacucuuaagaggcuuacagggaauagcaaauggaugcaaaauuuuauuaagaucuuucugcuccauuggcaaauaaauuagaaaugcuuuugguugcuuuauuacaguaauacccuaugcaauuuugcuuacuaaucagcagagauuaucucuaacauaauaauuacucaauaacuaauguuguuuaucuaguauacuacauuuugggagacaguuacuagauuaugaauaucuuagcugccaaauacacuuggacauuaauuuauucuagggacuuagcuucaugagaauguuucaauugcauagaaauaaucuaucuguucuguuuuuaaagaaaaucuucuuucacagaaagagcuaucuguuuuuauguugacaguguaaacuauaucuaauuuauucuuguauugacaguuacacuuuuuuuuugcuuuuuuaugcuuuaauguucuucauuaauaaguauuuggaaauauacaugaaauauaccaagauaaacaggcuguaucuuguuauacauaccaaaggcuagccuaacccaugauacuuucauggcagguuuuugagauggauauuucuaagcaguugcaugccuaugagguggaauaucaugugcuacaggaugagcuucaggaaucuucauauuccugugaggauagugaaacuuuggagaagcuggagagggccaauagccaacugaaaagacaaaacauggaccuccuagaaaaauuacagguaaagaaauaaagauuugagcaaauaaguacuucaaugccuccugcaugcacagaacuaccucaggaaugaaagggauaugugcguggaaugaaccauugcuaaccaagagcccauguaucagacuguccaagugcucuggggcuacaaaugacauguuaaauuaaacauuacuuggaaaaaaaugcacccucacaaaauagcuaaauggcaguucaaaguggaaucugcuuaaauaccuguugcauguuauagauauuugguuaaauuaaagggaggaggaauugaauguaggaaauugaugaaguugugaaggaccugggcuugagcuggaaucuggaggguugguggaagaaaugagugaggagggucuuuaagucaggcugaguaggaggguggcaucaaucagaaggacauggcagagcagcaaaguuagccuagugucaauuuaagauagagguuggggagagguaggguaaauaugauagaggcagaaucguaagugacuuucagugucaagccaaagaacauggcuuuaauccugucaagagggaaaucucucaaaguuuuugggccaugcuguagaaagaucaaucugggaaccuugacgaggacagauugagaugggagagaagguaaggaggccugcuaaaagucacuugugaaaaucuguugcggaugaugagaguugucuagacuaaaauggaaauuggaagagagggagacaugucuagguaaauugaaucccaugcaaauguuacauguaauauuaauacaucauuccugccaucagggaguucacaauuauuugagaauauaaaauacuauauaucugucucuaagcgcacacuuauacaugcaauaagaaauuuauuauaaagucauauucgguauuugcaacuuguaugaugugugcuauguagccaugcccugaggggaggggcuuaagagugaucacaggaugggggcuagcaggugacccuucugaagucuucggggagaugacuucaggggaguuucagugucuaauggcuccucgguuuccacuuacuccuccucuccauuuccccaacacugcaccuggcuacaaacuggaaaacacuaaaacucugcuucuauauggugaguccccugucaagaccagucaagagagacagguuagaaaugagggaucucuaaaguaguugcuucccaagaaugggaacacuaaacuuccuucgcuuugucuuacauuggcucuggcucauagaaaauguaaaucuuuuuuucuauucaaaaaagggcaacauacucuauuuucaaaaagaaaacuaaaugguuaguauauuguccauuuuuaguuggauaggucaauggcgauuaauuauuugccccuuauuagggaagguggguuuguaccuguuuuauaaugauucgucugaacuguuguagacuuuuucacugacaguucaguguagucaucaucaguuacuuggccaccccucacaucuauaaauacugaugaaagcccaaguguauguuuagagaacgccguauuucagucagagaaggaaaaucucuuuuagcacugcaauagugucaggaaucuccuguuucuccuucagccaggccagaucccacucacucaggggaacaccaguggguguagaauaaggauuccuacuguuggugaggggggugauuuaguauugaauuauucguguguucagugagaagagaugaagcaugguaguuccauaguuacaucuuugugaaaccuaauaaaucaucguuuccuguagguuuucagaguauuugcuucacauaauauuuuauuaaguaauuugaaguaauugguuaauauguguaaggacugucuccuacuauaaugaaucauuugauuuggaggauuuuuucccccccaaacagguagcucauacuaaaauccaggccuuggaaucaaaccuggaaaaucuuuugacgagagagaccaaaaugaagucuuuaauccggacccuggaacaagaaaaaauggcuuaucaaaagacaguggagcaacuccggaagcugcugcccgcggaugcucuagucaauugugaccuguugcugagagaccuaaacugcaacccuaacaacaaagccaagauaggaaauaagccauaauugaagaggcacggccucagcagaaagugcuccuuagaauacuacagagaggaagagccugcaugucgcuggcccaaggcuggacccugaagcugauggaaccaccuaauacuggugcugagcgccuagucacagcagguggaccucgugcucaucagagcaugccaauccuaagccauuggacauauguagacugguuuuuguuguugcuauguacauauaaauauauauauaaaaugaacauaguucaugcuuucagauaaaaugaguagauguauauuuagauuaauuuuuuuagucagaacuucaugaaauccacaccaaaggaaagguaaacugaaauuucccuuggacauaugugaaaucuuuuugucuuuauagugaaacaaagccagagcaucuuuguauauugcaauauacuugaaaaaaaugaauguauuuuuuucuccaaagaacagcauguuucacucaauggugaaaagguggaaacauuuauguaacuuuauguguaucugucuugauaucuacugacauugucuauaugaggaaaaugauuacuggucaugcuccugugaguuuuuugggaagguagggucauuucucccugccugcuuugugccaacuagcauguugcaucuacaugcauuaugagucugguuaggcauuacuuuaaacauacauaaagagacaguaggacauuguggcugagucuacccagcucaagguaaaggagaauguugcuaauuuuuuagcaaacuagaccagcauuauuacucaaacuaaaaauaucacaccugaaaaauuuaauuuaggaccuaaaaugucuagauuagcuuucugcuuuuuuuauuugaauaacucauucaguugugaaugaauuccucuuuauuuggugccacagucaccaaaugacaaggauuugccacuuucccaccaaauugugagugcuuguaauuuaggucucucuaccuuaaauucaguauaaggaaacguaauuaugauugauuuuuuccaaagaugacaagcuguguugaaauacauuuuuucuuuugaccaauugacagaaucuaauaagcuuuaauaaucuuccccuuuuaugugaaaaguuuugagaacugugaaauguuuaggaacaaacuguugaaauccauuggaagggaaaaaagaaagugguaccaguguuaccagcucaacuaaaaccugcaauucugcauuucaacucuucacuuccucagccuacaaauagcucauuagaugacauucacgcaugcuggguauaggcaaggaaaguaauuuucaaaguacauuugcaguucucuuuuucagagaugauucuaugauagugccucugaaaguugaugcagcauuuuugccuuuccaaaaaguauuuauccucacugcuuuuugcaguacuuguauuuucacagauggauuaucugggguaauuuucuucaaagggaguuuguuauacacagugaaaauguauuauagaguagaauaguaaagcucuagggguuucagaaagcuuugaugaacagaugacaaacaucugaaacccccuccgcacuguuacccaguguguauauaaugacuuguuauagcucagugugcccuugaauccauacaguuucuuaaaagacaauaaaaucuuauuaauaaaguuaauguaacuucuaaguucuagaaaaugcugauucugucugccccauucaauugggggcuacuaauugauuuguugcuuggauuuccugagaauuucucuauuuguaggagggguuuuuucuuuuuacggucuguugaugacaauuacuuuaugggugugaugcaccgaugguagccaaggaaucuguuggggaaguucggaaagaaaccuuuucuuucuuuuauucaguuuaaaguaaacuuuauccuggauguuuagaaucaacauuaagaguuauauuaugguguucagagauuaagcugacuuggauacaauauuuucuuuugaaaaugaauuuucuuuuucauuugugauuuuuaaaaaauguugcaccaguuaugcuucaugcaucguuacaucuucaucagguuaauguaaugucuaguuccuuugcaauaaauauauugcugcagcuuu

SEQ ID NO: 192522 - RNA, 146158 nt, Homo sapiens
agguauggaauuuuuuuuauuuuuuaucuuuuaacaaacuuguucauuuccuuuucuuuccauugagcaccucugaacaaugugauucuuuuuuuuaagucuuucacacuucaggaaaauacuacauucacccacguugugauucauaucggacaguuucuuacucaaagauaacacaaauaccaauucuuauucauacuuugaaacuauauuuuacccuagacugccuugguucaaaggccuaguuucgacauuacuguggcaaauuauuuaagcucucuguuuucauuucuuuuucuguaaaugcaggaugaaaacaauauguaucuccuaggauggcugugaggagugagugagacaggacaugaaagguguguaugaacugugauaacuguugcccuugugggcauguuauauagggcuggcucuaggaagaagccugugucuuuuuucagaaaucccuggagcaacuuaaaugucuuuagaaaugacaagucucucaguuauccaguuagccguaaacagguucuggaagacacaccuagauagaacucggcccgucaguucugagugaggcacguaccacuugggcuugggauguccuuaacccauuuaugccugagguugcaauuuuuugaauuuuuccaaucacaccuuggcgaugaccuugagcaguaggauauaaauaacucccacaugcuuaguguuccaauaauggaacacuaggcauaaacagguuuuaauuggcuccucagucaaccaugaccaauaucucuaucucagcuucugcugaugcccuagcucagggcucugcauuccgugccagggacgccucagccccuuaacauggaugugccacaugacaggcaauaauauauuggccccauuagcccuuccuggagcagucauaaugaauuacagucaugacaggcacauguaagaaaccaaaauuugcuaaauauguacaugagucuucaucacagcaucguuuaugaaaacaacuaaauauucacuaauggugccaguggaauaaaucagagaacauccccugcuacguaacucucugcauacaucaaagagaaugguguggcuuugcuuuuucaacaaucuacugaguggccaugggcauguggauauggccaugaaugagcaagauccucucugauccuguagaaguuaaguucuaccagauaacuugcugcuucaacaaaaagauuuaccuuuuuaaauaaauguuguagaauacuuaaaaaaaacaaacuagaauuugccugugugcagccaguaacaugucuauuuaaccuggacaccuuuugaggaauauucucagauugcccccaugcuguuuauaagacauuguuccuuauacaccuguuuaugaaugaaaagaaacauaaggaguggguacaaagacuucuaucuaugaaugauuaaaaaggcuagaguacgaauacuucuugaaccuuugguacuaaaugcuuuucauguucuauauaaauguagaaaacauuuuacaaauccuguaaauaaacuguuuauuuuuuauagaaagccacaacagaaaaugauuaguauauaacuaacuauguaagaacacuuacauccauacaaucaacagaugcuucaaaugcauauuuuaaaaauaguuuugaguguuaauuaugggagggccuugaugggaucauuuugugaacaguucgcuuuuauaacaaacucaagaggcagcuugccagcgagcucuuuuagacauaagcauuuuuaucaaacuguuuugaaggguuuguuguuuuaaaaucuucuccaccaugauacuuuguccgagaagacaugacagauguggccccguuguauguguaucugaaagguaaaacauaguuugguagauucuauucuacacauagggcaaacaaaaaugggaagaaacuguuucggccugucucugccaauaucuaaauguaaaucuuccucuuucuuagauagcuuucuucucuccucuugccccaagaaguauuuucagugucauuucugagugggauggagaaucucugcagaagaaacucaugacuuggucauuuguucaguuauccucuuacaaaaccauguuuuaaaacucacccuccuggaagcuaggagacuuaguagaggccaucaacauuccugccuaccuagaggaaaauuaugaugaggccaacgugaagaacauguccucauauucagacccuuauuucuacguuagaauuuucuuuggaauauaguaaugguaaaacuuuaaaaaauuaacuguacugcuaaccuuuuccaauuccggauuuuggaaguuucuaagaaucauaugaacuaucuguaauuuguuccacauguaaugauuuaugauagcauucuacuuuuuaacaggucauuuuugucucuuuuucauaccuggguguuuuguuguugucagauauugaaaagcaaaauaugacaccaccaauuaugcacagugaggcuccugcccauccaauaaacagagcggcuccuaauucauaccugugagaaagcauuacacaaguauuacagcucacuuauuuggagaguaaacaguauuuaacacugauagucaacauuuacuaaaugcuuauuauguuuuuuugcuauugaaaauuguaaaggaaauaauaacaccuugugucuguaaaaugcuguaaacucuucccaaaguguuuuuauagccauuagaccaucccaacauccugaaaggagaugagggcauccacgggggcaaagucaaagcaaaaguagucacagccagggucuccugacucagccagcaccuuuccucugcacgcugccuuaaccuugccaagcuuuccaucuauuuguucuguucugcagcgcaaaucauuuaggcagacuguaguuaguuagaaaacaaaagguugcuuuugcuuucauguuaguucaauuuaguaaauguuuauuaagcacgugcuaugugcaaaucgucacuaaucgcugcagucuaguggggaaaugaaucaauagcuaucauuuagugauaaauuacuauuaaggaucucccauauggcaggugacagugcucugccgaugaccgcagcaggagcagaugcaaagauaaacaagacaguacuuccccugggaaggccacgaaacaaagguaugaacagugcuacugaggacaaaaaacaagaucacuugcaguagcggacuagaggaaauccuuucaggggagauauauucacccagagaacaaggaaugagaaaaguacaccaaaauuucagggacuauguguguucucauguuuguuuagcuuucuccagaagaauagguugauuuuagguuuuuguuuguuuguuuuuauaaagaguaacucuuauuuggggcccauaaacuuccauugcaaggcaaaagaaaucuuggugcuuuucaguguaaaauaaagccagggucggagggucuguuuugauugcacagaauccauaggggagaugaggcaagaaaguaagagguccaggagaaggcaagacagggcccaggguuaguuccuuccucagggugcaggggagccaaguucaagagcugaggccaggcuucgguaucagaucaaggccacccagugcugccuggguucguccugagccuugcugcaccccugccuacuugaagugucacuaucucugaacucuggcucugcacaugggcaggcuuucugguguggucugagucgcaggcagggugguguaauagggugggcccaucacuagccaggggagcaggaagcagggcgugcuuuuaaucaagcaugcaugguaccuggcacuggcauccuauuuuagugaaccucaguauuuuaagacacauaucacauugaucagggacacggggcccacuugugcauuuucauuugggauggaguuacgugcacaagaaaugcugcucugugacccuuucuuuacucacucuuguguugccuuuccugggacaucagggugacugauggggcaaggaacagcugcaacagaauaacuagggggaagccccuccugcccuggagcacuaacugugcuuuggcaucugagaaacuucagcggguucccuuaaggggcaauggcagagacagaggguuuguauaagcgaggaaaaacacccucagucuacacacacacacgaacugagcagcgaaguccacaggugaaaaaagagcuggcuaaaucaggagugcugaccgggaguuucagaaaagauacuuucauuaaauauuguguuacacaccugaaaaagaugccccggauuucugcaaucagcccugcuuuuauguuguuuuaaugagauuaugcacagacaacaagcagcaugccugccaaacuggaggugcaugucauuuggccccugaaacaccuggaaauccuagaagauggcaucagaucugucuguuggcacccuuuuuacugcagacaacuaaaggaaugagcauaacugaaaaauucugcaugaaguacauuauuauaggaugacuauaauuguauaacgcuuucuauuuuucucuguuuuuuucccaguacagguuaggcuaucuucucuccugaaacuauaccuuaauauuacucuuaguguaaauaugcccugaaaacauggucugagauuuuucugaaaauauugagcuucacuaaaauagaaugccagugccagauaccaugguugauuacaaauaaauaaauaucuaauuauuaauaguggccaguugggggaugaagaugauagaaaucauaagcauagcuuggcacaaugaguucacugaaaggagcauuacaaacacagacacaguauugcuacaaaucacaggauaaauuacccaggcggaugaggaauugggucuauguuaagccauauugaaacuuucuggagaaauuuaggaaucaugaguuuggcuuauauuaauauuuaauaucuuuuuaaauauauccuuuuuuauguaucuuuuucuuuuuugagauggaaucucacugugucacccaggcuggagugcaguggugcaaucuuagcucacugcaaccuccaccucccgaguucaagcgauucuccugccucagccucccgaguagcugggauuacaggugugugccaccaugcccagcuaauuuuuguauuuucaguagagacaggguuuccccauguuggccaagcuggucucgcacuccugaccucaggugauccacccaccucagccuccuaaagggcugagauuacaggugugaaccaccacacguggcccuuuuugaaaaauaucuaagucacuacauauucacucuauuccaaggaaaaaaucauuuccauuugcauuucagugugaauuauguuggagacaaacauuuaauagacaguauccauuuggagaugauuucagaaaccauacaucuaccccauuuuuuuuuuaacaauuuggaugugagggcucuuguuuguucuuucagagacuuuuccuucuuucuauugaaagacacauaucacagacuuacucaacagugacuuuaauucacaccucuccguguguaucuggcaaaaauugacauguguucauauguuuauugcggcacuauucacaauagcaaagacuuggaaccaacccaaauguccaucaaugauggacuggauuaagaaaauguggcacauauacaccauggaauacuauacagccauaaaaaaguaugaauuuauguccuuugcagggauauggaugaagcuggaaaacauuauucucagcaaacuaucacaaggacagaaaaccaaacaccacauguucucacucacaagugggaauuaaacaaugagaucacuuggacacaggguggggaacaucacacacgggggccuguuguggggggaggagggagggauagcauuaggagaaauaccuaauguaaaugacgaguugauggguacagcaaaccaacauggcacauguaaaccuguguaucaaaccugcauguugugcacauguacccuagaacuuagagguacacacacacacacacacacacacaaauaaaaauaaaaauaaauuuaaaaauaucaaaaaaaacugacguguguuauugaaagacaggguugagaaagagaugaacauaauauccacuccaguuuguucccaaggcacauauucuuucacauugauuaggagacuuauuuagucucugucuggaaaucuuucuuccuuuucgguaacacuaagaagcugauuucaacaccuugguaagauuauccaaauuucagauucucuguugcaggucuuuugugaacaauauccuccuggcccucggccagccuuccugcucagagugugcccucuuuaugacuaauaccaaaguuucuucauuauucugaaagguugcaaaucuacaugacacuggaccaauccauauccaugacuuucagguugaggacagaacuucauuuauggaggaaaacauuguuuuuagaggaucuuggugauggacuaaucaaaagcugcgcguauaacuucaauacacauuaauaaagucacugaguggcuuuagaaacaaggaauguggaacaaauuuacuucuaacagaaauuaaaacacagauaaccacuuauuauuuucucaaagaagaaaccauaaagaucuaaggugaagucacucuccacccagcuguauguggugcuguaggcuguugcccauggcucucauuucauguugagcuggccagggcuacaccaaccuggagaccuugauucugaugcauuucauacuucaacuuguaguuuagccauuuagaguaauccuaaggaaauggaaugcugaacaacuuacuuucaccuccugcuuuugucuuccuggcacccaaaucccuauucugaguuagguuugccauccauggggagcugguguaaccuccucugguuaccuacacagaaaugacaugccagguauugugcuaaucagguguucagggcagauaagagggacauggcccuggcucacagauccagauuguauagucuaguggggauagucagacauuaaacugauaauuacaguaaagugugaucaaacaauaaaaagagcauguuuuugcaaaguaaacauuaccgugguucucccaaacacgcucagaugugguucaagucaauguccauaguagcuaacaauagcuacuauuacugucagcucauuguacuaggacuuuucggugugugcuaagauuuuuucacaaauauuaccauauucaaucuucaucacaagccugggagauagguauuacuauccucauuuuacaaaugaggaaacuaaggcucugggagauuaaauuacuuguuccuucaugucucagccaaguaaaugguagacccaggauuuaaaacccauaacugugauugcaaaccgaagcucuuaauugucaugccaucauccuuuuauguacacuuuaaguaaaagauuuuauaacuauaaaaaacccaaucaaugcaacauauuuuuaguugucauuucagaaagaucggaguugucucucucccuggcucauuaaguucucaguggcucaagagcuucagggcacaggauuuuuuucugaaugcccucgggcugccuuuucuuccggcacaaaaagaggugaggauaccaauuaaaaucagggcauguuggagcugaaaaaggaaagagcagccacucccaaaacaaagcaagaucgguuuuaacaaacgaaagcaccucauccuuuuaagauccccagagaagugaagcgaccuugcugaaggucacagagcuaggagccaggucuuuugucauccuucaauauugugucuuuuucaaacauauuguccugcuccucauuuuaaucaagaguaguaacagccaaaaugcauuuuccaauuaccuuaaaauaacuacauagguuuuuuuacaaaguuuaaaauccagaaaguacacucauauauuaucaaaguuaacauuucaaaauugaauucuauuggucuaacauaaaacuuuuucuucagugcauugucuuauauuaaauauaaucuauaaucuaagaucuauauaacugcaugaauugauuuuauuuuuauauaaguauucuacagcaauuaucagcauuuccccaaaauacgccucauucuuuuggggccccaguuauguggggugcccgcugauccugcguaucucucugaggcugccaugguccagucucucuuaugagacgcucagccucccccucugcuggguucucucccacugccuggcagaugccaaaggacuuccuacccaaggcauccaacaagacuugcaaaauagugacaggugccucccaaaugguggcuaaaguaggauggaaaaauuuaaguuauaagugucuacuuauauauggaaacuucauagagaauucuuacauuuaggaaaccuaaaauaaagacauuugggaggggguaccuaaacaaaaaaacugcuuuucuguggcuagauuauaacagacauaugcccauuauccuuccaugcacugugauuuucauuaggguaguucagaauucuauaaauuguauauauuaauaacagguaacauugauugauuaccuaccaugugucacugugguggaugcuuucuagacguuuucuuuguauuuucuaaaaugaacauguuucaaggauuuuauuuagcucauuaacuaauuagggaagcagauauauuaggucugugcaaaaguaauugcaguuuuugcuauuaaaagcaaugacaaaaacgcaauuacuuuugcaccaacauaauauguuacaaauuguccaaagguaaauucaggaaacauauuuaggcaaucaggaaugcugaaaugaauuuauaaauaguuauaaaacuggucuauauauauauauauauauauauauacacacguauauguguguguguguguguguauauauauauacauuuuuaaauuauguauauauuuuauuccuccuaucuaacugaaauuucauaucuuugggccaauaucuccccaauauguuaucuucucuaauccucuuaacauucagaacaggaaauauugccucuguuauccagucaagacaacugcaaucuaccuaauauaacaguagaguaagggccaggacucuggcccgggccaggaucugagcugagucaaacuccaaaaccucacccuucuccucuccaccaccugccucucuaauaguguguaaagugaucagugagugucuacacagaaguacuaauucuugaaaauuauucacagaaauuuaaaaaccauccacaguaggacuaaaucuaauguuggcuaaucuuuguuagccaaaguaaacuguaauguaaaaggaacaucucauguuccaaaagucacauaguucaauucaaaaccaaaucaguugcuuagcaccauccaugccauugaucuccauucguguguggauaauugggggguuugcuuggccguaagugagaaaugaggcaccgagucauaauaguuacaguaggcacaauaacagguuuacaugcagacuuugaagucugaauaaacugacaucacagagaaggcugugcuucaagaugggaaauuccuaaaauaacaaauacuguccugagcugccuuagggcauggccaguauugguaagcaugggucaagaauccguguguggauguggguguacguggcuuuguguugagguaaaaauauacagauggacuugcagcaaaagaagcuugggucaaucaaaagugaaucugacauuaggagaucgagaccauccuggcuaacacggugaaaccccgucucuacuaaaaauauaaaaaauuagccgggcgcgguggcgggcgccuguagucccagcuacuugggagacugaggcaggagaauggcgugaacccaggaggcggugcuugcagugagccgagaucucaccacugcacuccagccugggcgacagagcaagacuccgucucaaaaaaaaggcguaucugacauuuuauucagucuucaaguaaccuaccugagcacauuuuagaauugaaccaagaguauccaguugacaacuuuaaauuauuacuuaucucuaacucaaugcuaugacagaggugaccaacaauuuuuaaauuacacaagccuuauuuauuuuauuuuauaucuauuuauuuauuuuuugaggcagagucucacucccucuguugcccaggcuggagugcaguggugcgaucucagcucacugcaaccuccaccccccagguucaagugauucuccugccucagccucuugaguagcugggacuacaagcaccugccaccacacccagcucauuuuuguauuuuucauagagucaggguuucaccuuguuggccagucuggccuugaacuccugaccucaaaugauccacccacguuggccucccaaagugcugggauuacaggcaugagccacugcacccagccaagccuuauaguuucaugcuagguccccuucaaacgugccuucuacuugagagccaagugucuuaaaacaauugucucuucuacuaggucuccaacauuucaacauacauuucucuguggcuaaccuuaauagauuacauaagguaauauacuauacauuaauauacugugcauuagggucaguaucccuaaaaauaguagcuagcauuuaguaaguguuuacuaugaacuagcaugauucuaaacaguugaaguauacuaucucauuuaauccugacaacagccuccuaguauguauuauccucauucuacggaugaagggcacugggcacagaaaggguaaguaacuucuucaaaguuacacagcuagaaaguggcagagcgaggguuuacucucaggcagccuggauccagaguccuuauucuugaacagugugccaugcugccucucccuguuccuuuaagcgaucaccacaagcacacuccgucuuaccauucuaggagauaugcagacagacagacaguccuacaccacugcagauuuaccauccuugcuguaaggaucauggagcauggguccucuacaagagauuccaaagugaguaacacaugguuucgacuucuagaugcuuguggucuuguuuaggagaacaaccaauaaauaagcaggugcaaaccacccaguaggguuaggauggaagcacgagguagaaagggagcacccaaaacagggacaccccacccaaaaugcagguucugaaggcugaucagagguuagccaggaugugaaaaggagaggagcaauggggguaagagcugaauuaccagaaagcagggcacgcuggcagaaaucaugaugucaugcacuggucagcaaaaacaaaagagagcgccaaauauuuaguucccaagcagauuuuuaggucaugcuagcauaacaaaagcaucuaaguaauucuggugaucugagguggccugcacuauuucugaacaaacugaaaccacugaguaacacuuucuuaauauuuaacaguugaacucuauuuuguucuuaccacuuggcacuuaucuggaaucuccuaucugagaauaugugagaucacuaccaacauuaguucauccuccaaauaacucaugaauggaguaaacuuaaauaaacaaacauccauaauguauuaaauuauaauaaguauagaagagagaaauuaaacaucuugacaaggucaccugaugaggucaauauucuuuucaaccucacccaggaaaaucuguauagccuagaaauuuacuucuuacauugucuaguguccauucaacuugacaacaagaaugagauaauuugacugaaaguagguaguuguucacaugcaaaucaauaaacguaauccaucacauaaacagaaccaacgacaaaaaccacaugauuaucccaauagaugcaaaaaaggccuucgacaaaauucaacagcccuucaugcuaaaaacucucaauaaacuacguauugauggaacacaucucaaaauaauaagagcuacuuaugacaaacccacagccaauaucauacagaaugggcaaaccuggaagcauucccuuugaaaacuggcacaagacaaggaugcccucucucaccacuccuauucaacauaguguuggaaguucuggccagggcaaucaggcaagagaaagaaauaaaggguauucaauuaggaaaagaggaagucaaauugucccuguuugcagaugacaugauuguauauucagaaaacuccaucgucuuagccccaaaucuccuuaagcugauaagcaacuucagccaaguuucaggauacaaaaucaaugugcaaaaaucacaagcauuccuauacaucaauaacagacaaacagagagccaaaucaugagugaacucccauucacaauugcuucaaagagaauacaauaucuaggaauccaacuuacaagggaugugaaggaccucuucaaggagaacuacaaaccacugcucaacaaaauaaaagaggacaugaacaaauggaagaacacuccaugcucauggauaggaagaaucaauaucgugaaaauggccauacugcccaagguaauuuauagauucagugccauccccaucaagcuaccauugacuuucuucacaauauuggaaaaaacuacucuaaaauucauaugaaaccaaaagagagcccacauagccaagacaauccuaagcaaaaagaacaaagcuggaggcaucacgcuaccugacuucaaacuauacuacaaggcuacaguaaccaaaacagcaggguacuaauaacaaaacagauauauagaccaauggaacagaacagaggccucagaaauaacaccacacaucuacaaccaucugaucuuuaacaaaccugacaaaaacaagaaauggggaaugaauucccuauuuaauaaaugaugcugggaaaacuggcuagccauauguaaaagcugaaacuggaucccuuccuuacaccuuauacaaaaauuaacucaagauggauuaaagaauuaaauguaagacauaaaaccauaaaagcccuagaagaaaaccuaggcaauaccauucaggacauaggcaugggcaaagacuuccugacuaaaacaccaaaagcaauggcaacaaaagccaaaauagacaaaugagaucuaauuaaacuaaagagcuucugcacagcaaaagaaacugccaucagagugaacaagcaaccuacagaaugggagaaaauuuuugcaaucuacccaucugacaaagggcuaauauccagaaucuacaaugaacucaaacaaauuuacaagaaaaaaacaaccccaucaaaaagugggcaaaggauaugaacagacacuucucaaaagaagacauuuaugcagccaacagacacaugaaaaaaugcucaucaucacugcucaucagagaaaugcaaaucaaaaccacaaugagauaccauccaugccaguuagaauggcgaucauuaaaaagacaggaaacaacagauucuggggaggauguggagaaauaggaaugcuuuuacacuguuggugggaguguaaauuaguucaaacauuguggaagacaguguagcaauuccucaaggaucuacaacuagaaauagcauuugacugagugaucccauuacuggguauauacccaaaggauuauaaaucaugcuacuauaaagacacaugcacauguauguuuauugcggcacuauucacaauagcaaagaguuggaacaaacccaaauguccaucaaugauggacuggauuaagaaaauguggcacauauacaccauggaauacuaugcagccauaaaaaaggaugaguucauguccuuggcagggauauggaugaagcuggaaaccaucauucucagcaaacuaucacaaggacagaaaaccaaacaccacauguucucacucauaggugggaacugaacaaugagaacacauggacacaagguggggaacaucacacacuggggccugucaggggguggggggcugggggagggauagcauuaggagaaauaccuaauguaaaugaugaguugauggguacagccagccaacauggcacauguauaccuauguaacaaaccugcauguggggcacauguacccuagaacuuaaauaauaauaauaaaaaaagaaaguagguaguuguuuauuucuaacuacuaaauagccacaauggugaaaauauuuuauuauauaaagcuuaaauccuaaaguagaaaccaaauacaugccaggaaugagaagugcgacaugauuuugaaaagucuggaaauaagccuagaggaugauaagaccccaacacaaaaauagcugggccaaaauauuaacgguaaaugucauauacaaaaaaagaauaagucuaagacaacaauucuguucuacuuccucaaccagagcaaucaguuaagucguauaacuuugcaugauuugaaaagaaguuucuuaauguugaucaauucuuacuugcaaugguuuaucuaagaaaacaaagcuggacauucagaaaguuagugguuuggauaacaaaacaauggugggaauaacguaauuaaauuucaacauccugguauggugaaucaugcuaaggaguacccauuacuagaagcuugcaggagauuuuuuuuuuuucagauuuguuaguuuuuguuuuaauaaaaaggaggaaguuaguuugacacagccuaaagggaaaaguugaaaaacaguuuucaaggcucugcaagagcucaugcuggagucaucaaacauagucauagcucgaaugaaaaaaagcaaaacaaaagggaaaaauagagaaauagcagaacacgaugaaacucuuuacagauugcaguucugucaaaugauuguagcucggaagaaaaaucuucccagauacguggugggaaaggaaggacuuuuagaggaacuagccacugaacauaaagugcaauacugccugccaugugccugcugcaaucuuuacuccaaguccaugcuagaagccacucauuuuuuccucaucaacaaagcuccuguugaguuccuugcauauagcaggaauguauagggaacuugguucaugagcuuaguuguguuuuccuaacuugggcaaccaagaugugccuuauguagaguuguccuggaaaucuacaaagaagauccaauuaacacggcauacaaaucugaaggaaaaacaagagcagcagcaaagcaagaacaacaaaaccaugcucugaggucuaaacucuuuuccuuagggguuggguauuggagagcaaguauuugcucaccagaaauuuaaacuagaacaugugacaagucgcugucucucacugcgcuuccuaagggcccaaacacacaugcuccugcagggagagaugguauuuaguggcagcuaguuuuuguaagauuaauguaagauaauaaugggaagaagagagcuuucuugcuccauccucugggaggcucccucuauccacugagacaacaauuuucuuugcuaauucugaaaggacuaggucuacacauaagaauuucacuucuagguacugugcuagggaaagaagauacaguugcauagacguuuucugaccucaaggaacuuaauucuuaugccagcugauuaagacaccaaagacauagaacauuccuauaguggcaucuuccacaucccagccuaucuaggacuggcccugccacaagcuuugauucuacaacguauuccucucuaaguucauguacaaacaaaaccagaagcaucaauuaucaaauuccagcaaaugcuagccagagaagugcuaucccuagaauaagccaaaauaaaauauugcuuuaaagaugacauuugagagcuaggaaaucaguucauuuugugcugauagccaauuuauagcuuauucaucuucccaguuuuuauccccucuacuagaagguguugauaaacggaaaccaagugaagucauauuaguuaauuuauuaguuuuuauacaaguguguuuuguuuaaaugaggucugaguucuugugggugucaugucauuuuuaugccccuuuucuaucauuguggguaauuagaaucugaugguaucuacaauucucaggccuugauaauuccuugauccaacuggauuuuguugaaaucauggaggaccuuucuuugugaaaggcacugcagggaaaacagagaugaaggagagaaaguccuaaucucaagaagucaacucauucucaauaucagguuuuuuauagucuauauuuucuauagaccuugaugcaaagggccuguuauuuguaaauauuaccaauggauaagcacugcuguuuuucaugaccccugguucuugugcuuuuaauuacauuagguaaauuggugaauuguagguguuauauuuuuaagccacugcagaaaagagcuaauaaaggcaucuauaaagauaagccacaucuuacauacuauacagaauuaaaaagcaaucuuaauaauaauuaauauaacacaauaagagcuaauacaagguguuugcucugugccaaucacaucuaucucucucucucucucucucucucuccucucuuaacucucacagcaauucugugagagguaugcuauuauuaucuuuguuuuacagaugagaauacagacagagagagagagagagagagagagagagagagagagagaguggguaggcagagacagaaagagaaauuccaagaagcuaaugagaauggaauagccaauguagcaccaagagguugaaaaagaggaaagccucucauagcaccuaauuacugaacugaguuuaaucaaaaucugaaaagagaauaagaaauuccaauggcacuacacugaauuaggugacugagcuauaguaaggacagaaaacagucacgcaaagauagguuuaaguuauuguuuguacacaaauuagccuugaccauuugaggaaagaguccaaugauuuuuaagauauagacaaagauauccuuaauaauugucaggaaaauaaaaccaguaauauagaaaagauaaugcggaagagugagaaauguguuuaauaaaauaaaccaugagaaguacagguuugcugcauauuuaugauaucaaacccuaaaauaaaaauguaucauuuaaauacaauauuucuuuuaaauaucauuaaaauauuucuaagcuucagaaauacagccuugguuuuuauuucaauguuuccugccauguacaucugugcaaaucucauuugaaagauaaguaggagaaaauuaauaaauuaggacauguuuuuguauuauaggcaggggauaaaaaaguuauauugaggucuaaaacccauuuaauaaaauuuguuuuucuuucccauuuaauaacauuucugaauaaaaacuauuuuuaaauguauagaaaaggcugggcaugguggcuuaugccuguaaucccagugcuuugggaggcugagggaggaggaucauugaagaucaggagcuggagacaacucugggcaacauagcaagaccugucuccguuaaaaaauguaaaaauuauccggggccgggcgcaguggcucacaccuguaaucccagcacuucgggaggcugaggcggguggaucaccugaggucaggaguucgagaccagccuggccaaaauggugaagcccugucccuacuaaaaauacaaaaaaauuagcugggcaugguggugcgugccuguaaucccagcuacuaaggaggcugaggcaagagaaucacuugacccugggagauggagguugcagugagucgagaucgcaccacugcacuccagcuugggcaacaagagcgaaaacuccaucucaaaaaaaaaaaaaaaauuaucugguugugguggcacauauaugucccagcuacucggggggcugaggugggaggaucacuugagugcagaagcgcaaggcugcagucaacuaagaucacaccaccacacuccagccugagugacagaaagaggcccuaacucuuaaaaaaaaaaaaaaaaaggacgaaagaaaccucuugaugaacaguacauguagcauauugucacaaaaauuacaaaauaguggaauauuagaaaucaugcuuuuuaagagccaguguucugaaguucaacugccugguuugaaucccaguucaaucagccuacuaguuugguccaaguucccuugaacacaucacuuggccucuuuccucaauuuaaaaaaagaguaccaagaggaccuacuuuauaagguuguuuguaagaauaaaauaaaauaacacaauaaaauaauauuugcagugcucugcuuggcuccugguggggacucaacaugcgcuagcuauuauuuucauuuuauuucaugauauaagcauuuacuguuuaugcguaagguacacuuaagccagaacuagaaaaucaauuuccugaagauuccuaaaaccaccagaaaaaaaguaaagcccagcugaccagcuauuucaguaauauacuucuuaaaaauucuauaaaauuugaccugaagucuaaaauaaaauuaccagccucauugauagcaauacacacacacguacgugaggcuuccuaaagagggauguagauacauucuuagguaagacaaaauauuuaauauauuaauucugauuugguaucccugggguuuucccaauccaaagaaauaagccuagggaaacuauaaaaagcaacagcccauaguuuaaaaacaacaccaacaagcaaacugaucuguuaauuccaaagcauucaucugcaagacugaccagccacauuuggguaaaggugccgugcuccuacagcauuuuucaaaaaccuugcaucguauacaguuucuuuauaaagguuuauuaggaggagcuuguuaagacaguaguuaauacagcaaauuuaaaagacccagaaacuagcaucuggcaaauaucauuuugagugggcaacaaucaaggcaagguuuuaauuuucuauucgcacaccgcaucauucuuuccucuccgucugacaccuuucacguuuccucuacuugaccucaguuucaugauguacagcaaacgaugaaguuuauaguucuaaauuugaugccuugaacuguuucgagacaagacacugcaacacuagcaaacuaauuaaaugcauauuuugcguauguggcauaugacacauuuaaucuugaaugaugucaucaguuaccauuuaucaguaugucuuacuuucaaaagucauauaggaaauucaugucucuugguugagaauauuaauuuauauacacuuccugugagcuggaaacagacugagaagaguacuuacuuuugcucaacaaagagaggaucaaagaauuccguugugauuuuguuugcauauagggaacauccagucauugagcacagcccuaacaaauauuagagggaaagcacuaugguuagugugauuucauuaacaucaucaaguaccuuguuuggaagaaaguuacuauuuaccugacaguaugaauacaaucccagccaaacaagcaauuuuagcuuuggcuuuaucggagccuccgacuuugguacacuucauuccaaagagcgcaaauauggaaccaaagaagcccaggcugacagcagcgaucauaaguccucuacaugccuguauauaaccugcaauuagaguaggucauuuacguuacauaaagcauguggcuguccagggagaaauccucauuuuacguugucauucuggauguuuguuuuccaaaaagauaacugugauggugaaaacauguggcaagacaagcaagaaaggaaagcaaguuaaucuacagggagugccuauucuaggucacacacugugaagugcgguuuauggggaauccucaggauagaucugaguguuauuuccauauucaccagugaggaaacugaggcacacaaagguuaugugacuuaccagaggugaguuagaaaguggcagacauggauuccaucccaaaucagacuacgaauuccauauagugaaauuccacagugaaaggugccuuucacugugaaaaaacaucaucugccaccaucacaacucuguagcuccuccgcucauuggacuuuaaaaggguguuuuaaugguuuugacauuaucaaaugauaagauuuauaacuggguggcagaaagagauccaaagggucaaaccuuccaauauuaguggacgcuuauuaauagcagacuaacuggaauaucaucaugaaccauggggggucuaagggaauacuuuagugaaguacuauuguuuucaggguguauauaauaaaacuggguuuuaaaaagcacuauuuuguagaagaguaauuuauagugauuaagucaacuguucuuuuauaaaugaaugccuuuaaaguacccuaacgaguauguucugucaguucguuuguucauccuuccugugcuauucauguucuuagucauguauuuuuauuugcacagccaggguacacgguaaacuucaguguggcuuuuguccagguuuuuacauuaacaggguuuaaacuaauaagcuuuuaccacauaagccauuuucauuucagccugaaacaaugccauauuucgaucuaaaauagugauaguagcacauaccggguguaaguaaguaucugcuaagcaaauaaacauauauaccuacaucagguuuacguuuggaauuaaacuuuuuaacuggaaaaaaccucuuaugugucaauauaugauaagucauuuauuauugguguucaagcagagccaugauaaauaauaauuccgagaccaugauaaucaugaauuuagggaguacauacuaguggccuccaguucaguuucuuuuuuucuuuucuuuuuuuaacacaggaucucacuuuugccacccaggcuggagggaaguggcauaaucauagcucacugcagccucaaauuccuggguucaagagauccuccugccuuagccuucugaguagcugaaaccauaggcgcuugcccccaccuauggcuaauuuuuaaauuuuuauagagacagugucucgcuguaaugcccagauuagucucgaauuccuggccucaagcgauccucuugccuuggccucccaaaaugcugggcuuaaaggcaugagccacugcaccuggccccagucuguguuucuuuggaaaagaaugaaauugaaguuuuaauccuauuccuuggacccauuuuugaagagcaaacaggagcugcucuacuuaauuguaaacacuuuagacucccacaaaugcagacugcaaggacagugaccuuccauuguguagugugaaauauuuccauacagaaaacaauuucacuaacaccguggcuaucaaaaacagcaaaacaaacuuauuuuuagcaaaacaggauaaugaaggcuucuuucauagcaaucauugugcugcagggcuaucugggucuccgcugccaaaugcugaaccagcuguauuuuaaacuucaguccucgagcuccccagccagagcccagacagcagguagaggcaagacagagaggggaagccugucagucccuugcaaguuugaagagagccugugaggauaacccaaacugguucaucacuugccaccagggcuacucggacagugugguuucgcucuuuuugugaaauucauuuuaaucuaugguuuugagguuuuauagcugacucugacugcagucauuaaauaaacaaaaaaaugggggacucauccauuuauauauacucccagaaaacauuagcauguacccuaauuugcauugccuuuaguuacuuccaugcuuuguuaacagaaagugcaaguugucgggaauuuaccaaagguuaaauucuacaaucuggucauuuagaacgcggaaugcauuucccagaugauaaacaguggguagaaucccaggccaacccauucgauucuuaauacaacagggaaaauaacaguagucuuugaacuuuauguaaucaccacugauaacauuuuucccgaguuucucacucugagaugccccgucccagcccugguauuggcagcaggacccacuuuggucucuugacacaagcaugagaggagaagugggcagggcagauucugaucuggucagguccuucuuuugugccaaccagaacccggauuuggaaaaugagguaccuuucuccagcaugaacagcagccauaacuuguuaauuuugcgcaugcacaaagaaggcaauuuacaaggacgaucauuggccagauuuucugaaauggagagcaaagagcaggggauaaacuccccugccagccauaaauguaauggaguugcucguaagccugagauuuguaaauucucaguguucuaaggcuaccaguccuuacaacacccacagauuggagccaagaugauuccaacaaacccuuucagaguucaucuuuugcaaagcagaccucuacagccuugcuuucuaacaguuccugagggcaaaacuuacaaguaacaccaccaggagaaguguuaguaaaaaccuagucaaggaggccauuauuuuugacaggucuaauuuacugacacuguuaauagcuaauuaacacauuaaggugcugaggcaugaacauauuuauuuagaaguucucugaaguauaauuuauaguuaguucuccugggagaaauggcaagcauucccacuagcaaaaauagauggcauacacuaaaaacaagcuggcugaaaaucauacucagcugaaguucaagugguacuuugaaaggaguauggguuaacaauaaacagaaaucacaagcucauucagcugugaaauuuucaaauaguaaaauacagugacuuuaaauuaaugaacucuguuggaggaaagcuucaagguguuccuuaaaaguuaaguguuuuccaaauuauguguacuuuauuuucaauugcaaaucagcaaaaaacgaaaacauccacuugguggagacaauucgcuaauagcaccugugcuaguugauggauuuaggggggaaaaaagaaugugcuuuucuuuuccugguagcuuuguguacuucugcaaauccuuugagagaacagugguauggggagggcaggaacucugaguuucaccucuggugcuucuauuuacccaagguauguacuugguuauaggaccuaaucucuuugaggcucaguucucucaucuguaaaacagggauggcagcaccuccuucacaggaugaauaauauggaugucugcugagcaguaagaaagucaucaaagcaucccgucauauuauaauacuacaauggauucuaagcagaaauuagagcuggguucuuaauauggcauaacguuaaaucuagacauauagcuuugcuaggccucauuuuucuuauaaggaaaacaaguggcaaugauaccccuaggggaggggaaucagagauuucuuuauauaagaaauuuagggcugggcgcauggcucaugccuguaaucccagcacuuugagaggcagaggcgggcagaucacuugaggucaggaguucaagaccagccuggccaacauggugaaacccugucucuacuaaaaauacaaaaaucagccagguguggcagugggugccuguaaucccagcuacucaggaggcugaggcaggagaauugcuugaacccgggagguggaaguugcagugagcagagaucaugccauggcacucuguccugggggacagagugaaacuuugucucaaaaaaaaaaagaaaagaaauucagaauaaugaccucgucguuugacuccaagaguucuucuaccuaacacaagauaggcaagagucacgagccuucucucucccuuccuggauucucuucccaaucuagagcucauaccuggguuuaaggggagggcuguuccacucaggccaccauggccacuuucuccaaaggcaaugucaggaccagcacccaccagauguggcugaccugggaaugcaagguagaggacaaacagagggccccuacccuggaagcuuccacuugcaggugggggaaucaacuccccuccacaggaaaacacaguugcaugauuuaacccuccaagauguuauucugagagauacagaaaaguaaguuuguuuugcgguaagaaaugccaucuuaagccacagaaggaaagucaucaaaaaaacaggcugauaaauaugauucuauuacaaauuucaaaguccugugugagaaaaggcaucauaaauuuaaaagaugaacaauggugugagauugcaaccuacauaacaaaucaaggacugacaaaucaucgaaaccacaaagaaacaacagaaccaugggccuaagauauggaugccaauucacaaaagagaaaaaaaaacggucagugaguuuugaccauuuuuauaaccagugauuuugaccacggcaauaagggaaaugccaacuaaaaugauaagauggcugggcgcgguggcgcacaccuguaaucccggcacuuugggaggccgaggaggguggaugaccugaguucaggaguucgcgaucagccuaacauggugaaacccugucucuacuaaaugcaaaaaaaauuagccgggcaugguggcacaugccuguaaucccagcuacuugggaggcugagacaggagaaucacuuguaccugggaggcggagguugcagucggcugagauugugccacugcacuccagccuaggcaacaagagcaaaacuccgucucaaaaaaaaaaaaaaaaaaaacuggauuaacacagaguggugagaauguggagaagcagguauucucauacacugucaguggaaaguaauuugacaguaugaacugaauauuaaaaugcacguguauucuacugcucuuacgauaccauuucucaguggaauggagucuacagaaauacacacacauacaaagaggugaauauaagauuuucaguaaagcaccaccaacaaagaaaagcuggaaaagguccaauguccacaauggaucuaugguuaacuaagccauuuuaugcagucuaaugaauauaccaugcagcaguuacacagagucaagucacuucuauuaaguacugacuuggaaaaauacauugauuuuaaaguguuguacaacaguagguagugucaugccauuuauguuuuuaaaagucauuuuuuagucacaugagcacacaggaaggccauuuugcaagcuggauggcauaaaaaugucacuccucucuguucuccucccagcuaaccaggacaacuauuccuacuuccucuucacucccggcccgaucugcccccaaacagguaugguaccaccuccacucucacugcagacauguaggagaaaacuuuauuauucugcacuuaauaauauucauagagcauucauuuccuucucucccuugucccccaacuguccuacagaaggaagcguaccuaucuggcacacuaucucagagaacaauagaguuacaacagaagaguguucagaggacaguaacacauugcugacuauaaaucacaggaacaagagaaugccuguucaucuaccuggaugcgugcucuacaaaccacaggaaauucaacgguaaugcuggggaauaaacacuguuccggcugcuuauuuuaccgaacaggacacggacccgggcgccacccuucuaaaacuagaugcguauuccuuauacggagguuccaucaaauaccacguugagcaacaguuugcucuucguggcaaaccccaucuuagaggaaucaacuauuuucuuucauuuacccagcuauguaaacaaaaccugcaagugcgguaauaaaagaaaaaaacaccucaaaucuagaaauauguaauguaaauaacuccucuuaaguuucugccaggauucguuugcuguaaaauccuggaagcaacgggccuagaacuugagcaaucaaugggaccgggcugacaucggcuguugucuugaaacucaacagagccagaguucugugugaauauccaccagcugcuaccagcauaaggccugacuaaccagagcaacgcaggugaaccuccacaaaggaacaacccaggacagcagcaggcaccggggacucggaugcagaacuggucagcucccggcgccacgcucucacggcccaagauucccuacccucugcggacucaucgcggcaccgcaagggcuauuauuuuccuaaaacucggaggaaguguuuguaguguugccuaggcagacaaguuuguagaagcucuuuaaagggaaacaauaacaacaacaaauucugcaauauguuuucccgcuuccaaccucucaacccccacccccgccuacuuuuaaaagaaccaacgaaauggcucaagggaggucaggacaaacggauuuggcuugcaaugacaccauuuuuaucagaacccagccuucggggaacguaggggagggagguggaggagacaagccccugcagcaugaacucugggucccagcgguccccaagauauggggggugggggagggcagccgcuuccuugacucucaggaccgcaaagcuuccccaucccccgacgccugggagucaccaacccgggccugucugcguguccccccucccggggucccaggcucgaacaggcgccccgcgagacagccaucaggagagggcgggcaccaggagcgucccuggcucccuaaggcccuguugggagagacgggucgggccucagaggaguccagucuaggggucccgcuggggguauugggggcgagagggcgccuagcgggcuggccaucaaggaaggagggcugagggcgggggccgcggggaugcagaccguccagcgccagcauggaggggaaguccuugcaguuggagacgcccguggagucgguaacgcacgccuuccacagguuggcccaauagguggcgguugugaugaccgugccgucgaugguagacaccuuccaguagucggugggcagcguggaggacaccaguacccagccugagauggagaccaugaaggcgaugaucuccgaagccgugcuagccaugccgccggcugcagccgcgcucgcucuccggcucccacucugcgccgcgacccccgcacucccaaccccggggcuccgccucccgccuccgccuccgcccaccguccccgcccaccaccccgcccagcggacccggcgccagggggcgcacgcgaccccucacacccaugcccugucccuugaggggccucagagggcucgcggucgccccccggguucuccaucugcagcuggcccgcgcccgcgugcgggaggaaggccggccugcgcuccccugagccaaagggccgcggagaagggcucgcuuguuggagcggcucagguucagacuggcaaccggguguggacaaccugcugcgcccccaccucaccacccccacccagcccuacccaaggcaaauagcuuggcuuccugacuaccuuguagaagcagagcaggaaaagccuuuugcaugcccugaaaggacacgguuugguaacucagcccucgguuugcugaacucuaaagguuugcgugccacgcuuguuugggugacucuguuugacuugucaaggagggaucauugcagauucugggcuggaaaccggccuugcccucaaaacucugcaguucuuuuuggccuggugcuaugcggaaagucauggcaaaacggugcguggcacaggccuaaagucaagauagcagcagauggggcauccugacgaucuugaucuugcugguguacucauacuaaugcacuacgcagagggcauuuguucaacacauuuucccuguaggucccuuccagcuuccaggucuagaggcuauucuaugaaaggaugcuguuaucccagucaaaacugcuaucuugucuuuuauuuuuuuuuaaaccaccuccaucucucacgccuaauugaaauauaaacucauucauuccuucaucccuucauugcugucucaagguaaacauaaagaucaagguguacuucuggcuccugaggccacaaaucugggcauaaaugagagaacaaggacacggguuauuauuuguccacuuaaagguucuugcaguuuuguuaugagcuuccagguuucacuuguugccaaaaguaaggaaaggucuaaaaccuaucaaucagucugcugugauaaaucucgugcuaacccucugugucacuaucuuuaggcagaaacacucugguucaaugugaagaauuucuuaauuucccuuugucacuuuuuuuuuuuaaccaaaugggugcccagugaaauuagaggcgacaaggugacuggagaagagaggaagcuggacauagaaucaucaaaacuuagauuggaagaaucacuguagaccagcaggacacgcuccacacucaaaacaauguuccugucuauuucuagagauaauguuuagcccaugcuccacccuucaggaccagcaguucagugcauggcaacguaucuauucuguuuuucuucauguuguuuugacagcccuuuaaaaaagcuuuucuuccuauugagccccaaaucugucucucuucaaugucuacccgaauguuguaaucugugcucugagaacacgaaguaaguccuacucuuguugcagccgugcagcggcuggcagguagugggcuucucugugcuuaauggucccauggcuuucgugaauggguacaagggugacaaugcagacaugguuacccuacuguucugcucugaaccccagcuuguccugauguaucauguuagguucacugguaaacuaaacuuaaaaacugaguuuaagaaguaucucccuggcugggcgcaguggcucacaccuguaaucccagcacuuugggaggccgaggcgggcggaucaugaagucaggagaucgagacuauccuggcuaacacggugaaaucccgucucuacuaaaaauacaaaaaaaaaaaaaaaaaaaaaaaaaaguaucuuccuaaccucuuccuucucauucuccuugcuaugcaaaucagucaccuuugagcaaugacuacaaagcauccucuauucuuuuguauggcuugccuuuuuaaaguguuuuaucaucuguuuuuuugcccuccagcauauuuccacuauuauuucuaugccauauuccuuccugaauaaucugccuauuucugauccaauuacuauuugaaaaacacaaaacccacuaaccauaacauuucuuacugauuuuucuaaaauuacaaauuacacaaauuuaauacuuuauuuccuggccuuguucgauagucccuuuguuuaccguggcucgccuaugguagauacucacuaaauugauuauuucuuuguuuuuacuagacaaaacccugacuuacuuuugccacaaaacaaguguagugcugugaccuuuaagacucaagcacuuccuaauuuaucaccuaguugcuaugaaguccacuguuuggauccaaaggcacauuguuuguuuuaaagaaagaacuuugaagaaugguuugguguuuuaaaccagucugcaaaguuuauuuaacacauaauguagcucuacccauuauacuucaaaaauccauaagcccagauuaccguugcaacauagcauccggaagaaacaaauucugaauuccugcuuggaacacucuucucucugccgcaucgccacaccagugaagccagaaucucuggggguggccuugguagcaguauuuccaaaacuucuaauguggacucaggcugagaaccacagcucugaccaguugagcucuguguauguguguauaaacaguuaauuuagcauaacggauggugguaugcaucacaggaagaaagaauauuaaacucauuguugaauacuuugaaaaaagaaauauucuauuacuguagagauugcaacacacaauuucaacuuaaaagggaugggaaacaccacaaacaauccauaaauuaaaacuuaaauggcagcauuauuaguuccuuuggcagcuaaaacagacuagggucgucaugccuguggacuugguuaauuuuccuuucuccuuucuaugagguuggacaacccuaaacucuuuucuuuaucuucccuaggauguacuacauaguuacuguggaaagcuguauguuggaggccaugaguuccugaccaaagaaugaaaaauguuaacuuucuuuaauaccuagauaauauuauguaaugaaucaaacauuuuuauuuuagaaugucuuauaucuuaugcuucucaagcuaguuuugucaggagaauucuaaagauauuauggaguagcauauaaucuaaaaaaagaauguccagaaaauaaaaauggaccaaauagagauuuuugaaaagaaguaauggauaaaugucuuguuuugcuuuaagauuauacaguucccaaauaaccuuugcaguuaaucugcaagccgauuuacagaguacuuucgacugauaaaugcuuccuuauuuucuuuaggauucaguucacugaaauuucauaagagacuauucuuaauuuaaauauaaaagugaauacaucaaaaaagguugccuccucuaaauuauucaaaguaacaucuuaguuaacaauaguuuagucuuuacaaaaagcuauagaucuuuuccaauaugaaaacuacuaacugaucuauaaauuugacccgaagacauacaaugcccucaaacauauucugagccuuucuacuuuugaggucuaagucacuggaauuagcauugaaaauuauuucuuuggcuuauuaugguuauuaaagagaaauagaggaucccccccacccugggguuguucaauaggagugaaaaccaguuuagccaacuaaacaggagauuugcagaaauuccuuacuugagauucaguacaccuaccaagcaacgcaggugugccuuucaauagcucaaggauuuucuaagcaucagauuugguuucaguauacauuagcuccuuccuagauuccagugagguggcgugcugcuaaucaggugggaagaaacugaauuccugaugauacgguauuaacuaaaaaaaacaacugcccaggagccaaguauuguuacaucacauuaaagaagacauuaaugccgguaccaagauauuaaaagagcauaucuguguucuuuuuccuuccauuuucccuaacauuucauuuaucuuaaugcuuaugcaaauccaaugauauuuguaaucuacuuagcaugaaagcuacagagugauaggaauaguuacagaaugaacaguuauucucaccauugcaucaccauucauauauaaauauauaucuauaauuuuuuuugcaaauuauaacuauaaaaacaguugccuuauucugucauuuggcaaccugugaaguuguacuccaucagaauauuucuaugggccuauuacaagucagugccauauaccuuguggauuuguuuuucaugcauucauuugaaacacacucauucccaauucuaaauuaucuuaguagacuccucuugagccccugaaggggagggguaagguuugggccccagcaggaauacccuucgagccuggaauuacucucacucugugaugcuagaacauuccagggcuuguagacagguuggguacauuuuguuuguccauaagcacuugaugaauaucaauauaaccucccacccaggucggggcaguauguuaauuuauauguuuugggcaagugauuuuaugucucugaguuacagcucccucauuuguaaaacagaggaguuauucuggauaucuuccgagaccacuuucaacuccaaaaaccccugagucuaggauuccuaaugaacuuagucauucacagauaacaucaaggagaggagaguagcaguuuuccuuuggugucuuuacuguuuuauucccacuuucugccucccuccuuuguuaaauuuaaagguggcgucuguauagauguguaugugagaggcagugcauggagaaaaucuaaaaucucuacauguagacuuauugucacuuauuccuucuguuuaggagaaaugugauaaggcaugguacuuucauucacuuaagagucagggagauauagcggacagaggguagaugauguaaucagaaagaugugagauaaaauucuaccucugaaugaccuuggacaggucaccuaaucucacucagcaucacuucuucaaguauaacgugggacuaaaugacagcuucuuucaaaggcguugugaagaauagagacaauguauaugaaggacaggaauguaguggaugcuuaguaaauaaugaauauuauucaguucauucaugccucucauuuccuugugucucuuuaaagagauacaauuacauuuuuucauaaaaaugguauuaaucgguuaggcuaacagcaguaagugaauaaggcugaaguguauugcaaaucucaaaguaggaaagcagaaaguguggagucgaaugccaacauggaaggggcuggugcccagagugagggcagagggagggaaaccaggaagucagagcagaggauagucccggggagcaaaagugguugggagugaggcgcuugcaaaggaaagugagaaauaaaacuggaggacaguuaaauuuaaaagggugaacagcugggugccuguaaucucucccagccccuccagaggcugaggcagcaagaucacuugagccuaggaguuccagaccagccugaguaacauagggagaguccccaucucuuaaaaaaaaaaaaaaaaaaaguuagccagccgccuguagucccagcucuuugggagcaugagcuaggaguucaagaccagccugccugucucuaaaaaaguaaaaauaaaugaaagaagugaccaaugauaaggcagagagaguaaggggaacagaaacugcaaagagaaaagcaaggggcaagaaauaaagauaaagaagagaagaagugggaaaucaaggggagacagcacugggacgagaagcugagcagaggacacugaggacagggugaaugauuuccauagcccucaguuuucucaaugacuagguguaaggagugggaagcaauacagucuagugucuguuaccaaaugcagauacuugcuccucucucuaguccucacaauacagcaggugcaaaguuuauuccaaacuacucagaagucccaaguuaccacguggcucacauuguggggaaaaucagaggaaguuuaaaaugaauuauuucaggguuaaaaaugcauguucuuacaaaaacauaccuauaagcuagugcuucauuuugagaguuuuuuuucuucaaaauguaggcauucucuuauuucuaucuaauaaacacugaucuugguaccuuuuaacaauuccaugcaauagauacuauuuaauaaaaacuccaugcaaugggguacuauuuucauucccauuguacagaagaggaaacugaaccacagagagauuaagucacuugcucuggaaggugguggaggugagguuucaaugugccagcucaguucuagagucuccacuccuugugagaaguugcuucccaccaagacaacucuuuguguacagaguacagucaauaucuacagcgugugaacaaacaugcacaaaaugcauuaagacaguucugaauaacuugauuuaacuuuauuuucaggaaaauugcuuuuauaaucagaauuauuugaacaggguaccuaguuuccuuacuucauuucuguauaugucuagaucuugcaguaagugaauugaaguucaauaauaugcuguuuaaugguauccugagcaaggcucacucacuguguuaguuugggucuggaauauuuuucuuugaguccacacacacaguaagaagacuucauuagagaauucuuaaaucugucuucugcgugcuuugagcucuggcccgugcucucagccaaacggagcuagcccagugacuugaaugggaacguucugccagugagcacccacccuucuucccugccauccugaguuggggacguucugcagugaguaucauuuacugugcuguggacgcuccuucucauguuuauuucauuuucuggugaaaauauuuaaaaaccaaugguuuuuaaauagccauaaaaaauauuguuauuuuaaaggacaucaaacuaagguauauauuuuuauuucuagaaugcugaaguuagaaaggaccuuaaaaaaguuaccuaauucaauuuuucaaaugaggaaacugggacccaaaagugacuacuuuuuuucuuuuauguuuugagauggaguuuugcucuuguugcccagccuggagugcaaaggcgcgaucucggcucaccgcaaccuccaccuuccggguucaagcgauucuccugccucccaaguagcugggauaccaggcaugugccaccaugccuggguaauuuuguauuuuuaguggagacaggguuucuccauguuggucaggcugguuucgaacucuuuaacucaggugaucugccugccuuggccucccaaagugcugggauuacaggugugagccaccgugccuggacucaaaagugacuucuuaaugcacauuaggucauaaaguauaugcugaaguaguauaucaauuggaauaacauuuugcauguuaucaauauuuuucaaaaauguauaaaucugaaaaauuaucugaguuugaugcugaagaaaaaucugaauuagaagcaagauuugaauaauauuuaaaaguugagccaggcacaguggcucacaccugcaacccuagcccuuugggaggcugaggcagguggaucaccugaggucaggaguuugagaccagcuuggccaacacggugaaaccuuguuuucacuaaaaauacaaaaaacuagcugggugugguggcacacaccuguaaucccagcuacucgggaggcugaggcaggagaauugcuugaaccggggagauggagguugcagugagcugagaucgcaccacugcacuccagcuugggcagaagagcaagaguccaucucaaaaaaaaaaaaaguugaaaacuacccuauuucaucuagguucuccucaaagauauauuuaugcuccccaguaaaauauuuacaaguguauuacuaggaggcuucgugauucagguucaugcagucaucucuauacaugacuucugaauaguaacauaaaaagaaaggaaaucacaguggaauuguaugcugauaauauggcagacugauaacagacacaccucucuuugugguucaaagcaauagcuguuucuaugauuuaggguuuguaaagaaugaauaaaaacaucuaaagaacaaaguugaugucauguuuugccuguauuaucauaacugccacaccucuaggauuucuggcauaaaucuuucugacaaacaaacaugcccuaugucagcugccucccaccguacaauucauccauauauguaauccuauagaguuaagccauguuuuauuuccaaucaaaacaccaugugaaagauuauauuguaauuuuuugacaugcuaaauaaagcagccaaugaaauuugguuaagcaaccugaaugauacucuguuuauucuugacuuucuagaguucauauacuguagaggagaaaagcaaauaauacaauuuuauuauuucauauuaauuuccagaugugauugagaggauccaacaaauuaaauaauagauauuauagaacuggguauacuauaggcauuugcuaaauguuguugaauuuaauuuuauuagucaaaaaaggauauaugauuaagauugguagaauguuaagcaugaacucucaaaaacagacuguaaaugucuaauuuguauuugcucuuuugaguauaaucuucuuacaugaagaaggaaugucauauccuuucaaauuaaaaucuuaugaauauaaggcuuugucaguuuauauuuuaaacaauuaaauuaauccucaaauaauugcuuuuuugucuuuuacaaucgauugcauauauguauauaaauguuuaucacuauacaauuuuucuacagauaguuuggaaucacacaauauuaauaugaaaggaauagaaaaauauaugaacuaauagaaaauaugagcuaauagaaaaacaugcugcauuuuccuaaauaugaauuuuagaaaugaaauuuaugaauuuuccuaauucauaaacaaacuaauagaaaaaauaaacuaauagaaaaacauacugcauuuuccuaaauucauaaacuuuaugaauuugggaaauuuuaugaauuuuggaaaaugcaguauuuuuuucuuuuaguuuguuuugcuaccuggaauagguauaugguaacuucacucacagauuagacucaccaguuucuuuuacucuuuuuccuaacagccaauuacuucugacuuucaagacucuuguauuucacuggcuuagggaaaaucaagcuaagcccuaagugguauguaccuccacacuuccaccuauuuuaaauggcaccauucuuuguuacuuagcaccugaaaagcucuggcugacucucagucucagggcagaagacuucucaaaaggguggauuuuauuuauuuauuuuuugagacagagucucgcucugucgcccaggcugaagugcaagggugcgauuucgacucaccguaaccucugccucccagguucaagcaauucucaugccucaaccucccgaguagcugggguuacaggcaugugacacuaugcuuggcuaauuuuuauauuuuuaguagagacaggguuucaacacauuggccaggcuggucucaaacuccugaccucaggugauccaccugccuuggccucccaaagugcugggauuacaggcaugagccaucaugcccagccuaaaggguggauuuuacaucuccauauauacugguguuugcuuuaccucucacuggacaaaugugagugugaguuuuuaccauuauuuguuugcuauggucauaacuaugucuuuauuauuguuauuauuauuccuauuauuuuagacagagucuagcucuguugcccaggcuggaaugcaguggcaccaucuuggcucacugcaauuucugccuccuggguucaagagauucuccugccucagccccccgaguagcugcaacuacaggcgugcgccaccaugcccagcuaauuuuuguauuuuuaguacagaugggguuucaucauguuggccaggcuggucuugaacuccugaccucaagugauucacccgcuuuggcaucuauguucauaacuaugauuaugaccuuuaacucucauuuuaaaauuauuuagugaauguagcauacauauuuccagugcaguauuuuauuucuggccaaacugggccaaagaugaaccguacuuguggauauacuucaaaaucauguugaauuucgaaguacauacauucauacucuacaucaaauaauuccauguacaugaaauaaugguguuuaaaugcugucacauccuccaccugcccuaacuccugugguugcugauaagguuuggaucugucugcaccacaucucauguagaauuguaauucccgguauuggagguggggccugaugggaggugacuggaucauggggguagauuucucacgaaugguucagcaccauccccuuggggcuguucccgugauagugaaugaguucucgugagaucuggucauuuaaaaauguguagcacuucccaccucgcucucuugcucuugcucuggccaugugaccaugugacaugcaagcuuccacuucaucuuccgcaaugauugugaguuuccugaggccuccccagaagccaaguagaugccagcaucauguuccuguacagccugcaaaaccuagcaauuaaaccuuuucucuuuauaaauuacccagucucagauauuuauagcuaugugagaauggacuaacauaguugugagguaacaaacauagaauacauuuuuacauaugaaaaauauaaggucaguucagccuugggaguguuauuguuuguucuuaaucauuaaacuugggugcaauguauggaaauagcacuggacuggcauuuaaaugaccugccaucuauucuagcugucacuaccuugcuguucauuuacauuugauugggcccauuuuucccgucuaaaaagugaguguggaaaaaaagugagugugucaaaacaagucucaaaagcucugccuagaucuagugauagaggaaguaauaaaaaaugcaaugggagaauauugucuccuccuccccuucagacagugcaaacaaaggaaaaacaagaaggaacaggggaaacagaaaaaaacuagaaagagagggaggcucagacgcagagugugauggggucauuguacacauaugcagcuagcaagagagggaaccagggagaaaucucuuucucacuacuccagagauuugcccuuuaguuuucaaaguuggcuuaaguuuugcccauacuugccccagcugccccaguuucuccuaauuaugcucacuugcguauaguugccucuuaauuagaagcaaagaacaguaacuugcagccuggucauucugaauuccucccugccuccaacaaguguuagaaaggaaaggcagacgaguuccguuuauuuucugcacaaggccugauuuccuuuacaacuauucucaagcaucggugccuauguuugcuuucaugguuggaauuaagcauuuguagaaggucccucggcagguuaaugacagagccagauuuagcaugcacagcugcugcauucucagugugggcccugggccacugggccacguggccauuccacccaguguuccaagucacauacuugucaacugcaagccacuuccuaagccaguaguugugaacaagcuuuauuaaacaugacacguccacaagagcagaacacccaaaccucaaaacuugaaaaauacuacuuaucucuucuaguucaagcaaaaagugucacauaguaguaaacugguaucgucagugucaguggaaaaaagcaaugucucuccccaacccccaaaaaaacuucacucccuauaucaauuacucaagcuauuaaguuagacuaacaggcuugaucauauuuuacaggugacaaaaguagccaacguuaagaauuaacaucacuucucauuucccaguccgagccacuaacuagcaugcaauuuuguuuaguuauuugucugauauuuucaaagaaugcauauaugccaaguauuuguuaccuaaugcauauuaacaacuaaaaaguggucuuuuguaauuaauguaagcaguucuuaaaaguaagcuuuuuuuuugagacagagucugucucugcucugcugcccaggcuggugugcaguggugcuaucuuggcucacugcaaccuccaccucccaggcucaagcgauucucuugccucagcccccaccaagcagcugagauuacaggcgcaugccaccaugccaggcuaauauuuauuuauuuauuuauuuauuuauuuauuuauuuauuuuugagacagagucucccucuguugcccaggcuggagugcaguggcgugaucuuagcucacuguaaccuccaucucccggguccaagcgauucuucugccucagccucccaaguagcugggacuacaggcaugcaccaccaugcccggcuaauuuuuguauuuuuaguagagacgggauuucaucauauuggccaggcuggucuugaacuccugaccucaggugauccacccaccucggccucccaaagugcuggaauuacaggcgugagccaccgcgccuggccacgucaggcuaauuuuuauauuuuuggcagagaaggggcuucaccauguugcccaggcuggucuugaacuccugacuuuaggugaucugcccaccucgaccucccaaagugcugauauuacaggcgugagccaccuugcccagccaaaaguaaacauguguuaaagggucaagauuaucuuuugaaagcugaauaaaauacuguacucuaugggauguugcaaauuucuauagaaacagaauuauaacuaugggagcugaaaauaaugagugccuucuucauuccacaguuuuucuaaaaaaaaggaauauguaaguguucucaggacaauauucuggaaagguagaaaauacaguuucaauaagaaauaaagccaucuuguaauuaacuuuuuauuacuaacuuaccuuuguauauuauucaagcccuuaaauaaugcaacaacuuucuuccagcugcucuuuucuaauugacuccuuuaaaauuuuuauuauaaagucagauucaucuucuaagcaaauuaauucagaacgugaauguuacuccaaugaauauagcaaaccucuuagucauguaccaacuaaaaaaugaucauuugagagaaggcauauugaaacaauacuguauucccacaugucucaauauaaauacugaaggugaaaacagauucacaauccaauuguaaugccagcauccucacuuuuucuucuguguuguuuuaagaguccagugacuuugguuccuuuguacccucuacuuuuacauugcuauccucaaacauuugaucugguuucuauucuuggagagcaauaaaauguuuuagaaauguaacaaaguucagcugggcacgguggcucacgccuguaaucccagcacuuugggaggccaagguggguggaucaccugaggucgggaguucaagggcagccuggccaacauggugaaaccccaucucuacaaaaauacaaaaauuagccagguaugauggcgggugccuguaaacccagcuacucgggaggcugaggccagagaaucacuugaacccaggaggcggugguugcagugagccgagauugugccacugcacuccagccugagcgacagagcgagacuccaucucaaaaaaagagagaaauguuacaaaguucagcauuaucaaacaacuugaguacuuaaaaaucgccuucucuguggagucuacaggaauggaaucuaaggcauuaggguuguugccauaagcggguacagcaggacaacgguguuggcuauagcaauaggcagaggaagaggaggagucauggccucagaaauucagaaaagaaaaugugauccaggcucuacccuauagaagaagagaucagaucuuauggucaggaaaggaggaagcuggccaagaugcagcgugaggauuucagagcgaacacacacauugaccuugcagcugcauggggugcgugaugaaggcagguuuggccacugacaagaggaaaucaauaugaugaaucaauugauaucacucuaucaucacauauggagaggagguaugaaugcuuguugguaauucauagaaacaguuuguuggcugggugugguggcucaugccuguaaucucagcacuuugggaguccaagguggguggaucaugaggucagggguucaagaccagccuggccaauauagugaaacccugucucuacaaaaaauacaaaaaaacuagccaggcgugguggugggcgccuguaaggugccagcuacucuggaggcugaggcaggagaaucgccucaacccaggaagcagagguugcagugagccaagauugugccauugcaugucucaaaaaaaaaaaaaaaaaaaaaaaaaaaagaaauaaacaguuugucaaugggucacagauuuguaaucaaaugaaagcuggaaauaaugcuuggcucuuguugucauguugguucucuaccaaaaauuucugcagaucuucuuggcaacguuguuuuagacuggugcauaaaaagggcuaugaauuuagcucugcauuugcccucauuuagugcuguuuguauguugccacugaaggauguaguuuuggguucuaguugauagccaccagugcuuaucaauuggcagauaaaguuucagggauucucuacuuauaauugguuucacuuuuaggggcuggaagccaauccaaauuaccccggugaguguuuguuacucgugggugaguguucauggcuaccgcaccccagcaaauuaccaggcagguaguuaugauggaaaaccuggaauuuggaauucaagccaguuacagaagcaagaauaagcacaggacuucaaauuuggaaaugccauucuguggagugaagugguacccuaauuuauauauuucaaguaaagaauuugguuaaaugaauuucuguuaaguaagggaaacuugugguauauuacuaccauugaaaaaaugguuucgucuuugcacuuccuuccauuugcauaguucauauuuaugacacccaauucuacuucagcaccuuuuuggcauaucauccccaucagaaaacguacacaaauuauggugggacucaagcuacaguaauagcugagaccagaauucacuugauccccucuguucgcaauucauacugccuccuguacgcaagaagagccgugcauacuggguauucauugaauuaugaauguuuccagcucuggcaacaaaacaaauaaccaacaacccccccaaaacugauuagcuauuaaccaaccccacacaaagucugaacuauauuaacuucauuaggcauucuuuaaucugugguagaauggaaauacauccuaaaauuagaagauuguaaacagagagguuuucuuuucccccacuuaauguuuaauuuuaaaauauucuaucuuaauuugauauggcuacccagaauagaaaaaauguuagcuucaacuuacuucuuuacuucagcaagccuuagcucugcucugaaacucuucuaaagaagcaaaaggcucuuaauuagcacacacacaacaggacaggauucacaugcacaugcugcaggaauaguguuucugcauuaacuuacagcagcugugaaauuuaaauaccacuagcagcaaagacauuuuguaaaauaccgcacuauauuucaugagaaauuugcgcccucuuuuggauaaagauuguuaagacauuucaauaugaacuuuuuuuuaaaaaggcaugcaguuuuuaaaaaauaaacaguuuuauuguaaggaccgugggaaaggacgagaaagaacaggugugaggacauugcaaagccaguauuaacagaacuagaaggugaagauuuuguaacugcaacgcauagauggcacuaugaagcgccuugaauuaggaaucuaucguuuucuuuuaaucaagauguguugagaaauugugacaaucauuacaaaguaaugauuuuuaggaccaauuuucucuagaaaacaguagccaaagcucaucuuccucuugaggcuguaaguuuuguaugguuaaggauaaauugucccuuggaugauuuuucuuuuuucuuuuuuugagacagagucuugcucugucgccugggcuggagugcaguggcgugaucucggcuuacugcaaccuccaccuccuggguucaagcgauucucuugccucagccuccagaggagcugggauugcagguguaugucaccaugcuagcuaauuuuuguauuuuuaguagagauggaguuucaccaugugacuagguuggucuugaacuccugaccucaggugaucuuucugcuuagaugaagcagauauuaaggacuuuuuuuuuuuucaaauuuaggaaaauacacaaauguauuuaaagauaucuugagagacauuuaaaacauauucuucauuuuucuucuuuaacugaccaucucaauagacuugucuauuacaguaucacagucucucuguccaccacccaucuacuucuccauccacugccaucuuuccuaccuuucccuuuccacugaaacaccauaggcaaaagugacaagugguuuugugcuaccugacuuagugaacaguccccauucuuuaucuuguuuguuuucucugcaccuuuuucauaguugcucaguuccuucuuugugaaauacuuuauucuuucggcuuccauagccccauucuugccuagauuucucugccuguuccacgauucgucuccaugucuccucaugggcugguaucuccagcauucuguacuuggcacuuaccccuuuucacaucacagucuuucccugaaccaacugguggcuccauaaugggauucccugacccagaaucaguucuucugaugucccaugugccuaugggacaucuucuccuuucuccugguggcucgcagguauggagaccucaauuaugucuacaacuaaaccucucacccccaccucccccgcagcucccuucuguauuuucuccacugaaccaugaaccauauuuguuugucuacccacucagucugccaagcaaguuaugaguguuccugagucaucuuggauggcgcucuucccucuguacuccucaucacucaaucuuguugacacucuuucugaacugccaugagucauucucaccucuccaggcccacacuacucuucccaguuuagacccucaucaccucuuccauccacuagccugacuggucuuccugccccagggcucaccccuucuaauaugacuccccagcugauuuuccuaaaagauaagccugauuguuucuuuaccccuuuaaaacccuucacgggcuccucauuacuugcagaaugaaaucuguguaucuuaucaugacacaaaagguauccuaggaucuucagcccaucaccugccaugcugcaccuuggaauacucugcuggaucauagcaagcaugcauggcaguguucuuccacccaggaugccuuuuuugcuuaauuagccuggagaauuccuuuuaauuacuuuuuaaaaaaacucuuuccucccccaauagaccaggccugagagucacucucucauucuugguggcgugcuuccauuguugcauuuacugcgcagaauuggaguuuguauccaugucccugcugagcugugagcgcuuugagaauaaacacagauucuuauucauccucacuguuguuguuauauuauaaccaugauuggcuaccguuuauugaaugccaggagaaaaaaaacccugaaguuuggagauauuaggaaaauugcucaaagauguauugccauuuagaggcagaguuauaauuuaauccccuuuuuuuaaaugauccaaaacacauguucuuaucaaaaugaugcacuacaacuuagagguuuccugguaauacuccuacuaguaguaguuauuauaacuaucacugugaaucaugcauuauacuaaauucuuuauauaacaaucaguuucugaagauggagaauugauuuuuuuuugaauuuuuaacgguuugauauaaaaaguuauuuuuaaaaauguaaaauaacaaaagauauuuacuaaagauauucauacauuugacaggaguauaguuaagcuuagguggaccagaugacccacaauaucccuuaccacauaagauuuuauaauucuacaaauauuuuuccucuuuugauuuuaacaaaucuuuucuuaaauuuauuuuauuaacauaucguccuggcaguagcuucauaugguuauaaccauguuuucuucuucuuuuucuuuccuauuugaaggaaaaaaaagacacccaaugcuuucuguguguuuucauauguaaccuucuacauagcagaugcugcuaaauugcuggggauauaaugagaauuaaaaaggaaauacaauucuuuuucucauggagcugaaaaucuaguaggggagacacacauuacccaaacgaucccucagugaccauguaauuauaaacugaaucaaaugcucucuaauaaaggacuacuguacucugaaacuguauaacaaagaacgugaucucugcucugggucagggagcaugucccugaggaaaugggcgggggcugaggcuuggugagugaggcggaauacucaagccuggugccggggaggagagccuggcagacagagcucuggguagagucuggguagagggaccuguggugggagaaagagagaagaucagaguggaggggagaagcaggguuggggccuugaagguacugcugagcauguggguccuuauccuuacccugcauugcccgcaggccugaccuuugcuucauucuucauggcugccaagugagaguguggccccugcagguaagaucuaacuaagucuuggaugucucuguaucucaccggguaggcagauaguaaaagcucaauaaauacuuccuaauuuauuugaccuacagguuuuccccuccaccuucuuauaccuguacaauuacuagaagagacucaagauaccagcgugauuuauuuuuuaauggauugaacaaauuaguuauuuauuaucaaauagucccauuggaaaacaauucugugaaauguauuaggggaguguuauaucuaaagauuauugaaaacugguucuuucuucuaaaaaucuacuuuuguuuuccccaacauuuucucauaaaacuuuauaaaauauauagcaauguugaauuuuacaguaaacaccccauauaucauacccaacaccuacauucuaccauaaacauuuuauuugcuuugcucucucgcucugucucucuucuucccccucucccucccucuaucaaucuuuuuuuuuuuuuuggaauauuuaaaaauaaauugcaggccucaguacaauuucuccuaaauccuucagcaagcauaucacuagcuagauauuaauauuuaguuuuucuuuugauguaaaaauuacauacaaugaaauuuauaaaucuuaaguguacauucacuaacuuuugacaaaugcauacaucuguguaaaugaaacaaacacuaucuuucuagaaaguucucucauacuccuucccagucgaucccacuccccccguuuuucuuguguuuuccacaguagacuaguuuuaucuauucuagaacuuuaucuagauacaaucaaacagcauguacucuuuuguauaaggcuucuuucaguauguuuuaagacucaucuauguuguugcacauauaagcaguucaugucuucuuuuuuuuuuuuuuuuuuuuuugcugaauugaguuccaguaucugaagcuaucacaguuuguuuauccauuuuucugcagauuaacaugugagcuauucccaguuuugggcaaauaaagcugcuaugaacauucuuguacaaguuuuuuugugaacauguuaucauggguaaauaucuaggaucagaauuacugggugggaggguaaguguauguuuaguuuuauaagaaauuaccucaccauuuuucaaaguguacuauuuuauauucccacuaaccaugugugaaacuugcagguacucuacauucuugccaacguuagauguuaucagucucuuguuuuagccauucuuguagguauucaaugauaucuuauugugauuuuaauuuuuauuucccugauaacuucaugaugcugagcacuuuuucaugugcuuauugcccauucaaauaccuucuuuugugaagugccuguccaaauuuuuugcuccuuuucuauugaguuguuucuuuguuuuuguaagagcuguuucuauaccaggcuguuaucagauacauucuuagugaauauguucucucaguguauggcuugccuauuuucucaaaggcaucuuuugaugagcagaaguuuuaaauguugaugaugucuaauguauauaaauuuuuuucucuuaugguuauugcuuuuuuaugaccuaucuuaugaaaccuuugccuacccccaagucaugaugauauucuccuauauuuucauuuuaaacccuuugcuuuuagcuguuuuuuauguggccuaugauccaucucuaauuauuguuuguuugguaugaaucagagguuagauucauuuuuccauauggcucucuggcuacuuuagcaccauuuguuuaaauuccuguuggacuguuuuggugccuuuguggaaaaucaaacacauguguaagcgcagaucuauuccuuuaucuuuuuaaaaauguaaauacuagccgggagcgguggcuuaugccuguaaucccagcacuuugggaggcugagauggguggagaucaggaguucgagagcagccuggccaacauagugaaaccccgucuccacuaaaaauaucaaaaaaaaaaaaaaaaauuagccaggcgugguggugggcgccuguagucucaguuacuugagaggggagguagaagaaucgcuugaacccaggagguggagguugcaaugagccaagauugcaccacugcacuucagucugggugacagagugagacccugucucaaaaaaaaagguaauacugagcaaucaacauccaaaaguuuccuucuuuuaauuuaaauuuuacauccuguaaucuggauaagaguuuaauaaugaggauauaaugacuuuugaccgccuacuagaaaaauugaugcccuauggcuucuuuaaaauaugaaucaauuuguuucucuuucagggauauaacuuucauauugcuaaucaaaugcauuggaaucuuuacuugaaaauuaaguuggccuugaaaaugcaaaauaaaaaauuauguuacugccauuauaugcuaauuuaaagucuaccauauuuuguuauuuaagaaagaugaucauccaggugugguggcucacgccugguaaucccagcacuaugggaggcugaggcgggcagaucaugaggucaugagaucgagaccauccuggcuaacauggugaaaccccgucuuuacuaaaaauacaaaaaauaagccgggugugguggcacacgccuguagucccagcuacucgggagacugaggcaggagaaucgcuugaacccgggaggcugagugagccaagauugugccgcugcacucagccugggugacagagugagacuccaucucaaaaaaaaaaaaaaaggaaagaugaucaguuucuucucauuggagucuaauaugguugaagggcuagagguguuucuaggaaggaucuuaguauaugaacuuagguaagugaguuucauguuuuauuuuuuauuuguaaagaaagaaaauaauucuuugacuguuccuauuauaauaagguauuguaaagaucagugaauuucagggccauacuuuaggaaaacauauggauaaaacaauaaaaaauauaagcacaagguaguugauaaacacaagauguuuuccuugagugucuauguagcagguauuuuucuuuguguaaaagcuuguaaccauagcauuaacauucuccuuuaugaaauuugggauuugaucucuuugcccuaaugaagauagacacacaggguccuuucgaugaguauacucaggcagggaagggcgaagagugguucuaaguccuucuuggcagccuuuccugggcuugccaccccagauggauuugccugcucuugaguccaguaauucaauagccuguuuccuuccgguagggguugcccaaccgcuuacaaccugccaugagucuucgucucaugccacucacaaauguugugguuuaaacacaaagaauuuuaacaucucucacaucccaaaguaaacagcaguucuggaaaugucacagggcuuucagugcaugggaaauggauucugugagauggauuuaaauaacucaugguccacuguggaaacuuuuugaagcugcucccccuccccauuuccccccugucaaagugauuaggugaaucaagaggaaacaaauaaaggugcuugaaaaagugaaccuaaucacacacuuucugguugguguuugugggcacuaaaaagcauuauaugcaugugguuugagguuuuaauaugugaaauuuauucaccuuuaauaucuuuuuugauuuaaauauaaucaacucaauguuuuaaauagugaaagugaccuucuauaauaauuauaucacauuugacucuaggauaauuuacaauguuuuccucaccagaauuauuaaaaagcaguaccaacuguucacaucuaauaagcuaguuucaagggagagcuauguccugauaacccaagaaauaacaaucuuaaacccuaaauuauuugggaaaaaaaagcgaaacuggaauauuaacuguaaccuacuuauuuguauaaaaauccuggauaugaccagagauuuuugcacacuucauguagacaaguagggaaagaaaagagauuaucaguguccuacaaaagacuuuuggggaauggaaaaggaccacuucuguaugaauacuaccucaugaagccaaaaauaauaagaguuacaggaaagccaggugacuaaauuauuccagccuagaggcacgcucaccuagaagcuaagaauucuacugcaaaggacugaaguucccaaugcccuuggcagcaccaaaaaaauaacauauuaauaaggcgaaugguucuuaacaauuccuuucaagcccuguuuucuauguaacaggguacauuauuuugaaaaaaaauguguuuauucacuuuaauuaguuagaaaucuuacuccuaacuagaaguaucccagaagaucugaugaaacaccugccaaucaaaggaaaagaaagcaccacuaacuuacugauugaagaaauaaauggaucaacagagcaaaaagagaucucaauaguaucuguugaauuuucuucugauuauuuugaggauuccuuuuaaauuuagaaauuauagguaaauuuauagguaacagcaugccuccauaugauauuaagacaaaaauuaaaaaaaaaauacuagacaugggcagcaauaucuuacugaccccaccaguucuacauuaaaaacaacaacaacaacaacaagaaaaacauuguucccagcuuuguuucagaaagaaacaaaacacccuugauuggccaucacucaguuaugugucuuggcaccuuuucuaacucucuguagacaaccaauucauacuauguucaagcucuaaauauuagugacuguggugucuuaaugaccuacuuaacuucucucuuuaacuugguguugccaacuuauugaauaaacuuuuuuucuugccaacuacccauuuaauaaaauggcucauuaaugcagucagaucuccuucaguggcuuugccguggugucuguacuuuuuucugcugccaugagcuccacacaugacauucucccuuuccuuagcuuuacucaauauggcuaucagucuuucaggagaaggaaucaucuuguuuauuucuguuugaucuuacuuguugcugauaccuuauuugaauuuaucuuuuggcagaugguuggaucauccauccaguucuuugcuuccucuagcugauauccuucuuugcuguacuauaugggaaaagcaagaaauauuugacaccaaaauguaugauucacuuaugcauuaguccguuuucacacugcugauaaagacauacucgagacuggguaauuuauaaagaaaaagagguuuaauggauucucaguuccacauggcuggggaggccucucauucaugguggaaggcaaaaggcacaucauacauggaggcaggcaagagagaaugagaaccaagugaaaggggaaaccccuuauaaaaccaucaaaucucaugagacuuauucacuaccacaagaacaguauaggggaagccaccccuaugauucaauuaucucccacugugucccucccacaacacgugggcauuaugggagccaaaauucaagaugagaauugggugaggacacagccaaaccauaucaacuuguauaugguggcauuauagagacagauacagccagucacacagggaaaggaaaaagauuugaacaaagccuagaaacaacuacuugauguagccagaaaacaugcugucagaucacagcacagauccuagaaucaggaaaucuccagguugccacaaauccuaguggucaaugguucagcauacauccaauucaaugauagcagucgaauagcaaaaaacuuuucccuacaaaugucacacuccuguuagaaugaauggcuauagcugacacacucugccuuuggaugcauagaauauuucaccauaagaugauauacacucgccacagaguuuuuuaauuuuguuuauuuauuuauuuuuguuguuguuguuuucgagacugagccuugcucuguugcuuaggcuggagugcaauggugcaaucucagcucacugcagccuccagcucccugauucaagugauucuccugccucagccuccugaguagcugggauuacaggcacccaccaucaugcccagcuaauuuuuguauuuuuuuuuuuuguagacuugagguuccaccauguuucccaggcuggucuugaacuccugaccucaggugauccacccgccucagucucccaaagugcugggauuacaggcgugagccacugugccuggccuguuuuuguuuuuucuauaucagaauuuuaaagagagaagaagguggacuucugguuaaggaugggagacacacacauuuguauuuguuuccucaugaaauuuuauuaaaaagacaguaaaugaauuucuuaaaaauuauuguugaaaaccaucaagaauaaagaggaagcaaacaagaacauaacauuccuuuuaugaaaguugaaaauagcauucaugaacaguaagcugccuaacagaacugagagguuugguccuaaauuggcaauaaggaaaaccaagaaacaacccaaauuauaucgcagaacugccacaauuagcaggccccuggaagcuuuggaagaagguggcaaaaaugggucuaaaacaggaggauuuguugaaaguccaauuagaaguuugacacucauauuucauacucagcucuguucaaugggggcaaauccucccuccucaccugaacagaaagcuggaaguauacucucugggguggaugaaauuuugguuguugaacuaggggacaccuguuccaaaugaagaagggaguuucauuauuaaaacagugugauuaacuaaaaauuuuacacuaaaugcuaagacagcucuccuuuccuucucgccauguuuauuuauuuauuuauuuauuuauuuauuuauuugagauggaauuucacucuuauugcccaggcuggagugcagugacgcaacauugguucacugcaaccuccaccucccgguucaagugauucuccugccucagccucccgaguagcugugauuccaggugcccaccaucaugccugucuaauuuuuguauuuuuaauagagacggaguuucaccauguuguccaggcuggucccuucuugccauuuuucuacauuugguucucaaaacacaaaacauuggcagccaggccuaaacuccguauacaagagacugacugugagauccaucucuagagaauggacaguuucauaaggaacaacuuaaagauacugacauugaaguuucccuaguaaaauggcucauuacaaauguccacugugagcuucucaguggacaaguccgucuacagucucagagcuucuaaugaauucuuaaauucccaugcugaagaacugacuggcagacaguugaagaaauuuccaacagggaagucaaaugaacaaacaaaguaacuuguaacaacuaacauggagaaaacguuagauggggagaaaaaaaaucuaacaauuauaauuaauauuuucacagaaauaaaagaaaauauugcauccaugagauaagcacagcuaaagaacauucggagaaugcacacaaacacucucucggaaauuaaaaaaaccauaguugagauaaaaacacaauggaagguuuagaagacaaaguuaacaauaucuuccagagagaagugcgaaaacauugagacuuagaaaguagaagagaaagacaaggaauauagaagaacgauccaggagauccaacauccaaauaagaggauuuauagacccagaaucagugaggagaaauccucacugcaugggaaaguacaggcgcacaaagcuagaugcaaguuguuuagucaauuuuaauaagguuauucugcagucaauaacagcccuagaaucucgguggcuuacaacagugaaaguugggcugggcaugguagcucaucccuguaaucccagcacucugggaggcugagguggguggaucacuugaggccaggaguucaaggccagcuuggccaauauggcaaaaccuggucucuacuaaaaauacaaaaaucagcugggcgcgguggugcacgccuguaaucccagcuacuuuggaggcuaaggcaugaaaacagcuugaaccaggagguggagguugcagugagccacgauuacgccacuguacuccagccugggcgauagagcaagacucugucucacaaaaacaaaaagaaaaaacaaugaagauuuauuuguuacucacuuacaugucauuugggguuaguagacaacccacagaaugggaaaaagauauuugcaaauaugauaaggaucuaguguccagaauauaucaagaacucuuacaacucaauaauaaaaacccaaauaacccaauuuaguaauggacaaaggacuugaauagacauuucuccaaagaagauauguaaauagccaauaaacauaugaaaagauguucaacaucauuagucauuaggaaaaugcaaaucaaaauaauaaugaguuaccauuucaaacauacuaagauagcuuuaauuuaaaagaguacaaauaggccaggagugguggcucaugccuguaaucccagcacuuugggaggccgaggcgggcaaucaccugaggucgggaguucgagaccagccugaccaacauggagaaaccccgucucuacuaaaaauacaaaauuagcagggcguuguggcacaugccuguaaucccagcuacucaggaggccgaggcaggagaauugcuugaacccgggggguggagguuguguugagccgagaucucgccauugcacuccagccugggcaacaagagugaaacucugucucaaaaaaaaaaauaaaaauaaauaaauaaaauaaaaaauaaaagaguacaaaauaacaaauguuggugagagcuuggagaaauuagaacccucauacauugcuggugaaaauguaaaaugaugcagccgcuguggaaaagagucuggcagguucucaaaaaguuaaaccuagaauuacuauaugacucagcaauuauuaucuucuugguauauauccaagguaauugaaaauguauguucacacaaaaacuuguauaugaauguucuuagcaguauuauucacaauagcccaaagguggaaauaaccuaaauuucuauaaacugaagaauggauaaacaacaugugguauuuccauacaauggaauaucauuuaaccgaaaagggaaugaaauuacaugcuacaacaugaaugacuuuugaaagcauuauauuaguugaaagaacccggacgcaaagaccacauauuacacaauuccaugauguugguugcacaacauaguaauauacuaaaagccacugacuaauaacacuuuaaagugguaaauuuuaugugacguauaucucaaaauaauuaaauagaaaaacagaguuaauggcugcuuuucaaaacgugugaaaggccucauucauagacucaagaagcccaacaaauuccaaacuaaauaaagaaaaauucacaacuauagccaucauugugaugcuacagaauaccaaaaucagagauaaaaauguuaaaagccagucaaagcagagugagacucugucucaaaaaaaaaaaaaaagccagucaaaguaccuaagaccaaacguuggacauauagcuuacuuuucaaugguaauagugaaagccagaggacaaugaaauuauaucuuaaauauguuaaaugaaauuagaauucuauauucaguagaccaguuguucccaaccaagguaauuuugcuccccaggagauacuguuaguugacacaacugagaagggaagugauacggucaucucauguguagaggucaaggaaacugcuuaauguccuacaaugcacaagacagccccaacaacaguuaucuggccaaaaauauaaagcgugccaaagucaagaaaucaugccguaacauaucuuucaaaaauguaaauaagccgggcauugguggcuugcuccuguaaucucagcuacucaggaggcugaggcaggagaaucacuuaaggccaugagucugaaaacagucugggccauguagugagacccuaucucuaaaaaagaagaacgcauauaaaaugaaaaaauauuugcagacaaaugaacguugagauaauuggcuaucaguagaucuacaucaaaggaaauaaacggcaaauauuuaccugaucuuuucagguaaaagaaaauaaucccacaaguaaaauugaagaggcaggaaggacaaugaaaauagcaaaugugugaguaaacuuaaacggaugauaauaacauuaagcaacaguaacaauuccuuaugugguuuaaaauacauauagaauuaaaauuacaagaauugcauauaggucaagcugagaguaaaugaaauuaaaguguucugagauuuuauuuugguucagagugagagugauaauaccauauagcauuagaaucaauaagucaguuguacucuaggggaacaacuaagagacuaguaaaagaguauaaauuauaaauuaacaaaaaaagauagaauaauaagcaaauuaauacaaaagacggaaagaaaggaguggaaaaggaguauaaaauguaugggacaaaaagagggugaaaacauaguaaacuuaaauacaaauuauuaucauaaauauauuagauguaaaugaacuaaauguuccuaagggcaaagaacuaaagucaaagauuuucaggcugaauaaaaaauaaaaaacaaaacccaagagacaaaacaaaaacaugaagauaaagaaaaguugauagauaaaaaaugaaaaagauauauaaugugaaugcuaccuaaaauaagacugaugucuauuaauauuagacaaacuacuuagggcaaaaagcaucaucacacaguuaaagagagucacuuuuaaugauguaaaaaaacccaauucauuaguaauauauaaaaauucuaaauuaguauauacuuaauaaaauugccucaaaaaauaaagugaaauugacauaaguacuacaggagauagauaaaucuacaaccauaaugggggguuuuaguguacaaucuaaaaaaucaguaaagauauauaaggcuugagaaacacuaccagcaaucucuaccuucuggauggcuauacaucacccaagaaucacauuuugaaucaagcauccauggaacauuuacuuuguaagcuaggucacaaacaaaucucaauaaauuucaaugaguuggaaucagaguauguuuucugacugcaauaaaaucaagcuagacauuuauaagaaaaauguaauagaaauccuacauauuugaaaaguuauaaaaaucaguugucaaaaaagaaauuauaaaauuuagaauaaauuuuauacugaaugauaauagaaauacaagacauuaaaacuuguggaaugcaagugaagcaguauuuagaggaaaguuauaaccauaaaauguauuuuaaaaaagaagaaugagaauucaucacccaagcaugaucucaaauaaacagaaaaagaauagcaaauuaaaaccaaagaaauaguaaagcaagccuucaugaaacaggaaacagagaacaucaagaaagcuaaaaguuguuucuuugaagacauuagacaaacuucuggugagacugaguaaaaaaagaaaaagaaaagaagcagcacaaacaaaugguaucaugaaagaaaaaggaggcaucaguguagauccugcagucauuaaagaaagaaacaagauucaugaauuacuuaaggucaauaaauauaaaaauuuagaaaaaaaugaacaaaucucuucaccaaauuacaacauaccaaaaugaacacaagaagaaauagaaaaaugaaauaguccuauaacaauucauaacugagagaggcaauuuaaaucuuuuccauuaaaaacaaaaaacaaaaccucuagguccagauggguuuacugguaagaacuaccaaauauuuaaagaagaaauaacaucaaucuuauacaaauucuuccugagaauaugaagcugguauauuuugauacaaaauccuaauaaacacauuauaaaagaaaggaaaauuacaguguguaauugucauucaugaauauagaugcaaaauuauaaaugaaguguuagcaaacuuauuccaguaauauauaaaaaggauaacauaauuaucaggcugguuuuauuugacaucgcagaguuugguuuaauauuagaaaaucaaccaauguaauucaucacaguaacagauuaaaagagagaaauaauaugaccaucccaauagaugucaaaaaagcauugaauaaaauuugacucccacucaugauuuauaaaaaucuuaucaaaaaaggaauagagaggaacucuaugaaucugaugaaaguagauacacauccccaaagcaaaccuuauacuuauugauaaaacauugaaaguuuuucuuuugaaaucaggaacaaaacaaggaugcauacuauugucacuucuuuucaaauuguacuguggccuagccaguguuguaggcaagaaaaagaaacaaaugguauaagaacugggaaggaagaaaugaaauuauugucacucacaaauuuuauaugauuguauguauacaaaauccaagagaaucuacagaaaaauuauuaguauuaauaugagaguuuagcaaguuugcuaaauccaaagccaacauauaaaaauuaauugaauuucuauguauaugcauccaacaauuuugcuguuuuuuuuuuuugaggagucucgcucugucgcccaggcuggagugcauuggugugaucucggcucacugcagucuccgcgauucuccugccucagccuccuaacuagcugggacuacaggcgcaugccacuacgcccagcuaauuuuuguauuuuuaguaaagaugggguucacuauguuggcgaggauggucuuggucuccugaccucaugauccaccugccucugccuuucaaugugcugggauuacaggugugagccaccacgcccgcccucauccaaacaauuuaaaacaugaacuuguccaggcgcuguaacucaugccuguaauuccagcacuuuaggaggcugaggcggguggaucaccggaggucaggaguuugagaccagccugaccaacauggugaaaucccaucucuaauaaaaauacaaaaguagcagggcauggaagccggcaccuguaaucccagcuacuggggaggcugaggcaggaggauugcuugaacccaggaggcagagguugcagugagccaagacugugccauugcacuccagccugggcaacaagagugaaacuccaucucuaaauaaauaaauaaauaaaugggaacuuuuuuccaucuaaaaauagugaauaacuagaaauaaaauuuaaaauaaauauuugagaucucuaugcagaaugucuuaaaucauaucaaauguauauguauaugaaaaagaaaccuauuuuaauauggaaguuuugcuuaaaaucaaucuacguagaccaagagccuuuauuaauaaccuagaaagauuaaucugguauuaguucugauuagguuuaggguuaggguuaauaugguggggucuauuaucaugggugugaaugcacucacuagagcacaggcauacgcauguucaucugaacaaacacacacacaugcacgcguacgcacgugcacacacacacacuauauuccccaaacauuguaaagaaaaacagaaaguuuugauugcaugagcaacucuuucuuugcacuuuagauuuucauacgcuuuucauaucugauuuucaugggugauuuccauggaugauuuucaugucugaaucucauuuacuucuuauguuguuaagcuuuccucucccuuuccucuuuaccuagacccagagaugcucccaguauguuagagcacauuauuuaaauuuagauuuaaugauacugacuuccauuaaugcuuuuauuuguugucuuaaaacucauccuugagucuacagcaaagacuugcccuguggcagcuuggugcacuguuaagaguuaggaacuaauagcuugaacaaggacugaguuagaaauuugugucugccacuuacugacuacuuguauggcauugugaaaauuucuucaccucucuggccaauguuucuacaucuguaaaauagaaauaauaccucccauuccuaccuccagggcuauuaugaagaucuagguugaucaacugcuguauaacuucuagcuaacuguagcuaacacuuccauaccaauucuuuccaauuuucuguuaaaaugaacagaccucagauuuguauguuccugccuaaagcagcaagcauggaugcaauggcggcggcagcccuuuugugaccagacaugagagaaaggcccagagagucacagagaccuugcauccaucugcuuguuuaggucucugguccagcucagggucaccaaccuucacacuucuuguuuggugacagaaaaagcccagaucuuuaagccacuguuaccuguguuuucuauaucugcaaguaaauucaauucuuaacuaauacaccaagcucuaaugaacuuguaugaugugccugacacuacacuaaauaccugauguauguugugcucuuugauaccccagaacagcucuccuacaggacacugaggugcagagagauuaagcaauuuacucaaggucacauggcucuaccgauaccugucacauacucauggaggccucaacaauugauucaguuauuuaauuauugucagaaagaugacacaagaucacacucuaaaccaaaauacuuuugugaccaacaucagccaauauucuauagcgcugaucacaucauugaguuaccuaggguccauguugcaaccacucugucuuagagcagucaucaggaaguugaacuuucuaaaauuagacuucuuuuauauuuauuuauuuuuuuuuuuuugagacagucucauucugucacucaggcuggagugcaguggugcaaucuuggcucacugcaaccuccguuucccagguucaagcaauuuuugugucucaaccuccugaauagcuggaauuacaggcaugcgccaccaccaugcccagcuaauuuuuguauuuuuaguagagaugggguuucaccauguuggccaggcucgucuugaacuccugaccucaagcaauccaccuuccuccaccucccaaagugcugggauuacaggcgugaaccaccacaccuggccuaaaaucagacauuuuuauguauagauuuuuuuucuuaaugacugcaguugguaaauccagguuuugcaaauguucucauguaaauaauuguggauaugaucuauaacagaacuuugugacuuagaucaucaguuuuucuagguuucuugaaguggacccaaaacaguuugaguaacaucuuggcccugccuauaaagauucucugugaggacaugauaauaaaaaagaauaacgacuaaacacugagugcuaacuaugugcuaggcaugcuucuaaucacuuuacacgcauucacucauucuaaccucacaacccuauggcagguaauguaauuaucaccauuuuucaggugagaaaaucaaagccaagaaauguuaaguugcuugucccagacuucuuaaucacuauaaaauggaagaaaaagaauuugaacccugaaaggcuggcuucaggaauauguccugucuaacuuuuaaaauggacuguucguugauuaucaaacauaugcucaaucucucuuuuuuuuuuuuuuuuuuuuugagguggaguuuugcucuuguuguccagcuggagugcaauggcgcgaucucagcucacugcaaccucugccuccuggguucaagugauucuccugccuuacccuccugaguagcugggauuacaggcacccgccaccacgccuggcuaauuuuugcauuuuuaguagaugggguuucaccauguugaccaggcuggucucaaacuccugaccucaggugauccacccgccucagccucccaaagugcugggauuagaggcaugagccaccgcgcccgaccucagucucucaauugguaagacagagugucuauacuucagaaucuugucaggaaauucucccugcauguuuuaaagugugaugucaagauacaaucaucauugacaauuuucugaagaauaggaaguguauccauauccuugacucaagccaguuucauuguuugggacuacagugucuuaguucccuuuggaacuaagcuuuuguuuagcuuuuaauauuuaauucaaacaucaacuuuccuuccuggauugcacccuucucccaccaccggaucccuagguucggggggugucuaccccaacacacucccauuguuugucugugggaagagcuccccaagggcaauggcugccccgacuuauuugucuguaucgccagcuccuaagcaagggcucaguaaauggccauggaagucaggaagaaagaagaaaggagagagggaaggaaguuaggaaagagaaaaauuuaagaaugaaaaaacagaaagagauggaaagaaggaaagaagggaggaagggagagaaagaaagagaaaggaagagagggagggcgggagggaggaggacagggaaggaaagagaaagaaugaaaaagggagagagaaagaaaaaagggagagagggagggaggaaggaaggaaggaaggaaggaaggaaggaaggaaggaaggaaggaaggaaggagagaaucuauuaacuuagagaauggcuucaucacaauggucuguauggguaaauauugcccaugguuuucagaucaucucauacgccuggauguaggagacacucuccccucccacacacauucugauuaaauuuuugguuuauagagcaaagaauucagaaacuuauauuaaagaugaagaucuuaagaagaugagauuccccuccgugcccuucugugcacacacagagauccaaagccuuuuccauagcugccugacagguuucacugcugccccgaagaaguccuugagacuugcagcaggagaaggaucucuguauaaucuuuguuugccuaauaauaggucuuuaaggguuuuuaaaaauugguuuccuuuggggaucauuuaaauuucccauuuccuuguaaauauuuuugguaaaaacauccucuuggauuucagaggaaguuaaaauagaaaaagcuugaaagcauucacaaagcaaugugcucucaaaacacagccauucauuugaaguugucuuuuagucugaauccaaauccuccagucaauacaaaccauaauaugcugcucggucucuguggauccauucugccucaagcuaugagcuucaaaauucucaaagaguuggacuucaaugcuguuucuuauauuuuauaauacuauuuaaucugccugaagguguaggauguaaugucaugauacuguacaaacuucugggcuacuggccaaccgauacagaugagaaauauucuauuacuaugaagcuggaguuccuuccuacuauuucauuuguauacauuuguauucauagcaauuauuuacuuaaauauuuuagcacauguaauuuugaaauuauaaaggacaucuuuuuuuuuuuucuuuuuuucuuggagacagagucuugcucaaucacccaggcuggagugcagugguauaaucucagcucacugcaaccuccgccucugggguucaaucaauucuccugccucagccuccugaguagcugggauuacaggcaugcuccaucacgcccagcucauuuuuguauuuuuaguagagaugggguuucaccauguuggccaggcuggucucaaacugcugaccucaagugaucuaccugccugucaguuuggagccaaguaggcagaaggucagcagaggacuagaaagaaacucucuguucccaaaccagucaagcgccuuccucugggcucgcguucuacaagccaucaucaagcaaaccaagcuggaacuaugucagccgccucccccaugcaucuaaucaagagguaguuagcuguaugauggcacagagagaaggugagcucugaggugaauccaagacuuuucagugaccacaguuucucuugguuagggccccugacucagagccucacuucauacaguggggaaggaccuguaggaaagacuuacauucaugccacaaaaggcaguccauucuguucuugaguguaacaucuuucugucuuaaaaauaauaguaauuaaggccaacgcaggcagaucauuugaggucaggaauucaagaccagccuggccaacauggcaaaaccccgucucuacuaaaaauacaaaaaauuagccgggcaugguggugcacgcauguaauuucagcugcucaggagucugaggcaugagaaucgcuugaacccaggaaguggagguugcagugagcugagaucguaccacugcauuccaucgugggugagagaaugagacucugucucaaaaaacaacaacaacaacaacaacaacaacaacaaacguaauuagccaggugcaguggguugagugccucuagucccagcuccucaggaggcuaagauaggaggauugcuugagcccagcaguucaaggcuauagugugcuaugaucaagucugugaauagucacuguacuccagguuggucaacauagcaagaccccaucuaauaaugauugcaaguugcagccaagucuccugcaaguucaccuuccauaguguaucucaaaucugucuccucuuuaccaucuucagcgccaucuccaugcaagucugcgggacaucaucucacaacugagauacugcaauggcuuccaugcuugcccuugucaccuuaaaauucaucuccuacuugguaaccagagugagccucuuaacuuauaaagcaaaucaugucacacacaccccuaccugcuucaaccccuuaaagggcuuuccauuucucuuaacuaaacaccuaaaugcaugaccuugacccacaaagccccauguucccugauccagaccucaucuggcuuucauccccaucaucggcuacucucaccugcugacaagugcuagaagacccuugaggcuaccugccuuaaugacuuugcacuuagggauccuuuugucugaaacacuuuuacuccucucuucucaaaccuuggggucuguuuaaauauuaucuccauagaaaggguaucacccacccucuacauaaaagguagcccaauuccucuacccaccauuauugguuguuugcugguaaacauuuagcaacuggcuccugaggguggggugggugggguaggugggggaaucccugauuguuaacguuugcuuauuucugugguguaaauucuccuaccacagcuaauuucuagcuaucagucugaagucaauaggcuggaagguuuuuucucuuuccuuuuuucuuuucugagacagggucuuccucugucacccaggcuggagugcagugguguaaucacagcucacuguaaccuccaccucccaggcucaagccauccuccugcgucagccuccagaaguagcugggauuacaggcaugcaccaccaugccuggcuaauuuuuuaauuuuuuguaaagaugagguuucucuguguugcccaggcuggucuugaauuccugagcuuaagccauccucccgucuuggccuccuaaauugcugggauuauaggcaugagccaccaugccugguaauaggcuggaagaguucugaagcauaacaaucaguuauugagagcugaugcaagcuggcuccagcucuucacugcaugauugucuaucauauagcacugcuuauuuccuuuaaggcacccaugaaaagcugucagauuauauauuuguuucuacacuuguuuuuguguuuaucucuauagacacagauuuuauagacagagauuacagugaaaauuccaugagaaaaggucuaucucaacccuaguccaaugcuuaucaauguagaauauauccaauauguaucuaugaaugaaugauaagagcucauucuguauacaugagucuucccuuuuacagccuuuucauuuucucaguuucucuaaguuuaaaaaaauaauuuuuuauuucaggggaaaaugcucuauuuuacugcuuuuaacaccuagaagccaagaaggagagaggauguugagcaagaagggugugaaagaagaaagggcuggaagcguuuguuagaggggugucauacaauaugacauggaaggaauuuauaguuuaaaccccucuagugagaugauuuuuagucauuauguuaauuggaaaauaaguuuaucuuuagcauagaacacauucugccccuuguuauguaaacuauaaaauuucuucuucaucacagugccuccugcccagcacagugccugccagacaggggauauguaaauaguaaauaauaaauaaugcucuugacuauggauucuaagggccauucuacaaugguaggaaaguuccaaauucaagcuaauaaaacauuuauuggacugggcauguuggcucaugccuguaauccuagcacuuugugaggcagaagugggaggaucgcuuaagcccaggagaucaagaccaaccugggcagcaauauaguaagacucugugcuccacaaaaaacuuaaaaauuagcugggugugguggcaugcuccuguggucccagcuacucaggaggcugaggugggaggaucacuugugcccagcagguugaggcugcagugagucaagauugugccacuggacuccagcccgggcaacagagagagacccugucucaaaauaaauaaauaaaaauaaaauaaaacucuuacugugugccagguauuggugaaaacaaaagucaaaaccuggcacuuucugugggugaaaagcugauuuuucccuaaucagguucagucuauuuuccuaaggaagccuauaggguuguaagccuggacacacaagugcagugcucuagccugauugaaagcauggccagcgugguggagguggcagagaggagacaguaccaggugacugggggacauggcacagggcugcagcugauacugcucugggccccugggaaauucccaggacagcauccuguguggcacaaacuaagauacaguccuugggugaaaucaucucccucaagggaaguuaaaacacucgcuaucccccuauucuccaaucucucccuuccuagacuuguuggcaaaacacauugcucacauuuacaucgaaaacagauacacaaacccaaaacaaacaaaccaaaaacaacaaaaaaggagagagaaucuuuaucuaagaugacuuuucuuaguuauaucauugguccuagccuuguuggucaaacacauugcucauauuaacaucaaaaacagauauacaaacagaacacaaacaaacaaaaaccaaaaaaaaaggagagacgaucuuugucugagaugacuuuuccuagaucuaucauuggucuuagccuuguuggucaaacacauugcucauauuaacaucaaaaacagauauacaaacagaacacaaacaaacaaaaaccaaaaaaaaaggagagacgaucuuugucugagaugacuuuuccuaguuauaucauuggucuuagccuuguuggucaaacacauugcucauauuaacaucaaaaacucuggggacuguugugggguggggggagaggggggggauagcauuaggagauauaccuaauguuaaaugaugaguuaaugggugcagcacaccaacauggcacauguauacaaauguaacuaaccugcacauugugcacauguacccuaaaacuuaaaguacaauaauaauaauaauaaaaagagaaaaaaagucagaaaaaaaagauauacaaacagaacacaaacaaacaaaaaccaaaaaaaaaaaaaaaaaaaaaggagagagaaucuuugccuaagaugacuuuuccuaguucuaucauuggucuuagccuuguuggucaaacacauugcucauauuaacaucaaaaacagauauacaaacagaacacaaacaaacaaaaaccaaaaaaaaaaaggagagagaaucuuugucuaagaugacuuuuccuacuuuuaucauuggccuaggucugaaacaccaaaggagaagcuuccucuccucuucuuucucucaccucugccuacugcagaaaacucuuucacaaagaaacacuuuuguaugaaaccaguuuccuucacaucacucaaguuucucaacacuuguucuguuaauaaacaaacauagguuugaaagucuuccuuguuuuaggacuuucaaaccuauguuuguuuacuaacagaacaaggauuuaggguuuuuuucucuuuccuuuuuuguucucugccauucuaucauagguuuugcuuuuucaccuaaagaaaaucccacaauggcuuggauaaaugauacuaaucuguauuuacaguaucucacuuuacuccuugcuauuuugaguucuuacaguugacugacuuucagauguaugaaaaaauuggaccaaguucuugaaaaacugguugucaaauccuaauucuguagauguuccaagaauucuugagcuuuaaaaaaugaucccugucaugaaauguuuuauuuucuagaaaauucuuaugccugacaaauacaucauauucauagaguacuuuuauauuagauuucaggagcuuuacauuuuuuuggcugacagagcguuuccaacacccugaacauuuucuuaguaccuuuguuuuauacuuggaggacugaggccugaauaacuugucucacauagcaagguagucaguaauggaguaaguuuccaacugguuuauuguagacuuacugguucauuggagacucacuccaacaaauuuucacuuaauuuccuagcaauauaauuuaugaauuaucaauauuaaaauauuucuuuauugugcaaagacauuuuaugugcuuccaagaauuguuuucauaguguauaaaagagaauauacauauuuuauauaauuauguauacauauuauauguauauacuuaagccauaaaaacaauucaaacaugaagguauagaaaagauuaugguaaggcaaaugagcaaaggcuuaauaaauaagcaaguaaucaaauguucaaaaaucaaugcuauguaaagauaagaucuuuacccuuaaaacauuuaccauuaacccgggaaaacagaaaacaaacagucucuaauugaugccagcacaaagaacuagaguccuugugcaaaauacaaagaccuucuggaaauggcaaaggaaggaaugaauucauaaacuuuaaagugugcucagaggggucaggacaagcacaggcuucucaaaggaggugagugcucuuuaggugggaagauggugaccacguggauugagggagaauugcaagauuggccuaagcaaaacucaaaggcagaaauguccagauuuucucccuugucaaguguucuucacuggaagccagacucucgcuaucauuccagggugucccucuggggaaagggaaggaacaccaccacauuaaaugugacucaucucagucucagaagcuguggugugcuggaacuugcuugcaaaagcucaagagagcuuucccguugcaauuuggggaagugaaugacaacacauugguaguuuugguaguuuagaaucagccaaguugggaguauuuacaccacagaaaaugacaaaugcuacaaaucagcuccccaugccuauccuacccaccaccuuuuaaauguuuaccagcacaccuggaagcugugcauuuuacagucagggugcuauuguggcagcugugugagaggaagagaaaggagaucucugggaguggggcagaagaaacaaguaaggagucggagguagagacaaagacgaugguggcaggaaaccaccaaugaccaucaagaagagcgagugagucaccuaggaauucaugggaaagagaugaguccagaggggacuggaaucaccguagggaaaagcagaguugcuuagugcucuuacuauaugagugcugacuuaagauguuaaaaaucugcuuauauucggucugacaccuaacauuuuuaugaagcuaaaauuauuguugcuuugcuaugucacccagucacuuguuucuguucacuggagcagauccaaaacaauucuuuaaugaauuuucgcacugccugcagguacugcugccacucaccucugaauuaaggaauuucaggggugaucucauuaugcucaauuuuccucgaugucagaccugacccccagccaauuuccuguuaaagugcauagguccaucuuuauggccacagggaggggcuggucuucauacacuugccauuguaaacagaccuagcaguccaauaccauauucacagucucuuauuccaaaacuugccuuuucuccuacauuacaaaccuuaguuauugucuaaguaguuauccaaaacagaaacuugggagucaucucuaguuucucuaucucuuucaucucccaugucugaccagucagcuuaauaucuuuaguaucuguucccaacugcuucuguuacugccuuacaucaaguucucaucccuuuuuccuugaguuccacaaaaacugccuaaucaucuaggcaguggacaucuucagccucaccauccuccagucucugccccauauuagacucacauggauaaagcacacagcugaucaugucaaaccaacagggguuuccucaaaguuuucuagaauuuucagauaaaguucagacucuucuugucaacccacaaggccuuaugaaacaacgcucaucuaguuccucagucccauugcucaugaauccuccauagccaccagcucuuugugcuucagccuggaacccaccagacuacccggcuccuccaacuacuucauuacuuaccuaauuccuacucauccuucaggauucaguuaacaaucaccucgaaaaggaagucucccaugauguccagaaugauccagauaucgcucccucuuccccucacuccucucugcuucuauggugacuguauccauuucaaucccaguucuggucauacaguugggcgguuguccgccuuccuuaccucauggcaagaaccauguccucuuugaccuugugucccuuuuuacuagcacuuaauugaugcuugauguauguuuggacaaugguuuguccuggacuugauuuucccuguagcugggauaguuagcuugagaauacagggguacauaugauacagaaaauaaugcaaagcagggaguaauauguacuuggccguauucugugacucuaaaauguaagagcaugaaagacaaagaugaaacauucuuagacagguggccuuaucaacacuaaugcagagaagaggagucaggaagaggcugcuggaccuggccacaagaauguuaauggugaccuuauauuagguaguuuuagggaaugcaaugaauggcauagaaggauagggugugggagaggaagcuaaugaauauauguuaguucagggugugccagaugcuuuacauacauaauuuuaugucaucuuuauuuuuuauuuauuuuauuuauuuauuuuuaagacagggucaugcucugucacccaggcuggagugcagugguacaaucauggcucacugcagccuccaccuccugggcucaagugauccuuucaccucagccucccuaguagcugggaccaccggcauacgacaccacaucuggcuauuuaaaaaaaguuuuuuggccaggcuugguggcucacaccuguaaucccagcacuuugggaggccgaggcagguggaucacuugagguugggaguucaagaccacucuaaccaacauggagaaaccucaucuuuacuaaaaguacaaaauuagccaggcgugguggugcaugccuguaaucccagcuacucaggaggcugaggcaggagaaucgcuugaacccaggaggcagagguugugguuaaccaagauugcaccauugcacuccaggcugggcaacaagagcagaacucugucucaaaaaaaaaaaaauuuuuuuuuuugcaggugucacuauguugcccaggggcgucuugaacuccugggcuuaagugauccuccugacucagccucccaaggugcugggauuacauaggagugaaacaccgcaccugaccccacaucgucuuuauaaucacucuaggaaauagguuuauguccuucagaauaaaaacaaaaaauaauuaccaacaaaggaguugaaacucagagguucaaauaacauacaugaagucaugccuucuuagugggugaugugggauucaaacccugguuuauuacuucacaagaccacaugcuucucauuauaccauauucuuuauagauguagaaggagacaucagaauaaagcugguagaauuuacccgagccuuaacccuacucuucccccaacucaaaaauguuuaucuguugaagaugguaggaaauuaggauaauagccaaaauucacaaaucgaucaaaggaauauuuuuuucucaaaggagaaacuuggauguuuucaaaggcaaguauaucuuucuauauuuauucuuaauuuccaugaaaaguugugcugauugggauaauuuuaacacuauguugagacuuuguaaguccaugugacaggaugguaucauccaaggaccacagugagaaaacaaggaucuaaauacccaggguucuauguucagcccggccccaauuccucguggccugcugagaaacucuauuuugggagcuuuacugcccccaaaccccucccccaugcaucggugugagugcugaacugggcaaaagaagguaggucacuuuuaggaguuugugggguggcaacccuccucuucccuccccuuccuuuugaggagaaagagaauuuuagucuucucagaaggcugauggacccuagacuacaacucucaccaaguuggauaaaauaguaaagaaaucagacaguguugauggagagaccaaaccauacuugguucaccaacuguuguccugacugacaggaacggguccaccuugagcagagaagggccaccaucagugagggccugaggcuugaaucucugggguuugcagacaccaggugggucugagguggcagaacuucucccagagggaggcagaggggagucucuugagaagagaggcaguagagggcaugaaaaagaucagaaggagagauaaacauccauggagauaccuuuccuuuuggaugccugcgucuucaagggcggaauuacacauuuguucuuccugcacugacuggcuguucuuuugagaucugccugacuguccuuaagaaaacuccaucauaguucagugucuguuuggaaagagaaggcugcuguagcagaagggacucaugggaagggauggaaauuaaauuucagcuguuuggcagggcucucguguagacagggcugaugagaacaucucuccaccaguccaucccaugugacacacacacacaggcacacacacacacuagcaucagcagcugcagacauuccuaagguggggcauuaagcagugagguugaauucccuaacccuacccuaucaaggauuaauuaguucuccuuugaagacagaaaggagccaggcgcaauggcucacgccuguaaucccagcacuuugggaggucgaggcagguggaucaccagaggucaggaguucaagaccagccuggccaaccuggugaaaccccaucucaacuagcugggcgugguggcaggcaccuguaaucccagauacuugggaggcugaggcaagagaaucacuggaaccugggaggcagagguugcagugagccgagauugcaccauugcacuccagccuggacgacagagcgagacuccgucucaaaaaaaaaaaaaaaaaaaaaaagaaagggaagggucuuggcacaagccaaauuacaaaugugucuauuuuauguuuauucaagcauuagcccucacuuuguaaacaucugcuuugcccacugccuccuuaguucauuuuaccuguuauggcagugauucgacagagaugagagcuuugaguuguauuugcuucacugucugccaacaaccacccuggagccaaaaauacccuucagauaaggcacaaagggacuuggccugggcugaaaccaaaaucaacuuccaaagaccauaguccuuauacgaaugagagcucagagcugugcacugaagaaagugagucagccaacgacuucaaguccccaugugcccauuguaagacaucccuggaauguggcucucugcauuugagcaauggguaaacaauggggcugcaacaauaccugccuuuaaaaaugaguggguucugcuaaauuuccagagagagagaaccagaucugauuuuauauuuuuaguuaggaaauuccuuguuuucucccuguggacgcucagaaccugauaccauccuaucacauggacuugcagucucaacauaguguuagaauuaucccaaggaacacaccuuuucaugggaauuaagaaugaauacagaaagauguauuugccuuugaaaacaccaaaguuucucuacuggcaaaaaauauuccuuugauccauuugugaauuuuggcuauuacccuaauucccugccaccuucaauaguuaaacguucuugaguugggggaagagcaggguuaaagcucaagguaaauuucaccaccuuuaaucugacgucuccuucuacuucuugaaauuagugagaauuuccaguguaauaaucaacagugacuuacgcagauaaucaaaaugaaugcuuuuuaaaaauaugcaaagcuggccagugugauggcuuaugccuguaaucccagcacuuugggaggcugagguggggggaucacuugagcucaggaguuugagaccaucccgggcaacauagugagaucauaucccuauaaaaaggaaaaauaaaaauauuaaaaaauauuuuaaaauugccaggcgugguggcucaugcuuguaaucccagcacuuugggaggcugaggcaggcagaucaccugaggucaggaguucuagaccagccugaccaacguggugaaacccugucucuacuaaaaauauaaaaauuagcugggcgugguggcacaugcuuguaauuccagcuacucaggaggcugaggcaggagaauggcuugaaccugggagguggagguuguagugagcugagaucaggccacugcacuccaccugggugacagagugagacucugucucaaaaaaauaaaauaaaauaaaauaaaaaauuaaggaauauguaaaugucaucucauauuuuaguaaaugugauuaauguuucuugcagaggacuuaauguuucuugcagaaguaaaaaauguaggcagacagaagagaauauuccuguuuuccuguccauaaauaugcccauauauagucuucuguaacuuacacuauucaccucacuguaguccucuuucugguucaauugucauacuucuucagugaugauauuugcuugcuuggcuggcuuuaucgacaaucucuacuucaaacucuuuucaaugaccaaauccaggaaauauuuuaaggugugcauuuuccuguaauuccauguaguauccaugacuacuccuuuucauuucaauguuuaaaauucugauaaaauacagguaacauaaaauuuauuauuguaaccauuuugaaguguacaguucaguaguguuaaguauauucacauuugugcaaccaguccccagaacucuuuucaacuugcagaacugaaacucuguaccauuaacaacagcccgccauuucucccucccccuucucccuagcagccaccauucuacuuugugccacuauaauuuugacuaagugccuuauauaaguagaauuauacagcauuuguuucuuugugacugacuuauuucauuuaguauuacauccuuaagauucauguaugcuguagcuugggucagaacuuucaucccuuuuaaggcugaauaauauuccauuguaaguauauaggacauuuuguuuauccauucauccacccacggacacuuggguuucuuccauguuucaguuuuuauaaacagugcugcuauaaacauggguguacaaauaucucuuugagaucuugcuuuccauucuuuugaguauuuaaccagaagcggaauuucuagaucauacgguaguuuuauuuuuaauuuuuugaggaaccuauggacagcucuugauauaacauccuucccuuugguuuuauauaaaaaugcauucuuuugaauauuguaccuguauuuuuaucaauacuuuuuaacccucaauauuagccacuuuccaugguuuaguguuugacccucuaauguuuuuuucuuuacauuuucuccuuugguaaacacauucacucuuguggcuuuuauuaauauuaucaccucuaugaaaaucuacauauucaccucuggcuucugucuugagaucaaaauauuuagcuauauauuaaauaucuccaaugggcaaauauccaaaauacaggcccaagacagacuccaucugugaauccauuucucuucaccuacacaggaagcauuugagcaaauuuaacccuaccacaagauagagccaaccaacaguuagaacaguaugcuuggguggccacugggaaccuguugagacuuuaaguuuuacuccuaucccuuucauucauccauacaaauguguccaucagaagagauagaugcuccagaaacaggacaucuuugcugaagaccuuuuuacugagugagcauaaugcaucgggagagugcacaucccccucacuuaaaacaugcugccgguugggcaaaguggcucaugccuguagucccagcacuuugggaggcugaggcgggcggaucacuugaggucagguguucaagaccagccuggccaacauggugagacccugucuguacuaaaaaauacaaaaauuagccaggugugguggcgggcuccugcaaucccagcuagucgggaggcuaaggcaggagaaucgcaugaaccugggagguggagguuacagugagcugagaucaugccacugcacucuagcuugggugagagagugggacucugucucaaaaaacaaacacacagaacaaaacaaaacacaacaacaagaaaaaacaugcucccaagcuguuccucaccauaaacguccuggcaacaguugaaguggggaaaacuuucuagagaaggagugacuaggcugauucacagguuuguacaaccacucccugaggcugcucagacauuugagaggugagaaaucacaaguaaggccagacuuccuauaauuaagcaggugggaggacaaaaaaauuaagauucgaaguguuacugcaauuaugaucucauuuguacucccagacuggugauuucuuuucuagaugaauuguagacuauaugcccaagucaggaagcuuggaguucagcuaaacuucuuuuucucaccuuuaaaaucuaacaagcuuccaagugaaucuaucccuuuuaacaugugcggaaguaaaauacuauagcuuaaaggauugggugugggggcuggggugguuauaaauggaacacaacuauuguaaaauucuuauauuagaugcuaugaauucaaaguagacccugauaaguuaaggguguaaauuguaaucccuagaacaacuauuuuaaaaugccaagaaguauagcuaaaagaucaauaaaggagauagaaugaaauauuaacaauuauucaauaaacagagaagauagaaaagaagaacaaaaagcagcuggaacaaauagaaaccccccaccagcaggauguagacuugaacccaacuauaucagugauuacauuaaauguaaauggaccaccaaacauuucaaauaaaggcagagauuauuagacuagauuuuuuuaaaagauaaaauaggcaagacccaauuauaagcuguuuauaaagaaugcacuugcaauauaaagaaacagacaaguucaaagugaaauauggaaaaagauacccaugcaaacaccaaucacaagaaggcugggguagcuguauugacuucagacaaugaagacaucaagacaagaagaauuacuagaaaugauuagagucauuucauaaugauaaaaaggucaguuuacaacaagaccaagaaaagcugggcaugguggcacacaccuguagucccagcuacuugggaggcugaggcaggaaggucucuugugcccaggaggucaaagcugcagugagcuacgaccgcaccacuguacuccagccugagagacagagugagaucucuaucucuaaaaacaaaaaaaaugggcuggaugugguggcucacgccuguaaucccagcacuucaggaggccaagucggguggaucaguugaggucaggaguucaagaacagccugauccacauggugaaucccugucucuacuaaaaauacaaaaauuagcgaggcgugguggcaugaacuuguaaucccagguacuuggaaggccgaggcaggagaaucgcuuaaacccaggagguggagguugcaguggcugagaucaugccacuacacuccagccugggugacagaguaauacucuguaaaaaagaaaaaaaaagaaaauuaagaauuaaaaaaaauuuuuuuaaaaagaccaaaaugaucugcccucgaugguaucccuuacaugccgcgcccucucugcuucuuccacuccuuuugcucaguucaauuuucuuuguuucccaggagaauugugucacccuuccauucaaauccaucccagcaacaaguuuauuuuuaaaacgaaaaugaggucacuucucuaauuaaaaacuuuuaaugguuucuggugguuagcuggauaaaguugaaaucccuucauuagcuucuuauuggugucucaaaggcuugccccaacccaccucuccaacuuugucauucacugaucaucacucaugccagacccuacucacagcaauugcuucuuguuccucaacaagcauugcuucuuucugugcauccuuccuccacuugccagagaccuccucccuuaccuuccuccacacauuccugaaacauccuucuguacucagcuacaagcugugcauaaacuggccucucccauccucccacuccacccucacucuacuccaacacuggccucaaauguagugaguugucucccauuugaggcucacucuuggcauuugcuguucccucugccaggcgcacucuccuuccuggaucauugcauggcgacuaacuccuuugaggcauugaggccucaggcuaaauagguacuucccagagaugcuuucccuaacuucccauucuuauuuagaccccgccucacucgcaugcaacaugcuguuuuacugaccucucagccuuguuuauuuaucuguuuagagugugucucuccacuucaauagaauggaauguagacucuaggagaauggggagccuuugggcuuuauucgaggauauauucucaaauuuuagaacagugccuggcacauagcaggcagucaguaaguauuugcagacuacaugaauugguaggugggugggaacauuuaacauagagcaagcuuguccaacccauggccuaugggcugccugugggccaaggauggcuuugaaugaggcucaacacaaauuuguaaacuuccuuaaaacauuaugaaauuuucuugugguauuuuuuuucuuugugcucaucagguaucauuaguguucauguauuuuauguguggcccaagacaauucuuccaauguggcccagagaagccaaaagaucggauacccuugguauaaaggaacuuuuuucuagugcuaaaucccuucccaacgugucaggcuugcuuugucagugccugggucaguguuggggcuccgcugcugauuccauuuaucacccccuuaggcaguuucccucccagacucucaggccuuccugggaaccuuccaccuccacuggcagcagggcuggucaggucuggaucgcucagucugccccggugccugucuaucugccugucagcaugcagauccaaaucacuuaguccugucuauuuucuuuucuuuuuuuugagauggaguuucacucuugucgcccaggcuggagugcaguggcgugaucucggcucacugcaaacucugccucccggguucaagugauucuccggccucagccucccaaguagcugcgauuacaagcgcuugccaccaugccuagcuaauuuuuguaauuuuaguagagacgggguuucaccauguuggcuaggguggucuagaacuccugaccucaggugauucaccugccucagccuuucaaagugcugggauuacagauguaagccacugcgccuggccaguccugucucuuuucaaugcuggcuaaucagaaaagggugcuuaauaauugcugccaaucaugacuuauaaaacucuuuuaaacacaacuccaagcauuuucauggacuucuuaaaacguauuccuggcauggacggauuaauggauaaacaagauguggccuauccauacgauggaauguuauucagucuugaaaagcaaggaagcucugacucaugcuacaacauggaugaaaauugaagacauuaugccaagugaaaagccagucacaaaaggacaaauucugugcgauuccacuuauacgagguaucaagagucaucaaauucauagagacagaaaauagaacggugguugcccggcaguggcagaggcagaaaugaguucuuuaauggguacagaguuucaguuuugcaagauaaaaaaguucuggaaauugcuugugcaacaaugugaacguaguuaacacuauugagcuauacacucaaaaauggucaaugugguaaaguuuauguugugcauauuuuaauuuuaucacaauuuaaaaauuauaaaggagaggaauaggcugggcacgauggcucaugcuuguaaucccagcauuuucagaggcugagauggguggaucacuuaaggccaggaguuugagaccagccuggcaaacauggugaaaccccaucucuacuaaaaauacaaaaaucagccaggcgugguggcuugugccuguagucccagcuacucgggaggcugaggugggaggauuaccugagcccaggagguugaggcugcacugagccgugauggcaccacugcacuccagccugggcaacagagcaaucccugucucaaaaaaagaaaaaagaaaaaagaguauaucacccauaaaauauuuugcccauagacaucuuguguguguaguuguacuggaaacugaaauucucuuuggaauguuuccuacugugaugcugcuggagaaggaucuaaaggaaugaggaucuggaguuuggcguuguggaucccuggaggauucaaugaaacaguagugagaaggcaggauagucaugcugggagaugagggcugccuggcagcuccaaggaggugcuuuccucaggucacacacugaccuucagauucccucucaggaagaaccugauccauaacucugaaugcuccugggaucuguuaagcaagaaucuguguuuuaauuuuauuacaucuagaaauuaauagacuguaaaaauuuccccuugguuugcuuuuuaaaaucaucuuguauuguuucucuuuuuguuguguuuuuauuuuaaagaaaaauguucaaguuuaccuucucaauguccuaaaccuuuaaguucaacaucauuuuacuuuucccaagaugucccuucacuucucuucucuucuuugauuuuuucuuuccuuccagaauuccccuuucuaguauucaguggccuguuuucuuuugagagaaaaauguuuggcaacuuacucuuuggcugcaaaagugcugaacagguuuuaaacacuuggauuuucccagcuggcccuaauccuuugccuguuacauaaagggaccacuuaagccccugaaauugcaggggacauuuguguugaaguucacuauucuaggauuauuuggugagguagguaugguugugaaacugcaaugcacauucaaagaugacacuaccacgaguccaaaucuaucugcacaaagccgggaggaugggcaggccugccucccucuuuguguggcuggucuguccuuugcagaguaacagcucugcuuccugucagggcuguggcgguuggcacagaguccuggcacugagcucaguggccccuucuuccuuaagcccagccacacugcuucugauuccuggcucaugcuugccauggcuucucuugugauuuucuuucaaugcuauauuguccucuaagagccuaaaauagaagcuugaccaugauccuuucauagaauucaauauucagccucaaaauaaauuaaauauugccacauaauaaguuucauucacuauaauauguuuauuaauaaccgauauaauagauuguuuaauuauaguuaauuauugauacugacauuucaugauuauagcugacauuuuuuuuuuagugcuuccuuuguguggccccguauugcccuguauagaagcauuucgucuucacaacaacucuaugagguagguacuauuauccucguuuuccagcuggaaaacaggccuggggagauugagaaacuuacccaagucccacagcuagggagugguggagcugggauugaguucagguugucuguuuucagacccagagccugcacuggaguuugugugucccuaugugcauuccacagaacccaguagcagauggugcaaugaggaaaacaaaaggagugucauguacuggaggcuugggucccccucagauccauauguugaagcuguaacccccaaugugauggcauuugagguggagucuucaggaaauaauuagguuuacaugaggucaugaggguggggcccccguggugggauuagugcccuuacaagaagaggaagagacaagggcugggucacucuccagaacaugagcacacagugagauggcagccaucugcaggccaggaggagugcccucuccaggaacucaaucugccggcccuugaccgugaacuucccagccuccagagccaugagaaguaaaugucugcuguuuaagccacccagucuaugguauuuuguaaucgcagccugagcacaguaagacaagggguagugcuuuuuaaucaaaucaauuuugaaaaugccccauacaguacuaucuuccuaucuuaaaggaccaaugaugccuauugaaaucaaagacucugaaaaguccugcaguaaaggaagcuauuuaaauuuguuuaaacaauugcuucucaaacuuuuugacuauggaauaucuccccacuuaugaauaucucaaagaacacacuggaagguacuacuggaagugaagcauaugcgucagacgugaaugugugcuuauuuaccaggugggaugaacugcccaaugaagccauaaaguuguauaggcgaggguuugguaguugaaaagaggagagaagaaugcagacacagccugagaaagggcaaagggccguauccaacaugugggaagugccauuucagggaaaagagcccaaauauuccggaacaucuggggaagauaaaaggaaguuguucuugggauaaauuuggugagaaccuacuuucaagagcagaguuuagggccuguccuggcuggaggagcugauuuuaagaacagaaagaacaguccaguauuaaauguuaauuugaauauaggaggauaggauaaaaaaugacucagaauuauuauguuaucugggcugaaaagcgucauauuuacugcccauuagaaauuccuuacaggcugauuuccuaaaguuagcuucauuucuuucuuucuuucuuucuuuucuuuuuuuuuuuuuuugagguggagucuggcucugucgcccaggcuagagugcaguggcgcaaucucggcucacugcaagcuccgccucccggguucacaccauucuccugccucagccucccaaguagcugggauuacaggcgcgcgccacuaugcccggcuaaauuuuuauauuuuuaguagagacgggguuucacuguguuagccaggauggccucgaucuccugaccucaugauccacccaccucggccucccaaagugcugggauuacaggcuugagccaccgcgccuggccgagcuucauuucuuucuaggaaauuacaagacauggacucaaauaaaaggcucaguugaccaagggaacaagaucuuguuuaguccugguaauacccaauaaauauuugcuaaauauaugcaaaggggcagggcacgguggcucacgccuguaaucccagcacuuugggaagccaagacggacagaucacuugaggucaggacuucgagaccagccuggccaacaugaugaaaccccgucacuacaaaaaaauacaaaaauuagccagagguuguggcauguuccuguggucccagcuacucaggagguugaggcagaagcaucgcuugaacucaggagguggagguugcagugagcugagauugcaccacugcacuccagccugggcaacagagagagacuccaucuaaaaaaaaaaauuaauuaauuaauuaauuaauuauauugaaaggacaagaaagggaggauuaauugcacaauuuggguuuugcauccuuaaaaugaaauauuaauuuuaccaagcaguuaguuuuuuaagaguagggguggaggggagaaggugagauugcuggcagaaagauaacaaauuacacaaaagccaucaagguguugugugaucuuacgaugagguuucaugucuguucaucugucagaugauggggccagacuagguggucuuaaaggcccuguccguaucuaccauccuaagauucucuguucuucagaacacgcuagaggaaguuugggaaagcaacuguuuuauucagagauaaguacacuuaauacaauucagacaauacauuuguaacgggcauuuaacacagcaaucaauuguacaaguagauucuauuuacuuuuucuuuuauuaagcggaagaauaaauaaacauaacuggccucaauuauuuaacacuaaaaauguugacauuguagagauaaacgucaacaccaagaaauacguuuuccauguucuccuuaaaacaaauagaaaguuugaaugauaucaauaauuaucccuuagaauugggauguauucagguuuuaugcguguuacauagagcaaacaggcuauuuucaauuucuguguuuguauauuuaccuauaauugccaacuuucugcaaaugauguuuccucuuguguaaauaccaacuggauuuagcaaaugucaugauuauucgugccaccuauuggugaaauguaguaugacagcaucuuuugugugcaagacagcuacuauggggagaggaagguugucaggacaaauuaaacaggaauucuguacucaagaacgguggagaaucuaucuuuuaugaggcaauucaaaauuugaacacuggaaggguauuugaugguaguaaggaauuacuaccuuuuuuauuuccuauuauuuuuuaauuguuuauuuuuaggugugacauugguauugugguuauguuaaaacgucuuuaucuuuuagagacacauaguaagauauuuaugaaugagcgaaaaugauauguguaacaugauuuaaaauaguauuagcaauuuugauacaugcacaacguggaugaaccuugaaaacgugcuaagugaaauaagccagacacaaaaggacaaauauggccgggcauggugccucacaccuguaaucccagcacuuugggaagcugaggcgggcugaauacuugaggccagaaguuugagaccagccuggccaacaugaugaaaccccaucucuacaaaaaauacaaaaauuagcugggcgugguggcaugugccuguaauuccagcuacucgggagacugagacaggagaaucucuugaacccggaagguggagguugcaguggagccaagaucaugccauuguacuccagccuaggugacagagugagacugugucucaaaaaaaaaaaaaaaaaaguggggguaggcaaauauauaggguaucuagagugucagauucacagagacaaaaaguagaaugaugauuaccagagacugggggaggggaaguggggaguuaccaucuaauggguccagaguuuuaguuuuguaagaacucuuuucuggagaugggugguggugaugguugcauaacaaugcggaugucuuuaauaccacugaacuguauacuuaaacaugauuaaaaugcaaaguuauaacauguauuuuuuagcacaauaaaaaaaaaauuagggccaggugggugcaccugggcuggcaaggaaggggcacccgucuggguggguggggcagggaagguaccugaggucacuggcuuggcgguagcggcagggguggcagagguggaacugcagaguugcaggguccacugacccuuacccucagcuggagaauaacccuccagaucaacugcaagaacaaaccagcaauccugagaggagccgcagacccucugaaggaagcggacugccccugcaggacacaggagacaccccaaauacugugagugccccaacugcggaagugggaaagggggacccuccucuuccaaacacacaucaccacuggggaagcggaaggucuguuuuugggagaaguuuccaacuuuaccucaagcugagucaaguuagagagcugagccgagcaaaauacaaggguagaggaagcagcagaaagguccugggagcucguuggguccccaagcagcccauuccugccugacaccacagggauccaucaggaggguggccagaggagaaggggguaaaacuccauagggagaaggaauucucuagcugaacuuuauaacaauuugaaaggggcaagaagccuccugaccagaaccuaggggagagcaugaaucuggugugcagacuucacaugcagggggaagaacugaagcccuuuucuuccacagcuggaagggaaaaagccuugggcaaguuuucaagcccaucucacccuccaccaggaaacagacucgaggcuguugggggaggcacggugggagugaggccgacccuucgguuucugugggagcugggugaggccugugauugccagccuuccccaacuucccugacaaccuguaugacucaacagaggcagccauaauccuccuagguacacaauuccagugaccuaggaaucccacccccaucccccacagcagcugaagcaagaccugcccaaggagagucugagcucagacacacccagccccgcccccaccuuaugguccuucccuacccgcccugguagggaaagacaaagggcauuuaaucuugggaguucuagggccccacccaccaccagucccuuuccacaugacuacagcugaugcuuucuggaaagcaccaccuccuggcaggaggccaaccagcacaaaaauagagcauuaaaccaccgaaguuaaggacccucacggaguccauuauacccuccuccaccuccacuggaacaggugcugguauccauggcugagagacccacagacgguucacaucacaggacucugugcagacaaccuccaguaccagccuggagcuggcuagacucacuggguggcuagacccagaaaagagacaauaaucacugcaguuuggcucacaggaagccacauccacaggaaaaagggggguguacuacaucaagggaacaccccaugggacaaaagaaucugaacaacagccuucagcccuagaccuucccucugacagagccuauccaagugagaaggagccagacaaucaacccugguaauaugacaaaacaaggcuguucaguauccccaaaaaaucacacuaguucaccagcaauggauccaaaccaagaagaaaucccggauuuaccugaaaaagaauucaggagguuaguuauuaagcuaaucagggagggaccagagaaaggagaagcccaaugcaaaaguauccagaaaaugauacaagaaguaaagggagaaauauucaaggaaauagauagcuuacagaaaaaaauaauuuaaaaauucaggaaauuuuggacauacuuuuagaaaugucaggugcuuuggaaagucucagcaauagaauugaacaagcagaagaaagaaauucagagcuugaagacaaggucuucaaauuaacacaauccaacaaagaccuagaaaaaagaauaauaaaauaugaacaaagccuccaagaagucugggauuauguuaaaugaccaaaccuaagaauaaucaauguuccugaggaggaagaccucacauuucaauacaauauugaauauaaauggucuaaaugcuccauuuaaaagaagaaccacagaauggauaagaacucaccaaccaacucucuguugccuucagaagacucaccuaacacauaaggauucacauaaacuuaaaguaaagggguggaaaaaggcauuucaugcaauggacaccaaaagcgagcagggguaguuauucuuauauuagacaaaacaaacuuuaaagcaauagcaguuagaagagacaaagagggacauuaaugguaaaaagaccuuguucaacaggaagcuaucacaauccuaaacauauaugcaccuaacacuggagcuccaaaauuuauaaaacaauuacuauuagaccuaagaaaugagauaaacagcaacacaauagcaguggaggacuucaauacucugcuaacagcacuagacaggucaucaagacagaaagucaauaaagaaacaaaggauuuaaacuauaccuuggaacaaauggacuuaacagauauauacagaacauuucauccaacaacugcauucuauucaacagagcauggaacuuucuccaagauagaccaugugauaggccacaaaaugagccucaauagauuuagaaaauugaaauuauaucaagcacucugucaggccauaguggaauaaaacuggaauucaacuccaaaaggaaccuucaaaaccaugcaaauacauggaaauuaaguaaucugcuccugaaugagcacugggucaaaaacaaaaucaagauggaaauuuaaaaauucuuugaacugaaugacaauaaugacacagccuaucaaaaccccugggauacagagucgaaaggccucuucaaggaaaacuacaaaacacugcugaaagaagucauagaugacacaaacaaauggaaacacaucccaugcucauggauggguagaauuaauauugugaaaaugaccauacugccaaaagcaaucuacaaauucaaugcaauccccaucaaaauaccaccaucguucuucacagaguuggaaaaaacaauucuaaaauucauguggaaccaaaacagagcccacauagccaaaccaggacuaagcaaaaagaacaaauccagaggcaucacacuaccugauuucaaacuauacuauaaagccauagucaccaaaacagcaugguacugguauaaaaauaggcacacagaccaauggaacagaauagagaacccagaaauaaacccaaauacuuacagccaacugaucuucaacaaagcaaacaaaaucauaaacugggggaaaggacaucauuuucaauaaaugguguugggauaauuggcuagccacauguaggaaaaugaaacuggauccucaucucucaccuuaaacaaaaaucaacuaaagauggauuaaggacuuaaaccuaagaccugaaacuauaaauauuguagaagauaacauuggaaaaaccuuucuagacauuggcuuaggcaaggauuucaugaccaagaacccaaaaacaaaugcaauaaaaacaaagauaaauagcuaggaccuaauuaaacuaaagaacuuuugcaugguaaaaggaacagucagcacaguaaacagacaaccacagagugggagaaaauguucacaaucuauacaucugacaaaggacuaauauccagaauauacaacaagcucaaaugaguaagaaaaaaaaucccaucaaaaaguggcccaaggacaugaacagacagcucucaaaagaagauauauaaauggccaacaaacauaugaaagaaugcucaacaucaccaaugaucagggaaaugcaaaucaaaaccacaaugcgauaccaccucacuucugcaagaauggccauuaucaaaaaauaaaaaaaaaaccaguagacguuggcaugggugcagugaacagggaacccuucugcauugcuggugggaauguaaacuagccacaguggaaaacaguauaaacagccacuauggaaaacaguguagagaguccuuaaagaacuaaaaguagggucgggcgugguggcuuacaucuguaaucccagcacuuugggaggccaaggcagguggaucaccuguggucaggaguucaagacaagccuggccaacauggugaaaccccauuucuacuaaaaaguaaaacuagccuggcgugguggugagugccugaaucccagcuucucgggaggcugaggcaggagaauuacuugaacccaggagccggagguugcagugagcagagaucaugccauugcacucuagccugggugacgagagaaacuccguuucaaaaaaaaaaaaaaaaaaaagaacaaaaaguagaacuaugauuugauccagcaaucccacuacuggguaucuacccagaagaaaagaagucauuacaucauuacaccaaaaagauacuugcauaugcauguuuacagcagcacaauuuacaauugcaaaauccuggaaccaacccaaaugccuaucaaucaacaaguggaugaagagauugugguauauauauaguggcauauauauauauaugauggaauacuacgcagaccuaaaaagaaaugaauuaucaguguuugcagugaccuggauaagacuggagacuauuauucuaagugaaggaacucaggaacggaaaaccaaacaucauauguucucacugauaugugggagcuaagcuaugaggaugcaaaggcauaagaaugauacaguggacuuuggggacuuggggggaagagugggagggggcaagggauaaaagacuacaaauauggugcaguguauacugcucgggugauggaugcaccaaaaucucacaaaucaccacuaaagaauuuacucauguaaccaaauaccaccuguaccccaauaacuuauggaaaaaaaauuguuaaaaaauuguuaaaaaaaaaauuugaggccaggcauggugguucacaccuguaauucuauuacauugggaggccgagguggguggauacuuccaccaauugcaucuuucuuuuuuuuuuuuuuuugagauggggucucacucugucacccaggucaagaguuugagaccagccuggcuaagacgguaaaacccugucucuacuaaaaauacaaaaauuagccggacaugguggcaggcgcugguaaucccagcuccuugggaggcugagguagagaauugcuugaacccgggagguggagguuguggugagucgagaucacgccacugcacuccagccugggugacagagcgagacuccaucucaaaaaaagagaaaagaaaaaaaauuaggccaggcucaguggcucaugccuguaauccuagcacuuugggaggcugagacaggaggaucacuugagcccagggguucgagaccagcuugagcaacacugugagacccugucucuacaaaaaaauuuuuuaaaauuagccaggcaugguggugugcaccuguaguccuagauacucgggaagcugaggugggagggucauuugaaucugggaggucaaggcugcagugaaccaugaucacgccacugcacuccacccugggcaacagagugagaucucaucucaaaaauuaaaaaauuagaaaaacuuagaaccauagggaaugggaguacagaugugacaacauuguccaugaguucaugaaguaugugagaguuuauacucuucucuguuauuuuuguauauguuucaaauucucuauaaugaaaaauuucuuuuuuuccuaaugaaacuccuggucuaggagggaagauaaaaugugaacaugaauaacuucuacaugacagaaagagauaaacuaagagaagugcagaggaaauuucaagaauuacuaugcuuccacagaugaacccaaaugcaaagcuuagagcagugauaacauacucuuuagccagucuucagcauuauuuguacugaauauucaaaaaugauuuugugaugacuuuauaucaguguaaaguucucuucauagguaacccucuaagggaaaaauagaaaaguaaguccugcaaacaggagauagucuucuugggaaacuucaguucugagcaagaggaugcuaggauagcagagacuggacaagaguguucuccuagaaaugacaucauaggcugccagaacaaauugccugugagaauagcaugugcuuaaucaggagauagaugcagagaacacccauagguguagguuagaaucaugcuaaagagcaacaggcuggacacggacaguucaaauccgugcgaaacacaacacaaagacgauagcacagcgacaacagcaaaaucuccacuucauuuuggccaugacuuuucaccucuuuucuccaccaaaaaccuuauuucuuuaaauuuuccaugugcaacucauugauugagcacccaaguaucaggcaccauguugaacacugaggcgguaaagggagaguguaguucugccuccccaaagagcucacaacguggccagguggaggcacaugcacaacugagaggcuaaaauguggcuacugaaucauauggccaggauggaaaaagaaaaaucuuuaggaauaaaaagcaaggcaccuuucauucuguuugagaugccugugaggcagguucacuguacucugguuaccaauuccaggggagauccuacuacauggaggauagcaaagaucaucacuaugccaaccaaccaccaggaagaggaguccagauacuucugccaauugcaucuuuuuuuuuuuuuuuuuuuuugagauggggucucacuguguugcccaggcuggagugcaguggugcgaucuuggcucacuguaaccuccaccucccagguucaagugauuauccugccucagccuccagaguagcugggacuacaggcgcacgccaccaugccuggcuaauuuuuguauuuuuaguagagacggaguuuugccauguuggccaggcuggucucaaacuccugaccucaagugauccacccacaucggccucccaaaaugcgccuauugcaucuugggcugcaauuucuaccacuugcaggaguugagggagacagaacacucacagaacaaguuaggcaaagcaacuuuauucaucacagauaggcagcaaggcacaacagaagccuagcauccauugcgagcugauucugcaaggcucaggaagcuacucagaauggauggagucuugucugcacaugccccacaaugcacuguagcugaggcacucugaaagcacuccacucuggguuuuauacccuggggggaaacugggaucacuggaccacagcauuggaggacaucuuguccuaagaggaacagaaacagaaucuggcauauucuggacagcuuuuccuuaucucagaauguuguuuccagcacauucuagcauuauucugagaacuacaagugaaaaaugggggaagagcuggguuaucaaggccauccaggcacuuauccugcaaugcccaggaaagucaccccagaggagguuacauuugaguuggccucaaagcacggcuagaauuucuaguccuuaucuggaggaaauagagugaggaaaaacauacagcugaguaugccaaaaacacaaguuguccagugaauguguguaaacucaggcugaaauuuagcagggaugaugagaaaggagauauggauuaggccugauuaggaaugcccugaugugccauucuagggaaucuggagugggcccgggcuugaaaaccagcagugaugaaugguagaauucuguuuggccagaucagauuugaaaauaauuuugaauaccuuuggauaggaaauucagcuccaaugacucauagaccugugguguaaggccugaaauuaagauucaaaacuaagugcugccuugaccauggaggcugguaaaaucaggguacagaggcucaaauggauuaacugcaaguucuccucccacucugcuccugguggauaaaguccucuagccaagcaacccuccuuaucaaagggaccaggcgcagugcuaggcuucagguccccgucagccuguagaauuauccaagcaaaccaaacacauccucuuacaggaaccaggggcaccucgcccucuuguuacuacaaagccugccucccacagcuuccuggugguucacucuguucccagcugcaacccccacguggcucucuguggggcagugucguccuucccugggccaugagcauaugugacuaauuaccugcugcccaucucaucugucuaggcuuggauguuguacauucaaccauccucucaacucuagggcggaaucccucccucaccaguggggugaaguggaggcaaacuaaaucaaacuaaauaagaccccaucauaccauguuguauugcacucugcuucuuuuuuuuuuuuuuuuuuuuuuuuuuuuuugagacagggucucacuuuguuacccaggcuggagugcaguggcacaaucuuggcucauuccaaccuccaccuccuggguccaagcgauucuugugccucagccucccgaguagcuggaacuacaggugcuugccaccacaccuggcuaauuuuuguggguuuuuuuuuuuuuuuuuuguauuuuuaguagagacgggguuucgccauguuggccaggcuggucuugaacuccugaccucaagugaucugcccaccuuggccucccaaugugcugggauuacaggcgugagccaccacaccuggccucauccugcuucuuuacacacuuacauuuccugcauaacugaaaaaacuugaccuuguaacaccucuuuucaggggaaugacauauaaaauuauucauaaugacagacuaugaaauauuuuaccaauauuuuccuuuaagaaagauuagggaaguaguguuuaggauagauucuacauggaacaaauuagaaguagaaagaccagucaagaaguaucugaacagaaugauagccgaguggugugcaguggauacugugauaugcugcccagaaaggacagugaaggacaucaggccccagcugcuagaagugcugcugcagucagccuguagcucuuagcccucucagaaagugacugagcugcagagagcugccucacccaaggacaugcccuaucuuuguccuuuugggcugcuauccuaccagagacuaaguaguucaaaaacaacagaaauguauuucucacaauucuagaggcugggaaggccaaagucaaggcaccagcaaauuugaugccuggugaggguuggcuuccuaacugauagagaaugucuucuuacuguauccucaugugguggaagggauaagggagggaccucucuggggugucuucuauaagggcacuaaucccaucccgagggcuccauccuugugaccuaaucaccucccaaaggccccacaucccaauaccaucaccuuggggguuagcauuuuaacauacgaguuuuggagggacacaaauauucagaccauagcacacucaugccuggggaagcucauaucgagugaccaauggaugguggagcauaagggcuuggccagcucagccaugcuuggcauguuucuaaaaguccaccuaacuccagagcucuuggugagguuugcugagacugucagccuuggguuguagcucaacgucacugcucugcccacuccugcuucuguccccuaccuuccacagguguggucccucccacaggcacgccuucaugaaaugccucuuuagagucugguuucuggggauacaaccugugaugcuuaaaaaauuaagaggccgggcacagugggucaugccuauaauccuagcacuuugggaggccaaagcaggaggauugcuugagcucaguaguugaagaccagccugggcaacauagugagaccaugucucuacaaaaaauuuuaauaaaaaagaaagaaaaaaaauuagagaugagaaaugaggggaggagagggaaauugagaaauaagcuuagauaauuuucacccuaaggguaaaucucccaaauaauguuuccccaucuucucagagagcccacagucugaacgaggagaaagcuguucaaugaaaaaucaauaaguagucaggugaauccuccaggaaucugcacagaguggcagugccacaccuuuuacauaaaccaaccuccucacucuccccuccucagcagcucccaggccugaggacgggcagcgucacuuucucccaagaacgauggagaaucauuucucaccaguaagaauguuggccucacauuaaauucgugauguuuaaugggcuuauuuauguauuuauuuauuuuugaaauggaguuucgcucuuguugcccaggcuggaguacaguggcacgaucuuggcucauugcaaccucugccuccuggguucaagagauucuccugucuuagccuccggaguagcugggauuacaggcacacgccaccaugccaagcuaauuuuuuguauuuuuaguagagauggggguuucaccauguuggccaggguggucucaaacuccugaccucaggugauccacccaccucagccucccaaagugcugggauuacaggcgugagccaccgcgcccagccaguuuauucauuuauacuucaaucaggauuaaguacaucaugagaauaaaacaauccagaugguucugagacugaaucugagcuccuggguaacacagcaggguggaucuggacuagacuuccugcccuggaucagcaagauuggucucauaggugugcacugaaggcagcccgagaaggugugauuugaugggcaccuagaagacccaucuauccccaaaagacaugacucagugaggcucuagacccuuucugccacagcagcuucaugugggcuuuguagaucagcacagcucuuagacccagcugugcacggcgccugacuugggccauauauauuagagaaggggucaacaaacuacagacuuugggccaaaucuaaccuccccauccagaccuguuucuguauagccuauguaaaaaauguuuuuuacauuuuaaaaaucuuuuguaaauuuuuaaauuuguaauuguuguggguacauaguagguguauauauuuaugggguacaugggacguuuugauacaggcaugcgaugugaaauaagcacaucauguaacaugggguauccauccccucaagcauuuauccuuaguguuacaaacaauccaauuauacucuuuuauuuuuacauguacaauuaaguuacguuaugauugaguuuuuacuuuuuugagucagagucucacucugucgcccaggcuggaguguaguggugcgaucuuugcucauugcaaccuccgccuccuggguucaagugauccuccugccucagccucccaaguuacugggauuacagacaugcaccaccacacccagcuaauuuuguauuuuuaguagagaugggguuuugccauguugcucaggcuggucuccaacuccugaucucaggugauccacucacuucggcuucccaaaaugcugggauuacaggcgugagcuacugugccugaucgaguuuuuacauuuuuaaauaauggaaagaacccaaaagaagaauauuuugcaacauaggaagauuaucugaaauucaaauuucaguguucacaaaugaaguuuuccuggaacacagccaugcucauucucuuaaauaucaucuguggcuguucucaugcccaacagcagaguugaauaauugccacagaaaccacauggcccucagagacuaaaaguuuacuaccugguacugaccccugcuuuacagcuuugcugcuucauucuguggucugaagaccagccucaccagcuuuaccugggaggcuguuagaaacgcagaaucuuggucccugcccuagaccuacugauucagaucccaggaaauuucuauucccaugaauguuggagaaaugucagcuuagaggguucugccccggccauccucugcugcccuuccccucagugcaggcaagguccgcacugagucacagauuuaacauuauaguuagucauaaauguuuuaaaauuaugagucugcaaggucaagggcaugcguccuccuggaaacucuuccccaucuaggccaugcucugagugccugggaauuuucugccuccagggucaaugccagcuuccucucugggguccauucuagcccaauagguggucaagaugcagcuguuacaggguggacggagagugccugugcuugaauuuauggaugguguguccucuugcucaagaagcaaguuccucauggcauaaagugggaagacaaaggggaaggauggcagcuggggguuagcucuugcugucccauuaccuucuggcuugggcuauagagcccaggaauucuagccugccauguaguuauguauauauauuugacaguuuauucacuugauagauaacuucuaaguauuucaacauagcuuaugggccuucauugguacucuugaaugugaauagcgugucuauugaauauuucucaacguguguucugaggaccccaugcagcagaauucacguggguuguuugcuuaaaaugcaaauuccugggucccguuuuugauuauccugaaucagaauuuuugaggguggagccaagggaucugcauucuaacaaguuucccagugguucugguucacaccagaguuuuaggaacucuugaaacugggguaggguggacaggagcuggcucccagugggcaggagcuucaggggagaagaaaaggaaccagccagcucaggggaccacaauggcugccagcuucagacgcuuccuauuucucucauuaucucucuuccgcaucuggccugagcccagcucugggugugagcuguggagagagguuuucugccaggauugggcaagggcauucuccucuaauacagggccuucagagacugcucuaccgaaggaagugucugagucaaugugaaacuggaaagaagagagauaugguuuggcugugaccccacucaaaucucauuuugaauuauagcuccuacaauucccaugugucgugggagggacccggugggagguaauugaaucaugggggcgggucauucccaugcuguuuuugugaucgugagucucacaagaucugaugguucuauaagaaggagcucccccgcacaaguuuucucuucccugccaccauguaggaugugacguuccuccuucaccuuccaccaugauugugaggccucccuagccauguggaacugugaguccauuaaaccuccuuccuuuauaaauuccccagucuuggguaugucuuuauuagcagugugaagauggacuaauacaaagaggaacuaggggagcuuggaggaaccagagacucaaucagggauucaagugaagucucuguugcaaacccuugagcaggugagaaccccuggacucuugcaggggaugugggaggagcuguacauacagacagugcuguccagccaauguggguucaaacccugcaucugucacuggcuaugugaccuugaucaaguuccuuaaggucuccagguuuguuuucuuaucuguaagaugagaauccucuucugcaaaccaugucuguuuaaaauaugugcuuauuuugaaagugauguagcaacauuuucucuaguuaauguucuuucucccucauaauuuuaaaacauuuauucaugacuauaauguuaagucugugacuuuauuuuugcuaaauguccaucucagagaagaauaugacuuuauauagcgaaguauuuuuuaaaaaauagccuuaguaaugcauauuugcaauaaaaauauuugacaauccuaauaccuucaggcuugucauuggaaugaaaugugauaauuaaguaaaacccauucuugcuacaaagauuuaagugguggccacuuuuuuuccccccgagauggagucuugcucugucacccagacuggagugcaguggugugaucucaggucacugcaaccucugccucccagguucaagcaauuuucccugccucagccucccaaguaguugggauuacaggcacccgccaccacacccggcuaauuuuuauauuuuuaguagagauacgguuucaccauguugaccaggcuguucuugaacuccugaccucgugaucugccugccucggccucccaaagugcugggauuacaggcaugagccacugcacccggccgguggccacuauuuauuaggaagcuuguuaucuucuaccacugcaccugcugaugauugcucucacaggcacuuaaccacuggcuaauaaaaugaaaguuccuuaaaccuuacgcacaggaagccacuuaggcugcaguugcagcccugugccagggcagugcuuggccagugaccuauaacucccugaggcuccuugugagggagcaacuccugaagucacauggcgaagaugcucacaggacaugauucuuaggaugaucccaccugucgagaccacaggcuguaacucacugucacaaguuagugaugaacgcggaaccuuaaugaaaccgccagcgacagcugugccauacugcaagucaccacuagggggaagcagaauacaagcauccggguaagaaccaacgaagcgcugaggaacguggcccaggaagccaaauggggaugggaggggagaaggauccuaggcgcacccucccuguucaccccacccaccgggcagaccugcacacuccuggucuugcucucaaaccaucugauuccucuguuucucuguucucugguccugguacagcacauuauaucuuccguauggcaaaggccagugguucucuaacauggcuguauguuuaaaucaccuggggaguucuguaaacgcucuacauccuggccuuaucucaauuaaaucugaaucuccaguguuuggaagcagggaucagugcuuuuuauauuuauuuauuuacuugcuuauuuauuuuugagacagagucucacucuguuguccaggcuggagugcaguggugcgaucuuggcucacugcaaccucagcucccugggcucaagcgauucucaugccucagccucccaaguagcugggacuacaggcaugcaccaccauguccagcuauuuuuuuuuucuauuuuaguugauaugguguuuugccauguuggccaggcuggucuugaacuucugacucaagugaucugccagccucagccucccaaagugcuggaauuauaggcaugagccacugugccuggccuccagagcuuuuuaaaacacaacaggugauuccaauuugcagccaauuuugagaaccacuguuuuaggcaaaagaucucauuucuuuucacaugaaagcuggcuuucauuguuagaggacuccuccaagaagccucccuaacgaaccacacguuuuccuccuccuccuccaucuguccacgggccugucugcagcugaugccaguacuuaucauggcuuaagauacauauggguuaccugaggguguugcagauucagauucguucagucuggggugagggguugagacgcugccucucuaagucccaggugcugcugguccacagaccauccacaguaggguuggcaggacaucaaccuguguuuccgcaugugcaccuuugcaguuguucucuguuuugcauuccuuuucugcuucuguauuaaccauguuucuccuuucuguaaaccugaugcuuuaacaucugccccgcgugcaucugcaggacacaccuugcucugugcaacccaauaauaugucucccucacugucccccucccccuggaaggaguccuccgggugauaugcuuuucaaaugaaaaccaacccagagcucgcaucccaaccaauucccuuaucuggcucucacacuccaggccacuaucccccugcccuaaucacccaggaccagguaucugacaaauaggaacagccuguaugccccagagccugcugaaaugauuuaaacuagccaguccugagcuagcuaacccugccuugcccacucuuuccuguggaaaccauaauaagggcucuggccacguucucuucucccucugccucuugaccagcccucgugcugccccgggugucccugcauggcguggcgugcccacuucucuuagaucugagaguaagaaacucucucuucagugagagucaucaucugaucuauuggccucaccaaagcugaauaaaauuaaaaccuauuagagcaacuccccugcuaggaggagaggcguggcugguucccaacuugucugcaucccgccucuccucccagucuugcuugggucccugcuaugcugcucaugguaugaacacaagacccuguacacacacagaaaagagcacaaucagugacuguugaaugaauaagugaacaaauguagggagaaaaauucugaacuuggagaccuggcucugccacuaacagcugugagagauugugaaggugcccccgagacucagugacuucaucuguccuguuauuucauagugaggccaccugagcaauauguguuaaagccccuuuucauccacaugguagcauccuccuuucucucuccaucuccuacuugucacugguguucaggguuccagccuugcccuucacacacugccugggaggucccaucuguuucugagucuuugaaucuucacccacagcugcuauggucugaauaucugugucccuccaaaauucacacguugaaauccaaaugcccaaggugauggcguugggagguggggccuucgggaggugauuagaucuugaggguggagcccccauuaaugggauuagugcccuuauacagaaggcuccggagagcugccucacuucugccaccacgugaggacacagagagaagacucaccugugaaucagaaagcagcccucaccggacaccaaauccaucagcaccuugaccuuggacuuacuucccacccuccagaaccgugggaaauacauuucuguugucuaugaguuacccgaucuaaggcauuuuguuauagcagccugaacagacuaagacaccagcucaggcuccccucuugagcuccacacacgucuaaccaaaugccgacaauccaucucuauccugucaaccugccuguaagucauauuugacacauucaaaaucgaguuuaucaugccuuugcgccucccaaaccagcuccuccccucauauguccuaucaccacaagugcccagaaggggaguggcacacggaaggaagcaaucugggcgauggggguggaauuagauggcagagauuugugacaagcauagaagaccacccagcacgcucaggggcagcaucaaucauaagucacaucacagcagagccauggugcucaucacagcagagccauggugcucaagucccgacagggagagagggugagggagagagagagagagagggaaagagggagagagagggacagagagagacagagagagagagagagaugcagggacccucgacccaugcaggugggcuugggaucaugagagcacaugaggauagaccccaggcuggcuucacugagacgccacccagagaaaggcagcuggaggaugaggugggaauggagcccuugccaccuuccuggagcuccaagccagucacccucaccaggggcccagaggccauuggggcaaacagcacugaaacucuuucaaacccugcuggccacuucccucccuuggggagcagcagagaagcccacugguggccagugcucagucagcacagcugaggugggcuggcaaaacuccuggcucucucugucuccgagaauuggcuggggcaucugauggugguugcagagccucaucuccccucucuugaacuuagcggagaucaggcucagcagaucugcccagguccccaggaggccgggcugguuacagucucuggggaccaggugcuccccuuuugaaccaagguuauuucucccaaccagggagcuuccauaaucacagggauguccccugaccccaucccuacaaauauguagagugcaagggagcaggcagcagggggcaggggugggcucuuaaucccuggcagggagcugcugccgucugauccucugauccgaguugugggacagcacugggugugugcuccuacuuccuggcuuauagguuuccuccucuguguggcaccagcauguguguccuugacuccuuagcagagaggagccaauucacucugucugugaagccaaaacacaagagaccugcaaguuuugaacccuccucuccaccaagaugugagacguauacuggcagaucccugagaucccauuaggcucaggcccuccacccaccgccucuucugggcucaagccucccucuggcaccugcagcacagaacagccuccuccagccuggcuccacgccugccccacccccaucuuccuccacccuacccccuggaaugagcuucccaaaaggcagaucuuaccaggucucucuccuccuuggagcacuuaucaaucucuacuugccuuuuccauucucuucuccccauccguuucuacauauggguuuccuccccaguuucacugagacagggccauugcccuugcaggccucccugcuguuucugaauacacagcuucuucuuggauuuguucucuuacucucuucccugcuagaagccguggcuaaccuguucuuaucuucccugacugaggugggccuauuucuccgcucugugcucauagcagccuccucuaaccuccauuugagacuuuguuuuauugcagggguccccaaccccugggccaugggcugguaccagucuguggccuguuaggaacuaggccguacagcaggaggugaguggcaggcaggugagugaagcuucaucuguaucugcagcugcuccccauggcucacaucaccaccugagcuccgccuccugucagaucagcugggcauuagauucucauaggagcacgaacccuauugcaaacugcacauacgagggaucuggguucccuccuccuuaucagaaucuaaugccugaugaucugucacucuugaugaucugucacugucucccaucacccccagaugggaccgucuaguuucaguaaaacaagcucagggcucccacugauucuacguuauggugaguuguauaauuauuucauuauauauugcaauguaaucauaauacaaauaaccugcacaauaaauauaaugcauuugaaucauccugaaacuacccugcgacccccguccguggaaaaacugucuuccacgaaaccggucccuggugccaaaaagguuggggaccgcuguucuauugcauuacauucuaauacuuuauuuuuuauuucuguuuccuucacugugggcgagccccuucagggcagggguuuguucccuccgaagcuuaacagccuggcggcagagcuggccuuugaagguuuucugugaaaugaguucaccggugauucuccagauguggucccugaaccagcagcauagcagggcccaggaaccugugagaaaugcaauucucagucccgcccugaccugccgagucagagcucuggggacggcacccgguccucagcccucgguucccguagcccuucugggugauucucaugcaugcucucauuagaggucagcugaauaaggcacgugagagccuaaugaaauaugaugugaaugggauuugcuauuacuacucagccuagacugaaggauccugggguggugagcggccgagggcggagcuguucccuggccccccauccucaucacuuggcaugcaggcugccugaggcacccgaggcgcaucucuuccucagcccuuguuagaccauguuauuucuuuuuuaauuuuaauuuuuaguucugggguacaugugcaggauguguagguuuguuacacagguaaaugugugccauggugguuuguugcaucuauuaacccaucaccuaggucuuaagcucagcaugcauuagcuauuuuuccuagugcucucaauuguguuguuaguaauacacacggaaguucuagggaggaacccaaugcccaaagagagacccuugauucucucucucucuccuuuuuuuuuuuuuuuuuuuugagauagguuuucacucugucacccagcuugaagugcugugguacgaucguagcucacugcagccucaaacuccugggcuuaaacaauccuucuaccucagccuguugaguagcugggaccacaggugcaugccaccacacccaacuaauuuuuaaauuauuuguacugacaagucucccuguguugcccaggcugcucuugaccuccugggcucaaacaaucauccugccucagccucccaaagugcggggauuacaggugugagccacugcaccaggacagagagcaccugauucuaggagccaugguugggacauccaaguggaacucuguggucauagaaccggguuucucaucccacacucucaaauuaaaaacauuuugcuacgggaaucagcucccuuuugccuuagaguuucuguuuuaccuguagugacaaguaucccacucuauuuuuuuuuuuuuuuuugagacggagucucgcucuguugcccaggcuggagugcaguggugugaucuuggcucacugcaaccucugccuccuggguuuaagcaauucuccugccuuagcuucccaaguaccugggauuacaggcacacacuaccacacccggcuaauuuuguauuuuaaguagagccauguuggacacacuggucucaaacuccugaccucaagugaucuacccaccucggccucccaaagugcuggaauuacagaugugagccacugugucuggccuaucgcacuauauuuuaaaauuuggucuaaaggaguugaugaugaguuucuuuuagccuuuuauuuuuugucuguugguuuuugaauguauuuguuaucaguaucuggaguuugaaaaagaaagaaccucauuuuaugagcucuguagugggagggcugcuugcuaucacuggauuuucucccauggccuaguacuaccauaucugcuucuagagugugcucagcaaauagugguuuuugauuacucaaagcaaaacugagaagccauuuaacaggcugggaaauaauuucuucagcacugaagaauauauccauaggcugggcacaguggcugacaccuguagucccaacacuuugagaggcugaggcuggaggaucgcuugacugcaggaguucgagaccagccugggcaauaaagcagacucuaucucuaccaaaaaaaaaaaaaaaaaaaaaaauagcugagugugguggcaugcgccuuguagucccagcuacuugggaggcugaggcgggaagacugaggcugcagugagccaugaugauugagccccagaggcugaggcugcagugagcugugauggcgccccugcacuccaggcuggugacaagagugagacucugucucuguuuaaaagagaaaaaaaagguuaggugcaguggcucaugccuguaaucccaacacuuugggaggccaaugaggguggaucaccugaugucaggaguucgaggccagccuggccaacauggugaaacccugucuuuacuaaaaauacaaaauuagccaggugugguggugagcgacuguaaucccagcuauuuaggaggcugaggcaggagaaucacuugaacccuggagguggagguugcagugagcgaagaucacaccacugcccuccagccugggcgacagagcaagacuccaucucaaaaaaaaaaaaaaaaauauauauauauauguguguguguguguguguguguauauguguguguguauauauacauguguguguauguuauauauauacacacacacacacauauauauccauaagucagagcugaaguucuggugagcacuucuuggaguucugugacaagccccuccacugguggucuaacuccugccuuccucgcuugagucaucucgagacagucacuccaacaugccuuacucuuucaguuccuugaauucccugaacucccguuguucuggaccuuuggaucugucuuuccccugccuggaaauucuccuccccuuuuccuucaggucacagugaaaucauuuggcucagaguggcuucuaauccucugugaggcuaggacuuuacccuuuuccgugcucaugcucucgggcuuuccuguaaccucuccuuucucgucuccuuucccccucuagccuggaagagcaggaacugugucuccuucacuuuccccagcaccuaucucagagccgggcccgcaguaggggcucaugcauuuguuggcuggcguuaacgugaaccagcacgucggcuguggaugaauaacuuuccaggucccaaaauuguccacuugcuucucuuucaccguugggcugagaacguagcuacuaauaaacccggagugggaggggguaucaguaacagagacaagugugugauugaaauggaagacagcuggagagaagagaacagaaauaggcaggacgugcacggccagcaggaaguugcugugauucccgcaaagcaugucuuuucauucgugaagaggggucccuaagaugagaguuccauggagacuuucccuaagggcucacuaugccuuauucucugauauguugagccuucggggguuggcuguaaauagagacugaacuuugacuuagaagaaaaaggggagagaagaacauguuguaucucuuuguguaaaugguuacuacucgcuccccaaacaagcuacuuuaauaggggcaucacacaaauuauagaauacaggucucucauccagccagccaugauggugcgcaccuaugguuccagcugcuuggaaggcugaggugggagguccuuugagcccaggaguucaagguucaaguccagccuaguuaacauagcaagacucucuaaaacaaaacaacaaaacaaaaacaaucuaaucuuaggauuagaaaggacaaggacaccagaugucaucaagucccauccuuugaccucuguaggaauucccugugcauauuucugguaagaauucacuaauccacuaguugucaguucuccacuucacuaacuuauggggcagccuaguuccauauuugcaggguucuaguuguugaaaaaguccauguagcccaguacauuguauguaguggugguuuauugaaugagauacaugaacacagacaacauuuauaaucgagacuuuagaaauuauuuucaaguacuguuguauuguuuuaaaaauagaauacggugagaagauugucuuaaauguuugacauagugucuccagcuuucagaucauaccagauacauauucaauuuaucaccugggcaaguaaaaaauuaaaaagacaauaaagccugucuuguuauauacuuagagccaauuacucaauauuuaccaaauagcccaccaaaugucucauaagcauuuuuugaguguguucagucuugagauugaacuuucagaacgggccucccuugcucauccugggcucaugaugauccgcuucagcauuuacacaaggagagcaagggaacagcacagaucaauggaaaggagacagcagauuauuuuccaguucuaucccugcuacuaacuaguggugagaucuuagguaaguugcuagacacugcuggaucuuaguuuccuccucuguagacuacggugauuaaaccagguggccuucaagguucaguaccacuguaacccucuguggcucuaaaacuuuacauuuuccuccuaaagacaaaagcuucaugagugaauuuaacucucaucccauugaauaacugaucaguagcaacaaugugcuccuacuaaauauagaaggugaaguuaaauauggaauauagcuguccacauccccugaauucgcagaaacuuagguuaauaguuggcuacaucacucagaucauaaucucuccauggcacaucauuucugccuucauaguuggcuaaaauaccuggaugucagcugaaucuagacuuuuuuaaugauucuauuuuuaaacuacagucaugagaccacauaauccuagugggguaaaugccagaggaagaaaaaaaaaaaaaagaaacagaaaacaaaaccaaaaaacuguaaagaaaucugaagugguuuuccauaauucucuuuuuagaauaauuuuuucucugauaugauauuuucugauaguaagguaugauuauuaugaaaucauaauguauuuaguagaaaaauaaauuacauuauuucauuaggagcuaagguuuucagugcaagaaaaauauaaauaucaaaucaaagaaguuaaauaaaaaccuucuauccuaaguuugaauuggaaauauuaauaagaacacaugauguguuuuaugguaaaauacacuauucuuagcucugucuguugaaaaggccuagauaccuugacuaagaguagcuaaguguguccuuagcacccaggccguuuucuuucuucauuuuuuuuuuugagacagggucucacucugucacccaggguggagugcaguggcgugaucuuggcucacugaaaccuccaccucugggguucaaaugauccucccaccucaaccucccaaguagcugggauuacaaguguaugccaccauaccuggcuaauuuuuguauuuuuaguagagaugggguuucaccauguuagccaggcuggccucaaacucgugaccucaagcaaucugcccaccucagccucccaaaguguugggauuaaaggcaugagccacauaucuggccuggccuaaugcacucuaaauaccauuucugguuaaagugaacaggguucuuuggagaaauggucgauucaacaucagggauaaguuuggaacaucuugucauaucagccagcaaagaaacugucaaagacgguaaaagcaugccaaaaagacuuaggaaccagagccuauuggccagagguaagacaauuaccaaaacaaacaaacaaacaaacaaacaaacaaaaacaggaagaauccagaaucuaaucaggaccuaacuacuaacuacaaacuuauaggaaauacacucuaggauaguaaauuuugugugucaacuugacugggccauggugugcccagauauuuggucagacauuauucuggauguuucugugagggcguuuuuagaugagauuaauauuuaaauugguagacuaaguaaagcagauuccucccuuuuuggaucauuguagaccucauccuacaguugaaggccugaauagaacaaaaagguugacccacccuaacuaagagagaauucuucccaucugacagccuuccagagggagcaucaacguuuuuccugucuuugaaccagaacugaaacaucagcucuuccugaguuuugagccugcuggccuguggacugaaccacaccaucagcucugcuguuucucaguuuuucagauuacacucucuuggggcuccaggugguuggcugcagaucuugggaccuguuugccuccauaauuaugugacccaauucuuuguaauaaauccuucuuucucucucuuucuucuauugauucuguuucucuggagaaacuuggcuaagccacaccuccacagggauaaaaucaacaaaaagcagaguauaggacauuuuauaggccaacagaaaguauuacucaucaacaaauaaauugccccccccaaaaaaaacaauagagggagggguaauuuauagauuaaaagauauuuaaaaggcauauucaccaaaugcaauggaagagccuuaguuuggauuccuauuugaacaaaccaaguuuuaaaaaaaguaugagacuaucagggauauuuggaacauuuccuggauacuugaugauguuauggaaauauuguugauuuuuuuuggaugcaaugacauuuacagggcuaugcuuuuaaaaguccuuaaauuuuagagauauauacuggaauauuuaugaauaaaauaauuucaguaucuggaaucugcuucaaaauaauucaucaagaguaggaguauggguuaaaaguagaggggguggcugggcgcgguggcucacaccuguaaucccagcacuuugggaggcugaggugggcagaucaugaagucaggagaucaaaaccauccuggcuaacauggugaaaccccaucucugcuaaaaauacaaaaaaaaaaaacgggcaugguggcaggcgccuguaguccuagcuacucgggaggcugaggcaggagaauggcaugaaccaaggagauggagcuugcagugagccgagaucaugccacugcacuccagccugggagacagagcgagacucugucucaaaaaaaaaaaaaaaaaaguagaggggguauagaggaaacaaaacuggucauguguugauaauuguugaagaauacaagaucagaauaugggggauuauuauacuauuuucucuacuuuuguacauuauuucuauacuaaaauuuuuacaaguaaaugcuuuauuuuuuuugccuaccuugacguuaaacuuauauuuuuaaggcaucaaugacaaguuauuccuuucuugucuauuacagauauauuuccacuugccuccuaagcuguaugauuuuuuuuucauuugcuuccuaaacuauaugauuucaguucuccuuuaucucaugaggaggguucccauuuacuuugucauauauauuuacauguagugauuuguuaaauuauuauuucaaaauuauuacugaaaugcacauucucugguucaagcuccaauggguucucacugccuuguuauaaagccaggcagccucacuuuaacagucaaagccuaucaucaucaagcucuacccaacacaucagacaagcgcuuccaaaaaauagaagagaggaaacacuucucaauccauuuuaugagaccaauauuaccccaacaccaaaagcagacaacaacaucaaaaaaaagaaagaaaaagaaaacuacagacuaauauccacauuuuagugaauaguaaaauccucaauaaaguaauagcaaaccgaauccagacacauauaaaaagaauuuuacacuugaaaaugguucaaauggcaaauuuuauguuauauauauuuuaccacuauuuuuaauaguaaaguaaauaaauagugguaaaauauauauaacauaaaaauauuuuuaaaauaguaaaauaaauaaauaaacauaaacauacaccaugacuaaaugggauuuaucucagggauuccagguugguuuaauauuagaaaaucaauuaauggaauacauuauauugauagaauaaacagaaaaucacacaaucaucucaguagacacagaaaauacauuugacaaaauccaaguucauuaacucccagauaaacagcaccuauucuagaggaucucuaaacauaaugagaugacaguagcgaagaaagacucugaguaucgaaggugaauggaucucagagauugccacaggaaaagauaucuuuuugaaucuaguggagaaaaucuuuguaaaucuacuuuuaucauaaacaaugccagcaugaaugacuuauccaagaucuaagaggaguguagaaugaaaacucuuaaaugauaggaaguguguguauuucuccuuugccgcuggcaugguuauucaccugccagguggccagugaguauuuuuguagugaauggcuuggaguuuuagggcaaguacucuagacuuaaacuuaacuuuccuggcugugugauuguaagcaaauuacuuaaccuuaaagucucagcauuuugcuuauuguuucaucucuaaaguuaagauaauaauucuacuaccauaagugaggguuuuaaaacacaguaucagcggggcaugguacaccugugauaugguuuggcucuguguccccacccaaaucucaaguugaauuguacugccauaauucccacguguugugggagggacccagugggagauaauugaaucaugggggcgguuuuccccauacuguuuuaaugguugugaauaggucucacaagaucugaugguuuaauaaggggcuucuacuuucgcuucugccucauucucucuuucugccaccaaaaggcaaaagugucuuuugccuucugccaugauugugaggccuccccagucacguagaacugugaguccauuaaauuuauuuucuucccagucucagguaugccuuuaucagcagugugaaaauggacuaauacaaccuguuacccuagcacuuugggaggccaagguaggcggaugacuugaggucaggaguuugagaccagccugggcaacauggugaaacaucaucucuacaaaaaauacaaaaauuagccaugugcugcacaccuguaauuccagcuacuugggaggcugaggcgggaggaucacuugagccugggaggcagagguugcacugagccaagaucacgccacugcacucuagccugggugacagagugaggcccugucucaaaaaaaaaagcaaaaacacaguaucuuugaaaugugcagcacugcagcauggcgucugggacauguacacccuugucaucaugaacaacauccaagaccauaaaaaucacgggucuccagccaucccauuacuggguauacaccaaaggaauaucaaucaugcugcuauaaagacacaugcacauguauguuuauugcggcacuacucacaauagcaaagacuuggaaccaacccaaauguccaacaaucauagacuggauuaagaaaguguggcacauauacaccauggaauacuaugcagcuauaaaaaaugaugaguucauguccuuuuuagggacauggaugaagcuggaaaccaucauucucagcaaacuaucgcaaggacaaaaaaccaaacaccgcauguucucacucauaggugggaauugaacaaugagaacacuuggacaaggaaggggagcaucacacaccggggccuguuguggggugggggaaggcgggagggauagcauuaggagauaaaccuaauguaaaugacgaguuaaugggugcagcacaccagcauggcacauguauacauauguaacaaaccugcacguugugcacauguacccuagaacuuaaaauauaauaaauauauauauauauauuuaaaaaaaaucaugggucugucuugggacuauuaggcuugccaguuguauacauaaauguuagauuagacagcuucauaauaccaaguuaaaaaugacuaauguccuuguguaaugaauaaacuugcuccaauaaccuugaaaaugaaagaaaaguuugaucacagagugaaauuuaauucagacaauuucagcagcuguguauuucagauaaacccauaaauggcacaaagaaaugauagcccuagcugaguuguccaaaaaagaggguuuggacaacucuuuuuguccaaagacaaaaagaggcaaguccuuagccuguguauugggucacugccaagagaugauguuguccauguggaggcagagagugaacuuccuucaguucugacugacugcuguaaauagugucacauggcuaaaccuguguaaguaguuucaaaaccugcuuuaaaguauaguuaaggccaggcucaguggcucaugccuguaauuccagcacuuugggagccugaagugggaguauugcuugauuccaggaguucaagaccagccugagcagcauggcgaaaacccaucucuacaaaaaauacaaaaauuagccagaugugguggcacaugccuguagacccagccacucaaaaggcucaggugggaggaucaccugagcccaggaggcccaggcuacagugagccaugaucaugcuacuuaacuccagucuggguaaaggagggagacucugucucaaaaaaaaaaaaaaaaaaaaggcaaauauauauauauauauauauauauauauauauauauauauuaagcauuugcacuuuugacucaacuauauguauauauacagaaauauauauacauacauauauauguguauagauagauagaugauagauagguagauaguuagauauugauaguuaagagucaaacucaaaugcucuuaugggcaaaacaauggagagaaaaccuuaaggauauuauuauagagagaugugggucccugguuagagggcuugcccugucgacaaggauuuacaugagaaacauuucagaagcaccaacauagcaaacacaaaggcucugaaggccucaguccuuggcaagcagcuuacagccacugauuaggggaacaaggcauaaauuaggcauuacucuuuuguaucccugagcccguagauuguuuuucuucuuccaaucagauaagaaccuugcagaaacuggacuguuaguaguggaauuauagcaucacaguaucuuuugagucguuuauauuuuccccauuucugguugcuuccaguucccuuuauaaauucuuccuuuccuuuuuucuaccuaaaacucagcuguuauuuagaaugagguggaacuuggcuaccauuucuguuuuuugucuucuucuccaaauacuuaaugccucaaacagguuuguguguucuggccuaaaaacuaacuccucugccaagugguccccaggcccugacuccuuuuuccucacuuccagcaucugagagacucccaaccacccuuguaaagggaaccgugugauagggcugugcccacccuagguccugcccacauguuuauucugggccucuuggcuuccuuugauacccaagucuuuguccuuaugaaaguuauuuacuucugaaaaauguuuacagaaugaugacaugaagucaauauugguuuuaauaaauuuaaauaacuuuccuuacaggcagaaugaacaaaauaaguaaaaguggcuauaaagauuauaaucugaaugugauuuagcaauguaguauugaaaggcaauguuuaaaaagguaaaaucauaauucauacaaauacaaaugaccaucguuaacucaugaguuauuuauuauuaauuaugauuaauuaaugcaggacucagugagguauuacagcuggauuuuacaggcuuuacccaacaaaauucuucaauaggguuuaaguacuacugcauguaaaguguuuauuuuuauuuuugagacagggucucacucugccacccaggcuggagugcaauggcacugucauaacucacugcagcuuucaccuccugggcucaagugaucuucccaccucagccuccugaggagcuggaacuacagauggcaccauugugcuuggcuaauuuuuuuuuuuuacuuuuuguagacauggggucuugcuauguugcccagguuggucuugaacuccuagccucaagugaucuuccugcauuggccucccaaaguauuaggauuacaggcaugagccacugugcaugaucaaguguuucauuaagaacaaguucugcuguucugugucucacagaagugcacagguaaagcauuugcacuugugggaucaagugguagcuuugauuuauaaagcagaacugucaucaggaauuugguugaggaagcugaaguuguuuuaucucaaaguuguuuuccuggaauaauucaguucuccaagggaacucugggauucacaaaucaugacgaggucaggaaaacagucaugcuaaugaaaauggggucugguauaggacaggggaaagaccaauaacuucuuucucuaaaguaggaugcuggagacaccaccauagaacaaaaaaagucaaauaacuugaggacaggagugaacaggaaucaaaggcaaaggaaaaagguaaagugacuuuuagcauaaauaaaggccucaagaaguaucuguucuuuccucuccugaaugacuccauuaugagggauagaaaucaaagagcaauagaaugggguggaguagaaguacuagaguguucuagcugagcuccacucaaggucacacuauuauuuaagaacacagaaugcaaggcugggcaugguggcucacaucuguaaucccagcacuuuaggaggcugaggugggaggauugcuuuggaguuugagaccggccugggcaacauagggagacugugucucuaaaaaauaauuuuuucuucuuuugagacagagucucgcugugucacccaggcuggagugcagugagcugaucucggcucacugcaaccuccaccucccugauucaagcaauuccccugccucagccucuggaguagcugggauuacaggugugcaccacccacauccagcuaacuuuuuuguauuuuuaguagagaugggguuucaccauguuggccagacugguuuugaaccccugaccucaggcaauccgccggccucagccucccaaaaugcugagauuacaggugugagccaccgcacccagcuaaaaauuaaaauuuuagcugagugcggugguaugugccuguaaucacagcuacuccagaggagagaggcucaggugggaggauugcuugaacccaggagguugaggcugcagugagccauugauaugguuuggcuguguccucacccaauaucucaucuugaauuguaauccccauaauccucguaaaaucuucacaugucacggcaaagaucagguagagauaauugaaucaugggggugguuuuccccacgcuguucuuguggcauugagugaguuuucaugagaucuaaugguuuuauaaggggcucuuuccuuuuugccaugugaagaagguggcuuuuucgccuucuaccaugauuguaaguuugcugaggccuucccagccacaggaaccaugagucaauuaaacaucuucccuuuauaaauuacccagucucagguauuuccuuauagcaaugugagaauggacuaauacagucaauugguaccacagagaguauguugcugcuauaaagauaccuguaaauguggaagcaacuuuggaacuggguaacaggcagagguuggaagaguuuggaagguucaaaagaagacaggaagauguggaaaaguuugaaaguuucuagagacuuguugaaugacuuugaccaaaauacugauagugauauugacaaugaaguccaggcugagguggucucagauggagaugaggaucuuuuugggaacuggaauaaaggugacucuugcugugcuuuagcaaagagacuggaagcacuuugccccugcccuagagaucuguggaaauuugaacuugagagagaugauuuaggguaucuggcagaagaaauuucuaagaagcaaaguguucaagagguaacuugggugcucuugaaagcauucaguuguaugcauucacaaagagaugauuuggaauuguaacuuauauuuaaaugggaagcagagcauaaaguuuagaaaauuugcagccugacaaugcaauauaaaagaaaaccccauuuucuggggagaaauucaagcaggcuggaaaaauuugcauaaguaaugaggaaccaaauguuagucaccaagacaauggagaagaugucuccagggcaugucagaggucuucauggcugccccuuccaucacaggccuggaggccuaggaggaaaaacugguuucaugggccagauccagggucuugcuacuuuguccagucucaggacuuggugcccugcauccuagccauggcuaaaaugggccaauguacagcgcagaccauuguuucagagggugcaagucccaagccuuggcaguuuacacauuguguugggccuucaggugcacagaaguuaauaauugagguuugagaaccucugccuagauuucagaggauguauggaaaugcccagauguccaggaagaaguuuguggcagggguggagcccucauggagaaccucugguaggguaguguggaagggaaagguggggucagagcccccacacagagucccuacuagggcauagccuaguggagcugugagaagagggccacuguccuccagaccccauaaugguagaucuacugacggcuuacaccaugcaccuggaaaaguugcagacacucaacgccagccugugaaagcagccaggagugggguuguacccugcaaugccacaggaacagagcuguccaaggccaugggagaccaccucuugcaucagugugaccuggauguaggacauggcgucaaaggagauauuuuggagcucuaagauuuaaugacugccccacugaauuuggacuugcauggggucuguagccccuuuguuuuggccaauuucucccauuuguaacagguguauuuacccagugcuguacucccauugcaucucagaaguaacuaacuugcuuuugauuuuacaggcucauagguggaagguacuugacuuguuucagaugagacuuuggauuuggacuuuuggguuaauacuggaaugaguuaagaauuugggggacaauuggaaaggcaugauuauguuuugaaaugugaggacaugagauuugggaggggcuggggcagaaugaugugguuuggcuguguccccacccaaaaucucaucuugaauugugauccccauaauccccauaaucccugugugucaagggagagaccagguggagguaauugaaucaugggagcaguuucccccaugcucuucugguaauagugaguuuucacaagaucugauaguuuuauaagagguucuucccccuucacucaucacuucuccuuccugcugccugugaagaagguggcuugcuuccccuucaccuuccaccaugacuguaaguuuccugaggccuuuccagccaugcagaagcaugaguugauuaaaccucuuuccuuuauaaauuacccagucucaaguauuuccuuauagcaaugugaaaaugaacuaauacagccaugaucaccacugcacuccagccugggucacagagcaacacuuugucucaaaaaacaaaacaacaagaacaacaaaaacacggaggcuauuucucuaccucuugacucuguguuuggccauaugacuugcuuugaccaaugggaugucauagacaugauacaaucagaggucuacacaaccacucauguaauugagcuuguuuugcuguguuuuugccaugaaaaguauaugcucaggcaagccuacuguucuaggagguagacagguagagcagaaccaagucaccccagccaaccucaucuaaggucagccaacccccauuagaccccaggugcauaaguugaguccaguugagaucagcaaaguccagccuagauuagcugaacuucacagguacaagaaaugaauguucauuauuguuguugaccaugaggaucugugguuguugguuacauagcaauuuucugacaauagcuaacucacagguugacuuauuuucaacauacccuaaugagaugacagagauugcugcagauaugcccagugcaguuuuggcuuccuagagggucuucaagagaguacacccuagaaaaagggcagaaaccaucacuauauacccaggcugccucuucuguuuggaagagauucuuauuugaaaaccauucauaugccaggcuaguggcauccccagcgaaacugagggucagaaaauaauaucugauaacugggaagaacuaaggucauuucuaguugcagaguaucugaaacucgaguaggaaacuagagaauggaacaaauagugguagcaacagggaaucccccuacaucaguaugugauucaccaaguacaaggucaaacagauaaccacaacugcucugucaguucccaagacugcacagaacacagagccccagcaccuugcuuugguccucccugaguuucuacacaccuggcuucucaacgaaagaggauccauuugcauacgaaacaaacucugcaauguagaagauggcuguuugaucugaagcagauuuuguaagcuugugcaaugguaagaacauaauuuaacucaacaauuuuuuuuuaguaacuuauuaaugcugaaaacuggaauaaucuccagagauguggauggacuaggaauuggaucugccuccauaugccaggguuaagacauaguccugcuaaagaaacaagcaaaugcauacacaacaacagaggugaccagaagaugggugcaauaaaaugcuucuggaucacaggaacacuugcgggaccgagacgcaacaggaaggcugugggaggaagugcuuuugcagaggaacaugaugaguuugguuuaggaccuaugcuauuuacagccuggcagagacuccaucugucuuacauauuuguacauaucagcuccaucuuuuuccuauuucucauucugcuucaauccugccugcaaauuuaaaucucccuuggagaauagacaaaauaacuugcuuuuuugugaucugucuuuacaaacaaagcaaaaugccuuaugcauaggagaugccuaaugaauguuuucauuuuguuuuuguuucauuuuguuuuguuucguuuugugcagggucucccucuguagcacaagcuggaguguaguggcaugaugacaguucacugcagccuugaauuccuaggcucaagcaauccucccaucucaaccucuuaaguaacugagacuaagcugugcuccaucaugaccagcuaauuuuuuuuuuaauuuuuuguggagacaggcgucuuauuauguugcccaagcuggucuugaacuccuggccuuaagcaauccuccugccucagccucucaaagugcugagauuacaagagugagucaccaugcuaggcugauuuuuguugcaugaaggaauaaauacauauuugaauauucuuggacagggguuucaccucugcuuccuggaguuccuuagagaaaagugggguggaauaggagaguagauaugggaaagggguugggagauuuguggagacaaggaacagacaaggaauagguaagaaagcagcguuggcagaacccagaauuaagauuuuugugaaaguaaagacagggaguaaagaugggagacgauuuacuuggaugugcagauagcaaguguaguuuaauaccuacaagauaugaaauuaaaaguuucaccccaaaugauacacaauuuuauugccucuggcaucacaauaaauaaaagccucuuucagcuuuuuuguaccugccucuggccugaugcagucauuuuuauugcacuggauggcaucuguauuuauuaucaaaccaggggauuucugcuaagucaucuugaagucuaacuuagcuagcacaacaugcuguuucauaauuaaauuaaaauugcaggauguuuuggauuagaagaaucuuccuucagccaggccugagguugguaagggagugugaccuguaugaaauagaauucccucauccaaaacauccggaacauuucacuggauuaauuuguaacucacugggagauuuuuaguucaauuugcuaaagauuuucuguuuccauuucucuuuucaauucaggucaauauacaguuauucaacucucuuauugaaaaugauaugaaaaguguuauugaguccaaagaauaaacaaaaugaaagguaaaaugcaaacaaaggaagaaauguaaugagugaauaaauaaguucuuucaugaauaaagaauuuauucaugaauaaauaaauccauucacccaacaaaugaacuuacagaacccuuauuuuuaccaugcacgaagcuaaguaaguacugugcaguggaggcagaacuauaagccacaguuucuguucucuaggauuuuagaauuuuguuuauuauagaaaauuugccauuagacaguuuaaguccaauuuauauugguguuuuaauucaaucaaaaacuucacaaagaaauaaaccaugaacaauucccuuacaccuuuaagaagacauuaaacacccucugugggaaaagccuaacaaaaucacuuuuuuguacuuugcaccacuggacaggauauguauauauuggcuaaacagaauccuguggccacuggccaauaggcugcaggaagagaauuuuaaaauaguuuuuuuuuuuuuuucuauuagaggcuauagaaaauaauccuugacugggcaugguggcucgccuguaaucccaguggugcgaucauggcucacugcagccucuaaccccugggcuuaagcaguccucccaccucagucuccagaguagcugggauuacaguuguacuccaccacacccagcuaguuuuaaaaugcugaggucucacuacguugcccaggcuggucuccaacuuguggccucaagugauccuccucccuuggccucccaaagugcugggauuguaggcaugagccaccacgcccagccaagauguuguuuugacuggacuugcaggcuugugacucaaacuugauuguaaagggguggaaauaggcaccacaccucccccaaaauauucauuugcauuuaaaaaccagaagcugccuauaaagugggacagcaucuuugcccucaguauauccucagauucaugaauuuucauaggagucaagaaguuuucugaaagggcccaggacccugacaaggaucccacaccccucccuucauccuuccacacucacaccucauccccucuacugccucuccacuaaucuucugugacaaggcuggaguauagaaaaaggacacuuugcuucccgcccugcaauccacaaccccacagcaggguggggagagaggggaggggagccugcaccagugguucugucucagcaucaggcuugcuuuuccuuccuuuccuuccuuccuucccuuccuuccucucucucucucuuucaauuuugagacagucuugcucacccaggcuggagugcaguggggcaaucucacugcaaccuccaccucccagguucaagugauucuucugccucagccucccaaguagcugagauuacaggcaugcacuacuacaccuggcuacuuuuuguauuuuuuagcagagaugggauuucaccacauuggcuaggcuagucuugaacuccugaccucaggugauccacccgccucagccucccaaagugcugggauuacaggugugagccaccuuuccuggccuggccuucuuucaauggcuggggagaagugcagcccuggcccaguggacaccugcacucaaauuauccugacuuggucaaccugguugcggguagaucuucuggcaaacacuuguccgaagauaaauugaaauuguuaccacgcuugggacccuuggaggguaagaaagagagaagguagauucagggcugucagaagccagcauaggggaaugagauugaugagcaauguuggcacuagaucccgaacucccaaccucaggugauccgcccgccuuggccucccagagugcugggauuacagguguaagccaccgugcccagcgaggcacuagaaucucaagugggaagagcucauacacagaaauguuacugggacagccaugccuauggaccuuuccuagaagcaguguuagcauaaaacacguaguuuuuaaucucugugcuugcucuuuuuuuuuuuucuuuuucuuuuugagauggaucucacucugcugcccaggcugaagugcaguggugcaaucuuagcucacugcaaucuccacuuccuggguucaagugagucuccugccugagccucccuaguaacuggguuuacaggcaugugccaccauaacccgcuaaguuuuuguauuuuuaguagagaugggguuucuccauguuggccaggcuggucuggaacuccugacuucaggugauccaccugccucagccucccaaagugcugggauuacaggcuugagccaccagcccagccucugugcuuguuuauuuagagguaaggcuaauggaguuugagacuggugggugagguuguugguggaaugagagcccagcccaguccugcugacaagauaguggguucucccgacagacaagagcagguaggagaagaggagauaauuacaaauauugauagggaagagauguuuagggaggggacuccuggaaaaguuuggaguuucugccuagauuucaugugaauugggacauaaauguaaagauaauagcauuuguucccauagguugguauaguacagacaauaacuuuuacaaaaauaaaacuuaaaaacaaaacaaaacaaaaccaaaaaccauugcaugcugauuaagggaagaaucaaaguuuauaaauaggaaggcaagaccuguacauugaaguuaauaauaaaagguaauuacaaguauuuuaagaaacacaauauuugcaauguuugaguuggggaguguguguaugguuggagucagaggaaguaacagaaaguccugacaggaaaaauaauucagauaggaaauaauuuauuguuagaaaauuauuuccacuucucaucuuaaccauuugagucaaaggaaaauaaaguaagauacaugaaagaacaacuauuuccaaaccaaucacccucagcacguuuuauaaaagagauaacccaaaugguaccaggcuaucucgagaagguuauggcucauaauuuagucugcucucagugaaugguacuuuauguuuaccuugcacuuuuacuaaguugcucauaacauucagaaacuggagcccucauagaaauguccacacgacccagucacuuuucugaauccagcagcugaggagcuggaaaguucuuuuucugcugacuguggucaugcaugacuggauaauuuaugggcaagaccaacaaccacauccauaucucaaauucauuaauaaucgagagagggacucagcccagaaucacucagagggugaguccucagggaaggaaucuguucaaauaaucagagccuuuuuaaaaauaaaaauaauaauaaauuaugauuuuucucagcaguaccuuuccaauacagggagggcuguuucuuacuacccaaagggaacauuuugaagggugccugagauuuuucaugugaauaucuauaugaaaggaccagacaugaucauagaaugaaggaaaacgugagcagcgagaaaauuagggguuaagaaaaugucccaaauuucaaaaggguauguuucggaaauugccauugauaacaauugguagcuuugauaauagcauugauagcuugguagcaaaugauaggaaaauuccagaauagaucauuaaagagaugguguuugaaccuuagagauaaaaggggcuccuguugagaaccagggugagccgcuaagagcaagagauguguauuaaauacuuucucuuuugaaaagugugccaggaugcuuugcaacaucuaucacacugugcuuuggacaagaagguugaaguugggcugauaaccauuccaauagacuugcuaacggcaccaaggaaggugaaccuggaaagucuccaugcccuguggucugcuccuugcucucacucauucaacucaacaaaugguucugcaguaacucaacauacaugaauacagccuggauuuuaugcagggugcucuuccaggcaagggauagaaagaaguuguuggaucccugucuucauaaggcuuauaaugcagugguggcaaagggcaagugcacaaguaaccacaaugcaaggcagaguagcaaagccacaagaaaagaaguaccagcugugcauggaggcuugcaccuguagucccagcuacuagggaggccgaggcaggaggauagcuugagcccaggaguuggaggcugcugugagcuaugacugugccacuguacccuagccugggugacagagcgagaccauaucucuaaaaacaaaacagaaguaccaagugccagggagaccuaugaagacaaaagucccuucuagcuagaagauuaaaaaggcuuugaauaacaaauggcauuggagguggaguuugaaggaagagagagaugcggagugaugaaagaaggugugugccccaaauggcaugagcagaagcacagagaagggagaaguuaaucucaaaguccaguucgauugaagcaggaggacugaaaaggacagucaggacuguuuugaugcauucuuccugccggggauuggccauuucugagaguccuugauggauaagugauaggacuuuaggacucaagaauuauacagucucacauuugcauccugccauggccacuaccuuagccaugacacugagcaaguuauggcccuucuccaagcucuguguaguuaccucaccugcaaaacgggcauggguaaagcuccuagcacaagaggucacucugggaaccaagugaggugauaguuacaguggugcaugcacagaguaaaugcucucaacgcagcugaacagagcccaggaacuggaggaagcucugccuuuggggguuucaucuguagccuugauucgagcaaguagaacagugaauauguuucuuuuuacuauuugaucacaaucuaaacucagcagggagagccuagaugcugagcccagguagacgauaaccugagccagagacagagcaaagcucccuccagggagaaugggaggggugagcaucagauuugacaggacuuugcauuggcugggcgugcagucugaagaagcagcagaugggccuuaugugcugcggaugucuaaccugggugaccagcugaauggaguagcaggaaaaucagagcggacugugaggaagacacauggcaaagaacauggaauucaaaaggaggaagcuuggcgaaagccugggaucagcgcugugggaaaagagaggaagagagaaaugugcugccacccuacuggauucagacaucucagagcaacacgagaaaaagagggaagggcucuuaaucccugcaggauucucacagagaccuccagggaaugugcagaagguuuuuaggugaugccaaacugggagauuagcuaacacaaacacaacaaagucugguuucaaagcagucuugaaaagccagaauugugaguuggagcaaacaacaaaagcuaacucauauauuaacuuucauauaaggaagauucuguuauuaucuucauuuuacagauaagaaaacugacacacaaggccaggugcaguagcucaugccuguaaucccagcacuuuggaaggccaaggugggagaauugcuucaggccaggaguucaagaccuaccugggcaacauagggagaacccugucucuacaaaaaaauuuuaaggccgggcgugguggcucacgccuguaaucccagcacuuugggaggccgagcaggcggaucacaaggucaggggauugagaccauccuggcuaacacggugaaaccccgucucuacuaaaaauacaaaaaaucagccgggcgugguggcgggcgccuguagucccagcuacucgggaggcugaggcaggggaauggcgugaacccgggaggcggagcuugcagugagcggagguugugccacugcacuccagccugggagacagagcaagauucugccucaaaaagaaaaaaaaaaaaaaaauuuaaaaauuagcuagcaugguggugugcaccuauagucccagcuacucagaggcuaaaguaggaggauuccuagagcccaggaguucaauguuacagugagcuaugaucacaccacugcacgccagccuagaugccagagcaggacccugucucuaaaaaauaaaacaacaaaaaaagaaaacugaguggcagggcacaguggcuuaugccuguaaucccagcacuuuaggaggcugaggugggaggaucacuugaggucaggaguucgagaccagucuggccaacauggugaaaccccaucucuacuaaaaauacaaaauuagcugggugugguggugcaugccuguaauuccagcuacucgggaggcugaggcagaagaaucacuugaaccugggagaugaaguuugcagugagccgagguugcgccacugcacuccagccugggcaacagagcgagauucuguuucgaaaaaaaauaaaaauaaaaaacugaaacacagacagaguuuaagucacuaggucgguaguaaagcuaguagcagcaguccugggauuccaacaggacaucaggcuuugaggucugugaucuggaaggaauggaggagggaaauggaucauuauggaguauuuacaauuugccagacuccaagcugggagaccuggaaggaaguaaggugauuuagaguauggcuuaguggaacggggcacggugguucaugccuauaaucucagcacuuugggaagccgagggaggcagguuacuugaggucaggaguucaggacaagccuggccagcauggugaaaccccaucuguaguaaaaauacaaaaauagcugggcgugguggcaugcgccuauaaucccagcuacuugggaggcugaggaccgagaaucacuugaaccugggagguggaggcugcagugagccgagaucgugccacugaacuccaaacugggcgagagagagagagaaucugccucaaaauaaaauaaaauaaaauaaaauaaaauaaaauacuauggcuuaguggacaaagaugaugaugugauggaacgucacuucuaggugcccccauaggccuaugagaggcaucuggggaggcaggagcuaacuuuucugugcugaccccugccccaauaugaaugacuucugagcaugguguggguaagcagccauccccagcucuuucuguccaggggggucacauuccucacugucugugaaaaucuuggucucuaagucuuucuuucccuccgaugacuaugcgugugacauguaugaggugucugcaaggugcaugguguauguguauguagguaguuauguguggagcuugcauuguuguauuugggucaauggguguauauguguguggggugccugccuguauggugaaugcacaucugugugugccuguguguaugauugcauggcaaauggcuggcuauguuuguguauguguguguugcccacauguaugugugauguguaugugcugacuguauggugaguguguauuuuucuguguguguguguaguguguugaggugucugcgugauaagagauuguguguaugaguaguuagcuguagaaccugccugguguaugcgugugcaugugugugccuguguggugugggcagucuaguuuaaguuuauuucauaauccuggauggaacuggagcaaaagcuggguagcuuagcaccugugcaauggcagaucacccccaccucucgccgcaggcacaggaagcagaggcagaaagagccuggcaagggagaggcggcauagcugcacccccgcagggcagcuuugaugcugcaggugggaggggaagacuccuggggaggacacucuuucucgggcuccacaccugcugucacggacaccccagacuugaagcuggaauagagggagccacuaggauaacaugcauauuuuuccagaugaaaaaauggauacacacacacacacacacacacacacacacacgcaugugcacucccccuucucguuuucccccaaauucucacagcuaggagccaugcuuugacaguucuucccaagguguggggugagagaaagcaaguccuggugaaggagcugaagcagggaggcaaaggagaggcccuggggaucaggcagaucaauagcguccagaacauaauguuuaggacaggcacugggucagaacugagccaccaggcaugcuggauuuaggguaugggaccgucguaagacagaucuaccaccuggaaccagacaucagccgcgaggaaaaaagugagaggucugcgguccagguuuaaacaggagagugggcagcagcugaccaccaggagcuggaaggcugagcaaaguggcacaaacacagaaccaggcgccgcgucaaggaaggaccucggccacugcaguagaaucaguuuaguggggacguuuguaggaguccuccagagcaggcuaaaauccccucauaugacuggcucaagacuugccgguggaaauaaaggagaacauauggccguaguaagauaagaagaaaauugucuuccauuuuccccugcccaccucacaaauguccacauucuguguucuggagaaaaucagccucccaguaggauggcgggucguuuuuaugcauggacuauauuuggugcguauaaacuagaaauaucaacccaaggaaauuuaguuaaaggcaggacucguucucuuguaucccccugcccccgccaucacucggcucugugccuggauuuagaaguaguaguccguucucccagaaaagguuagauggcauacacugugggcuucuuaggacccuuccagauaucaauuagagauggagagcuauguguuucuuauauuaauuauauuaauucuuuuuuuuuuugagacagagucucacucuguugcccaggcuggagugcaguggcacaaucucgguucacugcaaccucuaccuccuggguucaagcgauucuccugccucagccucccaaauagcuggaauuacaggugccugcuuccacacccagcuaauuuuuguauuuuuaguagagguggaguuuugccauguuggccaggcuagucucagacuccugaccucaggugauccucccgccuuggccucccaaaguguugggauuacaggcgugagccacugcguccaaccuucuuauauuaauucuaacauugauuaacauauagguuuaaauagaaugucauuaacauaacauauauaacauuuacugcuucaauucaugaucccuucuaggcuaugaacaucuaagggcagagaugagguauuuuuauugccguauuccaaguuaucuagcacagagcuuggcaguuguucaaaacuauugaagucaauaugcaaaucaaagacauagauuuuuaaauauuuguguuuauuugcacaugugcacagaaucucagaccucucauacuggaaacugcuugagagacugccucaucuaucuucccagccagugcaggaagggguucuacagccucuuagcagaacccccucgaccuccucugggaacuucuagccaggucucugugagacagccugucccauugcggagcaacucugauagaaaugacuucuuccaagugauccuaaaccggacucucuaguaacaucuacccaauaucuucucccacucugugcccuauauauuuuuuuuccauuucuuccaggugaaacaaauggccaugugaagugauuucaaaaccucucauccuccuagucacccuccucuagaaucaaugaauugguuuauguucaugucccuuaaaauauacggugugcaagacuagaacuaugcaauuugacuacaaaguaguuggggacuauuacccaucuaacuuuguuauuccugugccgcuaaugucaccuacaauugcauuaaucuuuguagcugucacauuuuccucuuguauuagacaucuaaagagcacagcuaaaaaaaaauuaaacucggucaaacuaaucugucucacucucuacaauugguguuucaaggccaaaccccauuaaguuaagaaacugacugacugagaucuugguacguauuggaaaacaccauacuaggagaaggaacuagagguuacguugggaccagcuuucucuaucccacugcccaucaaguuuccuggcagaaauccuuggagacauccuugaccccucucauuccucauaagucaccaagacucaacaauucugccucaaaauaucuuucuuuguauuccugcugcuaugcucuuugcucagauucuaacacaaaauacugcagggucuuuguuaaguguaagccccauggguauucucugcuuaaaauguuucaauagcuuucagcuucuuccagacaaagucuggaucccuuuguagggcuuaaaggucccuuugggagcuuuuguuaucgacgucugcagccagauauucucccccgcucugugcacaucuuaggugucagccauuccaauuaugugcuuccuguuccugcaugcacuugccuuccuccugcuuuuuaggucuuucuuguaugucccaggcauugcucuagaugcuguaugcaaauucaugcauucagucgucaccaucauccucugaaguagauaacauuuccauuuaacagaugggagugcucaggccaggcguggcggcuccugccuguaaucccagcacuuugggaggcugaggcagguggaucaccugaggucaggaguucgagaccagccuggccaacaugguaaaacgcugucucuacuaaaaauacaaaaauuagccaggaauggugaugcacaucugugcugaggcacgagaaucacuugaacccuggaggagcaggugguagugagccgagauagcaccacugcacuccagccugugugacagagugagacucuguaaaaacaccaccaccaacaacaaaacaaaacaaacaaaaaacaaugaaaacaaaacuaaacaaaaacaaaaaauagaugagggagcucaaaugucaggcauucuucucagaaacaugcaguuaauaauuuuuggguuggaugagucccuuagccuaaaaugcccuccuuuccuuggcaaacuucuugugaaacuucgcccaucuuucaagacaguucaagccucagcucuuugagaagucagugucccccugaacuuaaccguccaauaacauuuagcauucugggcuaauugccaaaugguugcuuuacucccaacagcauguaucugaagaacugccccuguccuguuccucccugaguccucagagccuauauucugcaccaggaaucugcugaaugauuugccaaauuauuaaccuuugguaaucaauuuuuccugcaaugcacacaaaaaucuggcaaaagcuuaauuguagaccugcugccuucugcaauucaagccaauuaucccaaguucauuuaggagcaguggcgcuuucuauaauguacauuaccuaaacaugcacaagggcaggaagguuuuaaaugacuaagcccagcacaccauuugcucagaagauguuccucacuacaucuccuuuaggaugcaauuuagucugugaggcgcgaggaaagcugugcgguggagacagccagaugggcaaugagcagggagaggagcuaugaaccuugugagagauaaaccugaaccuuuucuacacuacauguucaccaggagaaaaucagauaaguaugaagucuuaaaggaguaggggacagcaaaauccaugccuugcugucccacaguccaaacaccaccaagggcucuggcaucuaugcuguauuaacucuguuuucuuguuuucuguauucuccaugcucuggcacuuggggccuugcugacuugggggaaacugcuccuccaacccgagggcuagccaguuauuacagauagcaaaugaccccccacaagcacaucuuucauaagcaaaccaaccagcccaaagaccacacccccaacuaccuccuuucccaaguguuuacccauuaagcagauauuucccugcccuaaucaccccaggguggcaaccagacaacuuggggcuccuacacuccaaagccugcugaaaguauuaaaaugagccaauccuaaaccugcuuaguuuucccagccuggcuuauuccuucccacaaaaaucacaaggacucaggaacaugguuucccacccagcuccugaaugaccgugguucuucccugcguggucucgcgugccaugccaugucucccgcuucucgggaucgacgaguauaaaacuucuuuccugacaguuauuuccaugucugugcaucuuaccacacccgauuaaaacaaauccccaguucauuuuaaacacagguuagucuacgucauacaauaagauucuuuuccuugaccuuccccaccagcuuuugaagcauguaacuagacaucaucauugucaacaacaucauuaucaucguuauccuacagcuaagaaagggaaacaagggcaaaugccagggauucaccuaagguccacaaaacauggccaagcugggacuuaaacacaaauuugggagcuagcaccaaaugcuggccauuuccccaaaaagauuugcagaagcccauaggaaguuagaaauaugguccccagugaaccucagcugcuuuauauauaaaauggagacuuuagaguaucagucuucuggagaacuaugacaauguaugugaaagcacuucguaaaacacacuguauacauucauuuaaaaaccagugaccuuaugcuacaugguuaaagucaucaaugaauaacaugacggcuaacuuaugauugugacagcugcucaugauguaaagcguuuuacauuaucauuucauuuaacccugacaacaacccuaugaguugauucguauuauuaccuccauuugcaaaugagaagauugagucuaugagaaguuaaguaaugugcucgaguuugcaucguuagcucuauguggagcuaugauucaaacccauauauuaaacugucugucccaaaguuuuucccugcccucagaacuaagaauacucaaguaaacauuugcucuuuuuggcugcccggcauaccaaacacacccugagcuuguaggagcccugccuuccccuguggagcccaaagggggccuuuucuccccauuccaagcuauuagaacgugugauugacucaaggaauagauccacaucuuuaaugaguaacugacaucgaaaugcaagguggucuugccuuauacaaaauagcaaauccuaagugcaaacuauaguccaauauccuucacaucaugagcacaauauccuuuacaucaugaaaaauaugacaagacacgcagcaaaggagcaaaggcaugcuucuaucaggcuuugcauucuaagaggcagcuacugcaguccugguuggaaacaaauggguagagcagaguaauagccaccuuccuacagcagagaugugaccuuucaaggcacugaaagagguauucauggacauaaucgccacucuuuauggagagccuugugucugguacuacauaagacacuuugccuguguuauuuguuguuuuuugcuuuuuugagacagggucucacucugucacccaagcuggagugaaauggcucaaucacagcucacugcagccuugaccucccuggcucaggugauccuuccaccucagccuccugaguagcugggacuauaggugcccaccaucauggccaccuaauuuuuguacuuuuuguagagacgggguuucaccauguugcccaggcuggucucaaacuucugcgcucaagcgauccaccuggcuugucucccaaagugcuaggauuacaggcaugagccaccaugccuggccauaugugucuucuuuaaucaccauuuaacaggaaagaacacugaagcucagagggauuaagacccuuuaguaaauguuggguccaucacauuccuaaggccaaacuccaggcaaagauuucucaaacauuuaaugugcauagaagacaccuggagagcuuauaaaauugcagauucugauucaauaggucuguaguggggccugagauucugcauuucaagcaagcucccaggagauauagaugcugcuggcugguggaucacauuucaagaagcaauacucuaaauguuugugcuuuuuagauaccaucauaaaaaauauucauggcaggccaggugugguggcucaugcuuauaaucccagcacuuugggaggcugagacaggauugcuugaagccaggaguuugagauaaacuugggcaacacagugagauucccgucuccacaaagagaugaaaauuagccggaugguuggcaugcaccuguagucccagcuacucaggacgaugagaugggaggauugcuuaaacccaggaggucaagcugugaucacgccacugcaccccagccugggagacagagcaagacccugucucaaaaaggaaagaaaagaccacaaaaacaaauccauggcucuuuuacuuguucuaaacacuucccuaggacuuucucccuuuucuagaacuuggugacaugagaagagauucccucugcaauacaaaugucagaauuuaacucaaugaacaauuucuccuuccguuuauucaauccacacaacuucguugagugccuucuaagccagacacagcaguagguacgggggagaccaggauaaaugagauaagguccuggccccuaaaagaggaacuauggaugaagacaggaugucuuaaaaaguuucugaugcuuccaugaaagaacagccugcagcacacugcuuuaggauccccaguccagucguccgcugcuauggcaauugaggucauucugaccgcuccagcgccaucuucaccacuguaaggcuagggcacuuuucagcauugugccuucuuccaaccauauugauacagagacaauuauacaguggcucaaccugucuagauucuacugcgaaaguccaauucaccuaccuuggguuaugacugugucaguacacauauaauauuaugccucuguuuguuggaacaggaacaugucgaaugcuucuuggacuucacccaggcuggaaugcagcugugcaauaucagcucacugcagucucaaucuccccaguugaagcaauccucucaccucagccucccaaguaguuggaacuacaggcaugugcugccaugcuuggcuauuuuuaaauuuuuuuguagggacaaggucucccuguguugcccaggcuggucuugaacuccuuggcucaagugacccuccugcuucagccuccccaagugcugggacuauaagcaugagccacuacucccagucucuguauacuuuuaaauaauuuuauaugcauuugggacauagcauaaaaacuaaucugaaauuaaauuuaaccuuaaguuuauuuaaugaaacuuaguuucagaaagcagcaucaggaucuuagagaauggaaagguaaguguuauccaagggugcagcuaucuguuaaaaguauuaauauuggccaggcaugguggcucacgccuguaaucccagcacuuugggaagcugagguggguggaucacgaggucaggaguuugagaccagccuggccaacauagugaaaccgcaccucuacuaaaaauacaaaaauuagccaggcaugguggcgcgagccuguagucucagcuacuugggaggcugaggcaggagaaucgcuugaaccugggaggcggagguuguggugaguugggaucacgccacugcacuccagccugggcaacagagcgagacuuugucucaaaaaaaaaaaaggguuaauauuuuggaggcaucuaacuuacuaauuuucccucauugacaugguaauuuguuuucauuuauucauuauuguuguuugguauuuauuuacuauuauuauuuaaucacggacuaaggcacugcuauguugugacucuuugugugccccuaaauuuauauguggaaaucauaacccccaaaauaaugguauuaguagguggagcccuuugggaggugauuaggucaggaaggcagagcccucaugaauaggauuagugcuguuauaaaagaggccccagaggcugggcaugguggcucaugcguguaaucccagcauuuugggaggcugaggcaggcagaucacuugaggacaggauuuugagaccaaccuggacaacccagcaaaacucugucucuauuaaaaauacagaaauuagcugggugugcuggugggugccuguaguccccgcuacuugggaggcagaagcaggagaaucgcuuaaccugggaggcagagguugagauugcacuacugcacuccaaccugggcaauagaacaagacucagucucaaaaaaaaaaauaauaauaacauaaaaaagaggccucagagagcugccuugccccuuccaccaugugaggaugcagugagaaggugccgucuaugggcccucaccacgcacugaaucugccagugucucgauuuaggacuucacagccuccagaacuaugagaaauaaguuucugauguuggugaauuacccaguuuaugguauuuuguuauugcagccugaguggacuaacacaggcauacauuccaacuagcaagaagucuaaauugaugacaucagauggcucccagcuguucccuagaugugaauaaacccccacagaaaacccucuuucucuagcaagugcuauuccuuuacccuccgcuuuuuuuuuuuuuuuuuuuuuuugcgauggagucuugcucugucacccaggcuggagugcagcucgaucuuggcucacugcaaccucugcuuccuggguucaagugauucuccuuccucagccucccaaagagcggggacuacagggacccgccaccacgccuggcuaauuuuuguauuuucaguagagacaggauuucgccaaguuggucaggcugcucuugaacuccugaccucaggugauccaccugccuuggccucccaaagugcugggauuacaggcgugagccaccgugccuggccucuuuacccccauuuuuauggcauggccaaauaagggaguggggagagaggugaagcaucuggaaagugaggagagaaggcucacacugcugcagacagccagcaucauuugacugcagcuuccagaugccuguuugguuucauuccacugaaauccuggcacuuugacuugggucuuguggucauuuaaggucauuuaaaccuaucucaacccagaugcugagaagacuguaaacagucaggaacacaggaagcuggucaagauaacagauaagggggaaaaaaaggccuuggcagggcacgauggcccaugccuguaaucccagcacucugggaggccuaggcuggaggaucacuggagcccaggaguuugagaccacccugggcaacaucacaagacccugucuuuaccauguccagcuaauuauguuuauaaauaaaauuauaaacaaaauuauaauuacuuauaagcaaaaguagcugggcaugguggcacgugccuauagucccagcuacucaggaggcugagaugggaggaucacuugggcccaggaagucaaggcugaagugagccaugaucgugccacugcacuccagccugggugacagagugagacccugucuuaaaaaacaaaaauuaaaaacagaagaaaagaccuuaaucccaugagcaacuauaacaauuauaauagaggauacuuuuauggcuauaauucuuugggaaacuucuacugccagguggcgaagcauugugaaguucuggaauugaacucuagguugaaagauaccugaaggaacucuuggagaucuguucucuuaauuuauggaugaggcacagaagaugucauugcugaagucaaggucucacagcaagucauaaaggagccagaaugcaaggcucagucugcugagucauaauccacugaccucccuuuggguugccugcgcucauuuccucacucgcuccucaauucagcacacuccauccuuccuccaggaauacaauuuugcccucaucgcgaaccaucuguagucucacucauuauuugguuaauucagucauuuugcagcuauauauccggaacccagcaugugccaggggcacgacaggaacaugacagauccagccccugucccaaggugaucaggauuuccuucaaucccucacugcagccaugcuucuuggauucagucuucccccucagaaagaacugcuuuucucccuacgaugagagaugcuuuacuuucauagugaaagcauuccuauuaacguagauaugacagaaaaacaaaacacaacaaaacgagaccuagcuuaugguagacuuagugucuaaagauagugaauuggcuuuggauuuuaaucaagcuuucaggcuccaauaagaauugaauugcagguguuccuacgguuuauuucacagaaugacaguugaagguggccucuguauuuuuuacuauagcuauaaaugcugcucacccaaagagguguuugcucacaucaaauuuuuaagggauguagucacuauuaauccaaaugaagcccuaaaaagcuguggcuacacuggagcauucaagaggguuagcuaugggaagguaugacuccagcaaugaaguuauauaaucagcaagaaaaaaaaaauacaaccgagacagcuuagacagauuuucugcuuuucuuucuuagaggagguuuaaucuggccuaagucuaagaagauuugucucaaauugacaauauaggcuuaaauaguuuauuauuuuaaaaggugauauaaccauuuucauucuucauugacuucugaguucuuuucucaauuuauaauuauugugauguuggagagauuauuggcauagauagcuuuccugauucccucauuguuauguuuucaaauaggaauaaaagaaaagcaaccagcaaugacuccaugggaaaggaaauccaaaugugugaauccccguuuucuuuggaaauaugaaucaguguuucugacauugaaaacagauuucugcagcaaaguguaucauuuauaaagauuuugacucaggaugaagaagguagagagauuauauuaauuuaauuguacuuguucuuagggaagcauugucagugggugagauuuucaaauuaccuccuaugugcaggguauacaggagauagaauaaauuauuuuuacaaucaauaaacaaaguuaacuuuaaaaauaaaguuuuggcaggcgugguggcucaugcuuauaaucccagcacguuaagaggccaaggcaguaggauugcuugagcccaggaguucaacacuagccuagguaacauagugagaucugaucucuacagaaaccuuuaaaaauuagccaaguguuguggcaugcacuuguacucccagcuacuugggaggcugaggugggaggaucacuugaacccgggagguggagguugcagugaacugagauuguaccacugcacuccaaccuuggcaacaaagcaagguucugucucaaaaacaauaaauaaaaaauaagaaaguguuaagggugagagauaucuggaccauaauaaaaugccuaacucugugaugauguguuuggggaagcagcaaguugaagucauguaaaagguaccaugguucuuuaacccacuuugaagcuaaaguugaacacauguuuuccccaauaacuggguuucauuaagaaauacagaaugaaacauauuaagacaauuuucuuuuuuuuuuuuuuaagaugaggccgggcaagguggcucaggccuauaaucucagcauuuugagagucagagacaggugacucucuugagcucaggagaucgagaccagccuuggcaacauagagaaaccccaucucaaaaaauauauauaauaauugaacaaauaaaaaaugaacccaauuaaaaacaaacagacuuaccauaugccaucucuucuaccugauuccuaaggugaaaaagggccaagaggggccccuggagaaagaacgauuguaagaggugcagagugacaagagggucuccacacacacucuucuuuuccucuguuucuagggcaguguucuauauuagaaggaucaguguugaaauacccaaaauaaguuuagaaauugacccugaagagagacauagcauggaguccucaaauggguacuuaggaaaguccauguuauuucagggacuaagugaggcauccacgcuugaauauuucuuuugauugucauuagaaaucuccuggauuuaguuaaguauucucucuuuauccccuggcacucauuguagacuaaugaugugcauacuugacacaaaaucuccuaacacauuaugcuuuaguaacuuccuaguuaaaauuuuauuucauuuucuuuacuggggccaagguacaguuuuacuauuugacugugaaaagucuauauuuuaccaagaaacaaagagcaauuuuuaaaguaauaaacccacaauuuguggcagauuuguaaauguaucaaauuugcagaaagcagaggcagauaguaauucucauaaugacaggaaagcaaaugacaauuguuucccugaaggcauucuggaguaugaaaauguccuuaaaaaauauauguucccucuuugagauacguacacuuguaauagaguuucuaauaugcacaacgaugaaagcuugccccauguauucuuagauaaauaaaaucagguaaccaaaggggaaaguaaacagcauuuucuuucacuuaaccgcuuucaaauuuuucuugcuguuauuuuaucauucaauaugguuuuuuguuucguuuuguuuuauaucuaggcugugacaaacauuaaaaaaaacguggaaacccuucugaaaauagaauuccuuccuucguuaucaggaaucuaggauaaaguagauguaaggagacauacggauuaccuuacaggccuuuuggaaugcucagugugacuccaaaggaaagaguggaagugguuggauuguuuuaaaagccaguuugaauuugccaucguuugccaguuccaaucuagcaauggcauauuacauauauauguguguuacauaugugugugcaugaauauauguauauauauucauauagauaccuguguggguuauauaugugaauguauauauacacacaugugugcauauauauauacacacgugugcauauauauauacacacacacauauagauaccucuguguguguguguguguguguuuguggguguauauauauauagagagagagagacagagagagagagagagaggaagagagggagagacaaguuuaaaucaaugagagcauuuccuacauaggggugcugacccaucaagauuccuccaugacucaaggcaaauugaaacugacuuuuaaaacaauccagucacuuccacucuucccuuuggagucacacuggguauuccaaaagcccuguaagguuauucuuacaucuccuuugucaaauaagauaaaugucauucuuucagccaauacucauacaccccauccuuccuaggcaaaucuuggcacuuugauuaagcacucagucuucagagaguuaacagccagccauagacagcuacuucagcacagucggggggaaaaguacauuuuaccuccaccccaaacaaagccauuauauuuaccugcuacuuugaagauaguaaaaugcggucggcaauggaaagaacccaacgcguuaccugcgcaguucauccacagacccugguaaacccaaguggcuguuaucaccgaggaggcucgcguggucacuuuccacucauuggacgugguagcagcaacgagagcuccaaacccuccgacaccagacaccagagcccagaucugcgcccuggacaugucgcgccgccuucuccagugacacuguccggucagaacgcuuugguggucuaggcaugcagccgauagagaacacuuugacaagcgucacagccagcggauguggguaggugacagcguuucaugcucggauggccugaggaaguacaggaauuuaggaucaaguaugguuuaccaaugacauuuuaaagauggccugaaagagucguucugauuuucuacacggauauuuauu

SEQ ID NO: 192523 - RNA, 117851 nt, Homo sapiens
agagccacugaggccugagcgagagccgacggcgggcgggcgcagcugcugccggagcgccggcgcgugcuggugggccacacaccuuuccuccucuucacucgcgagcccucggacaugguggcccccggcuccgugaccagccggcugggcucgguauuccccuuccugcuaguccugguggaucugcaguacgaaggugaguccugcccugccccggccaggaagugggcucccggaccaggccccccgcgcuuucccgucugcgcccgggcgccugucccggagcggcucgggagguggggcgagcgcugggggagcccgcggccuggcuugggccugagcccgcgcccgguuccggguuugucuggggaagaaucgaggggacuggcgggccgcggggccgggacagcggguuuggacuaaggaaccgggccgcaggagucggaggaggcggggugcgggggcaccgggcuacgacuucaggaaguccugggacgcggagacuugggcagccuuuggguccuggccucgcuugggacccucgcugggcgccuggggacacugucagucauuggugcuggcugggaggaggcacuaagguggccaaaagacuuccuucgcucuggaguucuuggguggggaaggagugucauguccggcugggaguuggaggggacaguguugacuauuuaaaaaguguguaaccauccccauuaagaugcacugucguguagagaaauuguuaguuuggugcaaugaggagccgcuguuggaauuccaucucccggacggccaggcacugaguuugugguuuuacaacucccaacauggugucauucaacguauggcuggcauuacuuuuccaaguucgcuguaaaaagguucccuuaaaaagauacgaacgauuaaauuucacuucaguccugcagacuggaauguuggcuacuccagaauagcgaaaauagagggcuguccuaucuuagauggcagcggggaggaguaagaauuaaaguugauagugccgauuuaacgaaugcuucuggcgcgguuacugugcgaaauauucgaguguaaugacacaucacaugcacugaucuauuuucauccccauaaaaagggcuaguugucaaggaggucaaauuaaaccuuugaguauuccauucaaagggagcgaggaacuaaaaauugggaauuguuuauagugaauucuucugaaaguucucaacuuuuuuuuuuaaaguaguacuccccaguuuuuaggugucacccauagcaaugggcuuuugcuuuugcuuccccugguaaccauauuuuuugaaccccaaaucagaacacguaguguggcaacauugggacaaagaauuugacagugaggcugcccccagaaaaaucuaggggauuggaauuugaaggucuguaccacuuuaauaugggucauauauucuaguucuuuugcauuuucaaaagcuucauuccuccugcccccgcaccccaccaucccucaucuguaguauuuaucuccaguuaucauuaauaauuuauuuuggacacuuaagagaaaguugccuauguucuguuuaauggugauuuuuuuuuuuaaguuacagagaugcacaauuuugaaugauugcuuuucccacuacuuuuuagaauugcuguucuguauaugagucuguaaggacucuuaacucuucauuucccuccugugguauuuuccauaagaaaaccacauuugagagcuuuucuguguaggaggcacuggugacauuucucagaggagugccagagugucuucuuuaggaccauugucuguguaaaauagcagggacuuaguacagguaacagaaaaaggaaagaaaggagccuuucuguaagccauaucuuauucacgaaagcgugugguauucauuccuacuuuacagaccagggaacugaggcuccaaagguuuuacuaaaguucauuuugugugcacgcuggagacagaaguuaaguaguugacaacaucaugugaguccaagcacuuuuaagugauggcagcugagaaaaaaaaucagcacuuuuuuuuuuuuuuuuuuuuuguaauuaacaagaagguuauuuccugggagguuuaauacagugguucucaaacuugagugugcaucagaaucgcacauggagggcuuuuuaaaacagagugcuguaccccacuuacagaguuugauucauuaggucuugaugggaccugaaauuuugcguuucuagaaagacccuggaugaccacacuugagaaccacugguguaauaaauuauauagaggaguuaaauuaggugucugcuauguauuugacacuggauuuggugauagggauauaaagguaagaacucugacuugaauuagcaaaccguuagccccuguuuucccaaauaaauugugucuggauucacuaaucucauaguucucugaaaggcaaauggugcuacugcuaggccugaggcuuaauaaaauuguguuguauuaaggauuuuuguuaaauagguagguuuuagcugcucuugucacacaaaaaguaauuaugugagaugauagauauauuaaucugcuucacucuuauuaaucugcuucacuauuguaaccauuuuauguguguauaucucauaauacuauguuguaaacaucaaauauauacaauacaauucacuuuuaaaaaaagaaaugaaggagaaugguuaugagagaagugaauguggaacuaagaguggcacaggauggggaagagauaaccuaguguuuuucugauuuugaaauauuugccuuuguuuucuucuagauuuuucuguuaauugucauccagagacagaaaguauauaucaugaauugaaaguuugagucuuuuggcacccucccuucucaaaggcguuugaaagagugaagucuaaagcacuagaugagaucgaauuuuuggaauagaaagaaaacuuuaguaguaucugcuuuaguauucucauguuacagauaaggaaguuauuucauuucuuugcuaaugguuuguccucuuggugacuugaguagcaacacagccugggaacgaaaccuuuuuucucuuaucauaguuuuaucucuuuuucuuccuuaacaugcuaucuggacccaauuuuucuuuauuucauugagcugauuaaaccauauauuuuggccauggggaaaagaauaguugaaaauauauaguugaaaaucuauacguauaaaauauugugauaaguuuuauuugaaccaugauaaguuuuauuugaaccuaaccuauuaaagguauguuuugucuuuucuaggauuuucuugacauuaucuaaauagggaaagaauaaaguagcaaaaaugagugacuuuaaguaauuuaaauaaauuaaguaucauaaaagguggucacauauuuucuagaauuauuuuaaauucuuuaauaagauaggcuguaguuagcaguaguaucaaaguuccaguucucuugacauaguuaguauuugcugagaaacugccuggaaaugcagugguuuucauucugugagguaggggaaguuguucugggaggggaugcacuguaguaauuagguuuuauuuucccauaugaaguuaauuaauuguuguuaaguuuaauuucuacugcuguggucucuuuugauuaguguccugcaguuaaucuuuguuuauauggaaguaucaugggaacccauucaccugcucuucagaacgcaaacauuucaaccauagauuuauuuuucuuuccauaucuuuagaaagcuacuuaaaaaaauuaaaucugaugaguuuguaucauuuggaguucuggaauauggagaagacucauuuaaucagucagcaaaggcuuuuacuaacuauauugcucuuuggugagguauauauacguagcauagaacucauggcuuuugcuuuugaguuuacagaccacuuaggguuuaagacaugcauuugugaagcauucacguccucuuuuucuccuuucccgcuuuagacugagugguccauuauuguaguuaguguacugcaaaugcccauuuauuuucuggccccuguaaucuucuguuuuacucaccugccaaaacccaacacugguuaaauucaacuuggccaacuguuuuuauaccuuauagguaaacacggacggaggaaaauggagacaacuuugcugauuagucucauuuaucuuuauuuuuauuuucaauuuuuuuucgagacaaggucuugcccugucacccaggcuggagugcaguggcaugauccuagcucaauguaggcuugaccuccugggcucaagcaguccucccaucucagccuccugaauagcugggaccacagguaugcaccacugcauccccuacuaaguuuuuaaaauuuuuuguagggacagggucuucuauguugcccaggcuggucuugaacuccugggcucaagcaauccucaucccuuggccucccaaaguguugagauuacaggcacgagccaaugcaccuggcccugauuagucucauuuuaaagaaacaaucucagucgcaaaugcacauuaaauacugcuaacacucccacaauucuuuacuaugucuauucuugaaaaucaauauuucaaacauuuuccuccuuucugaagccucuaauuuaaacucuccuuuccucucuccccuaccucauucuuuuagaccuugucuuuacugagaaaaugaaagccaucacaaggcaaguucuucuuucuaccucaaaauucacuagcuuaucuacauuuguaccuauucugcuacuuuuucucauauugaaauacauuaaaugucucuauucccagauaaaucuaaucuguguacuuacacccuggauuccauuuccucucaccuucugaaaauguugcuccuacaguuguaucuuugugcugcuauaacaaaauaccacagacugaguaauuuauaaaaaaaauuucaaccugaauuuuggagagaacauucagauaauaguagaugcugaacuuccuguacuaucuuucuuuggcuagauuccacugucuucuguguuucugcuacaagacuucuuuuagacucuaccccaccuugcuagagucuuggcuuagccuucuguucuuuuuuagagaagaaacuuagggcuuuccucauuccucauauucuaagugcuccaaccugaauaaccaucucucucucugggauugcucucuggucugggucugccaccgccuuugcuugaacuuuaguaucuuugacuaugaguucuugccuccuuuagucugguucuuccagucuugauuguaacucacgucauaccuuuaaccccccaccuuuaaguuuaaaaaaauccuuauuuucugcucuccaaaauauaagauauucuaauacuaauuucagugaaagacauaguuggcuacucuaccuuuuucccugcccuugcugcuuauuuugcugacuuaugaucacugcuugucuaaggagaaaccuauugucuaaugcugauuaggaaauggcaugauguuugguugucuuaccucucugaaaauaauguuuacagaccauguggcaaaggaauaaaaauuaccuguggcucaaaagagaguggauugcaaaaacagccaauaauucgcaaauaauuugauuuuucagaugugucuuuaugaaucauugaucauauguuugacuugauaauuguuauguauuuuagauuuuauucugaugaauuauaauacguuuaaguaaaaaggcaaauaguuaaauucauucaacaaauauugcauacccacuaugugcgggauacugaauuaggugauacaaagaagaaaagacagcuccuccucucaaacuugcuuuugauaaguuuuguggaguugggacuuugagaagcaggcaaauugugaaaagcaauauauagagagagugauauugcaaagugaagucauguacuucugaguguggaaaugcaaaauauaggaagauugaaggagcuuuuuuucccucucucaaaacaauacagugugagggaagguuucacaaaggagccagcauuugagggcagaaucuuuuuuuuuguuuaacuuuauuuuauuuuagauucaagauauacaugugcagguuacauggguauauuguguaaugguggggugguaugauuuagaucugugccccacccaaaucucauguucagcuguaauccccaguguuggaucuggggccuggugggaagugauuggaucaugggggugguuucuaaugguuuagcaccaucccccagagcuguuauugugauagaauucucacaagaucugguuguuuaaaagugugcaguaucuccccccucucugucuuccuccggcucuggccaugugaagaugugccuacuucuccuuuaccuuuugccaugauuguaaauuuccugaggccuccccagccaugcuucauguacaaccuacagaaccgucagccaauuaaaccucuuuucuuuauaaauuacccaguuccggcugggcacuguggcucacgccuguaaucccagcacuuugggaggccgagguggauggaucacgaggucaggaguucaagaucagccugggcaagauggugaaaccccgucucuacuaaaaauacaaaaaaaaaaaaacuuagccuguuguggaggugggcgccugaaaucccagcuacuugggaggcugaggcagagaauugcuuaaaccugggaggcagaggaugaagugagccgagauugcaccacugcacuccagccugggugacagagcaaaacuccaucucaaaaaaaaaaaaaaaaaaauuacccaguuccggguauuucuuuauagcaaugugagaauggacuaauacagaaaauugguacugggaguggggcauugcuauaaagauaccugaaauuguagaaggaagcaacuuuggaaugggguaaugggcagagguugggacaguuuggaggacucagaggaagacaggaagaggaacgaaaguuugaaaccuccuagagacuuguugaaugguugugaccaaaaugcugauagugguauagacagugaaguucaggcugaggagggcucagaaugaccgcagaugaggaacuuauugggaacuggaguaaaggccacucuugcuaugcuuuaguaaagagacugguggcauuguaccccuggucuauggaucuguggaacuuugaacuugagagaggugauuuaggguaucugguggaagaaacuucuaagcagcaaaguguucaagaugugaccuggccucuagcagccagugcucauauucaugaacaaagaaaugauguaaaauuggaacuuacauuuaaaagggaaacagagcagaagaguuggaaaauuuucagucugaccaugugguagaaaagaaaaacccauuuauaggggaguaauucaagcagacugcaugaauuugcauaaguaaagaggagccaagugcugauagccaagacaaugggaaaaagggcuccaaggcaucucagcgaccuuuaaggcagcuccuucuaucauaggcccagagaccuaggagggaagaacaguuuccugggccagggcccugccagccucaggacacugcugccugcauccuaguuacuccagcuccagccauggcugaaaggggcccagauauagcucaggccuucagacggugccagcccaaacccuuggaagauuccacaugcuguuaagccugcaggugcugaaagccaagaauugaggcuugggagccucagccuagauuucagauauauggaaaagccuggauguucaggcagaagguugcugcaggggcagagcccucauggaaaaaucucuacuagggcagugcagaggggaaaugugggguuggagcccccaacagaguccccacuggggcacugccuaguggagcugugagaaagaccaccaucuuucagaccccagaaugguagauccgcugacagcuugcaccaugcaccuggaaaagcugcagccacucauugccagcccuugacagcagccgcgugggcugagcccugcaaagucacaggaguggcacugcccaaggccuugggagcucaccccuugcugcaauaugcccuggaugugagacauggagucaaaggagauuauuuuggagcuuuaagauuuaauaacugcccugcuggguuuuagcacgugcauggggcccguagccuuuuucuuuuggccgguuuuacccuuuuggaaugggacuauuuacccaaugccuauaaucccauuguaucuuggaaguaauuaacuuguuuuugauuuuauaggcuuauagguggaagggacuuggcuugucccagaugagacuuuggacuuuugaguuaaugcuggaaugaguuaagacuuugggggcuguugagaagggaugauuguauuuuguaaugugagaacaugauauuuuggaggagcuggggcggaaugauaugguuuggaucugugccccacccaaaucuuauguugaauuguaaucccuaauguuggaguuggggcuuggugguagguuuuuuguuuuuuuuuagaaaucuccauauuguuuuccauagugguugaacuaauuuacauugcugccacccauauauguguuacaauuucuucaccuccaugcuaacaucuauuuuuuuuuaagcuuuuuaguaauagccacucagacuuguguaagaugauugauauuucauugugguuuuaauuugcauuucucugaugauuagugaugaacauuuuuucauguuuguuggcugcuuguaugucuucuuuugagaaaugucucuuaauguccuuugcccacuuuuuuuuuuuuugagacagagucuugcucugucgcccaggcuggaaugcaguggcacgaucuuggcucacugcaagcuccgccucccagguucacgccauucuccugccucagccuccuaagcagcugggacuacaggugccugccaccaugcccggcuaauuuuuuguauuuuuaguagagacaggguuucacugugcuagccagaauggucuugaucucccgaccuugugagccacccgccuuggccucccaaagugcugggauuacaggcgugagccagugcgccuggcccuuugcccacuuuuuaaugggguucuuuguuuucuucuuguugaguuguuugagugucuuguagauucuggauauuaguccuuugucggaggcauaauuugcaaauguuuucucucauucuguaguuugucucuuugcccuguugauuaucuuuugaugugcagaagcuuuuuaguuaagucccauuuguuuauuuuugguuuuguugcauuuguguuuggggucuucgucauaaguuguuugccuaggccaauguccaaaauguuuaaucuaucuugagguaguuuuuguauaugcugggagacagagauccaguuucuucugcauauggcuagccaauuuucccagcaccauuuauugaauuaggguguccuuucccuguuguuuauauuugucagcuuugucaaagaucaaucuguuggauguaaguaugugguuuuauuucugggguucucuauuguaguccauugaucugugugcguauuuuuguaccaguaccaugccauuuuaguuacuauagccuuguaguauaauuugaagucaaguaaugugaugccucuggauuuguucuuuuugguuaggauuacuuuggcuauucaugcccuuuuuuggugcuguauggacuuuagaauuguuuuuccuaguucucugaaaaaugacauuggugauuugauaggaauuguguugaaucuacagauuacuaugggcaguaugguuauuuuaaugauagucuccaaauccaugagccugggauguuuuuguguuuauuuaugacauauaugauuuguuucauaaguguuuuguaguucucauggagaucuuucaccuccuuggucaguguuuuccuagguauuuuauuuuuuugcauauggcuuuuguaaaugggauugaauucuugauuugguuuuuggcuugaauauuguugguguauagaaaugcuacagauuuuuauaccaugguuuuguauacugagacuuuacucaaguuguuuaucggucuuggaguccuuuaguagaaucuuuaggguuuucuagguaaaaaaaucauauuugugaagagacauaauuugaccuccucuugucccuuuuggauaucuuuuauuucuuuuucuugccugauaacuuuagccaggacuuccaguacuauguugaauuggaauaguaagagugaacaucauuguccuguuccaauucuuagggugaaugcuuucagcuuuuccccauucaguauauuggcuguggguuugucauauguggccuuuauuauguugagguauguuuccuguaugccuaguuaaucuagcuagcaguuuaucaauuuugcucauggauuuggagaauauaauaucguuaaaaagacaacacuaccuaaagcaauccacauaccacccaaagcauacugucuugguuacuguagccuuauaguauagugugaaguuggguaaugugauaccuccagcuuaguucuuuuugcuaaggauugcuuuggcuauucagguucuuuuuugguuuuauaugaauuuuagaauauauauauuuuuaauucugugaaaaaugacauugguaauuugguaggaauaguguugaaucuguagauugcuuugggcaguauggccauuuuaaugauauugauucuuccaaccugugagcauggaauguuuuuccauuugcuugugucauguaugacuacuuugagcaguguuuaauaguucucccuuuagcaauguuucaccuccuugguuagcuguauuccuagguauuuuacuuuuuguguguggcuauuaaaaaugggauuuuguuauugauuuggcucucagcuugaauguugucaguguauauaaauguuacugcugcuuguacauuaauuuuauauccugaaacuuuacugaaguugcuuaucaguuccaggagccuuuugguggaguccuuaggguuuuuuagguauagaaucauauaaucacugaagagagguauuugacuucuuuuccuauuuggaugccuuuuauuucuuucucuugccugauugcucugguuaagacuuccaguacuguggcaaauaggaguggugagaaugggcauccuugucuuuucuaguuuucaagggaaaugcuuucagcugcugccuguuuaguaugguguuggcuguggguuuguuauagauggcuuuuauuguuuucagguaugcuucuucgaugucuaguuucuugagggauuuuuaucauacagggguguuggauuucauagacugcuuuuucuacaguuuuuuuuuuuuuugagacagaguguuacauugucccccaggcuggagugcaguggcucuaucucggcucacugcaaccuacgccucccacuucaagugauucuugugccucagccuccuggggcugggguuacaggcaugcaucaccaugccuggcuacuuuuuugcagagaugggguuuugccauguuggccgggcuggucuugaacuggcuucaagugauccucccaccucagccucccaaggugcugggauuacaggugugagccacugugcucagccuuucuguaucuauuaagaugaucauacggguuuuguuuuuaauucuguuuaugugguggaccacauauguuugcauauguugaaccauccuugcaucccagagacaaagcccauuugauugugugggugugugugugugugugugugugugugugugugugugugcgcgcuguuggauuuaguuugcuaguauuuuguugcauauguuuacaucuauuuucaucagggauauuggccugugguuuccuuuuuuugguugucuugccucauuuugguaucagguugauacugguuucauagaaugaguuagggaggaauccuuccucuuugauuuuuuuuuuuuucgggggggaauacuuucaguaagauugguaaccagcucuuuguaugucugguaaaaauuggcuguaaaaaaucuguccugggcuuuuuuuuuuuuccuggaagauuuugucaggacuaauuugauuuuauugcucauuauuggucuauucaggauuucuguuucuucuugguuaaaucuugggagguuguauguuucugggaauuuauccauuuccucuaaguuuucuaucuaguuugcauaaagauguucauaguagucucugaugauguuuuguauuuucugugguaugaguugucaccuuucucauuucugguugugcuuauuugaaucuucucucuuuuuuucuugguuagucuagcuaguggucugucaauuuuguuuauccuuucaaagaaguuuuuguuuuguagauccuuuuucuuuuuuuuucuuuuuggucacaaucucauuuaguucauucugaucuuuuuauuucuuuucucccagcuaguuuuggguuuguuuuauucuuauuuuucuaguuccuugagguguggugugugguuguucauuugcgaucuuucuaucuuuuugauguaggcauuuaaugcuguaaacaugcuucauagcacagcuuuugugguaucccagagguuuugguaugcuauguuucuguuuucauuuguaucagaaauuauuuugauuucugcuuuaauuucauugcucgcccaaaaguaauuccgguuguuuacuuuucauguacuuguguuguuuucagaguuccuuuugguauugacuucuaauuuuauuccauugugguucaagaaauacuugauaugauuuggacuuuuuuuuuucuuuuucuuuuucuuuuuuuuauugaucauucuuggguguuucucgcagagggggauuuggcagggucacaggacaauaguggagggaaggucagcagauaaacaagugaacaaaggucucugguuuuccuaggcagaggacccugcggccuuccacaguguuugugucccuggguacuugagauuagggaguggugaugacucuuaaggagcaugcugccuucaagcaucuguuuaacaaagcacaucuugcaccgccccuaauccauucaacccugaguggauacagcacauguuucagagagcacaggguuggggguaaggucacagaucaacaggaucccaaggcagaagaauuuuucuuaguacagaacaaaaugaaaagucucccaugucuacuucuuucuacacagacacggcaaccauccgauuucucaaucuuuuccccaccuuuccccccuuucuauuccacaaaaccgccauugucaucauggcccguucucaaugagcuguuggguacaccucccagacggggugguggccgggcagaggggcuccucacuucccaguaggggcggccgggcagaggcgccccucaccucccggacggggcgacuggccaggcggggggcugacccccccaccucccucccggacggggcggcuggccgggcggggggcugacccccccaccucccucccggacggggcggcuggcugggcagagaggcuccucacuucccaguaggggcggccgggcagaggcgccccucacuuuccggaugggguggcuggccgggcggggggcugacccccccaccucccucccggacggggcagcuggccgggcagaggggcuccucacuucccaguaggggcggccgggcagaggcgccccucacuucccagacggggcggcuggccgggcggggggcugaccccccccaccucccucccggacggggcggcuggccgggcggggggcugacacccccaccucccucccggaugggguggcuggccgggcggggggcugacccccccaccucccuccuggauggagcggcuggccgggcagaggggcuccucacuucccaguaggggcggccgggcagaggcgccccucacuucccagacggagcggcuggccgggcagggggcugacccccccaccucccucccggacggggcugcuggccaggcaggcggcugacccccccaccucccucccggacgagguggcugccgggcggagacgcuccucacuucccagacgggguggcugcugggcggaggggcuccucacuucucagacggggcacuugccgggcggagggacuccucacuucucagacggggcgguugccaggcagagggucuccucacuucucagacggggcggccgggcagagacgcuccucacaucccggacggggcggcagggcagaggugcuccucacaucucagacgaugggcggccgggcagagaugcuccucacuucccagaugugauggcggccgggaagaggcacuccucacuuccuagaugggauggcggccgggcagagacgcuccucacuuuccagacuaggcagccaggcagaggggcuccucacaucccagacgaugggcggccaggcggagacgcuccucacuucccagacggggugguggccgggcagaggcugcaaucucggcacuuugggaggccaaggcaggcugcugggagguggagguuguagcgagccgagaucacgccacugcacuccagccugggcaccauugagcacugagugaacgagacucccucugcaaucccggcaccuugggaggcggaggcuggcggaucacucgcgguuaggagcuggagaccagcccggccaacacagugaaacgccgucuccaccaaaaaaauacgaaaaccagucaggcguggcggcgcgcgccugcaaucgcaggcacugggcagguugaggcaggagaaucaggcagggagguugcagugagcugagauggcagcagcaccauccagcuucagcucggcaucagagggagaccauggaaagagagggagagggagaccguggaaagagagggagagggagaccguggaaagagagggagagggagacuguggggagagggagagggagagggagagggacaauuuggacuuuuuuugaguuuauugaaacuuuccauggccaagcauaugguugauuuuaagaauguuccacacacagaugagaaaaauguauauuuugugguuguuggauagaauguucuguaaaugucuacuagguccauuugguuuagaguuuagucuaagucuggaguuucauuguucacuuucugccuugaugaucugucuuguguugucaguggggggguuggcgucccuucauuauuguguggcuauugaucuguuuucuuaggucuaguaguaggaguuuuaugaaucuuggugcuccaguguugaguguguauauguuuagcauaguuaaauauucuuguuguauugaaucuuuuauuauuuuauaaauaauaauaaccccagggcccaaccccaaucucagcccuacuccacucuagcgcuauaguuguagcaggaguuuuucugcucaucugcuucuauccccuaauagaaaauaguguauuaauccaaaccuuuacacuguuuaggugcuauuaccaccauauuuagagcaaucugugcucuaacacaaaaugauaucaaaacaaugguagcacucuccacuucaagucaacuagaccuuacaauacucacaauugacauuaaucaaccacaccuagcacuucuacacaucugcacccaugccuuuuuuuuuuuuuuugagacggagucuugaucuucugcccaggccggacugcaguggcacuaucucggcucacugcaagcuccgccucccggauacaugccauucuccugccucagccucccaaguagcugggacuacaggcgcccgccacugggcccagcuaauuuuuuguauuuuuaguagagaugggguuucaccauguuagccaggauggucucgaucuccugaccucgugaucugccugccucggccucccaaaguguuaggauuacaggcgugagccacugcgccccaccgcacccaugccuuuuuuaaagcuauauuauuuauguguucgggauccaucauccacaaccucaacgaugaacaagauauucuaaaaauaggaggacuauuuaagacuuuaccccuuacuucuuccucccuuauuauuggcagcuuagcacuuacagguaugccuuuccuaauaggcuuuuacucuaaauaccuuauuauugaaaccacaaacgugauauaccaauaccugagcccuuucuaguacucuuauugccaccuccuuaacagcuguuuguaguaucagaauuauugucuuuguucuaauaggacaaccccacuucacaacucuaauuauuaaugaaaauaaacccuuccuaauucaauuaaacaccuaauaauaggcaguaucuucacuggauuucuuaucagcaauaguauuauccccaccucuuccccccagacaacaguaccaccucaucuaaaacuuacagcccuuaguguaaccuagggauuuugcuagcaauggagcucagucuucuaacuaauaaucuuaagacuauuagucuucuaacuaauaaucuuaagacuauuagucuucuaacuaauaaucuuaagcuaaaauauccauuacagacauucaacuucuccaauauacuggaauuuuacucaaccacaauccauuguacaaccccuugcucaagccaaaaucuggcuucacuucuacuauaccuaguuugauuagaaaaguccauaccaaagacaauuucacagacccacguuacagccuccauuaccauauccacucaaaaaggccuaauuaaauuuuauuuccauuccuuuuuuauccccuccuuucuaacucuacucuuaauuaucuacucuauuaccccaaguaauuucaauuacaacauaaucagcaacaauguucaaccagcagccaccaccaaucaacacccauaauuauauaaagcaccugcacccacagaauccucaugaaucaaccccggacccucacccuaaaaaauuauucaacuuccuacacuacuaaaauuaauuguaaucaccaccccaucauauucaaccauucaucaaaucaacaccaauucuauuaauaacccuaaugauaaaguuccucaaauaucauauuugauccuuaaugucucaggguauuccucaauagcuauugccacaguauaaccaaaaacaaccaucauaccacccaaauaaaucuaaaagacuauuaacccuguaaaagccccaccauaauucaacacaauaccacaacccacagcaccacuaauaacccuaaaccuccauaaauaggagaaaguuuugaagacaaaccuacaaauccuauaaccaaaauaauacuuaauaagaauaaagcauaugucauuauucccacauggcuuguaaccaugacuaaugauaggaaaaauaaucauuguacuucaacuauaagaacacuaaugauuaauauacauaaaauacacccacuaauuaaaauuauaaauuauucauuuauugaucuccccacaccauccaacaucucuacaugaugaaauuuuggcucacuucuuggugccugcuuaauucuccagaccaucacaggauuauuucuggccauacacuacacaccggacaccuuaacugcuuucucuucaguugcccauaucaaccgaguuguaaacuacggcagaauaguccacuauuuucacgcuaacggugcuucaauauucuucaucugccucuuccugcacguuggccaagguuuauauuaugggucacuuaugucccuagaaaccugaaauacugguauuauccuccuacucaacaacuauagcaacagcguuuauaggcuacauacucccaugaggccaaauaucauucugaggcgcuacaguaauuacaaaucuauuaucagccauuccauauauuggaacggaucuuguucaaugaaucugagguggguucucaguugauaaagccacuauugcaugacuuuucaccuuccauuuuauccuacccuucaucauuauagccguagcaauucuccaccuuuuauucuugcaugaaacaggauccaguaacccuucaggaauuucaucagauuccaacaaaaucaccuuccacccuuacuauacaaccaaagauauccuaggucuaauauuucuccuccuccuucuaauaacucuaguauuauuuugaccugacuucccgagcaauccagacaauuacacuuuagccaacccccucaguauccuaccccacauuaagccagaaugauauuuuuuguuugcauacacaaucuuacgauccaucccuaauaaacuagaagguguacuggcccuucuauucucuauucuauucuagcaguuauucuuguacuacauacguucaaacaacaaagcauaauauucugcccauuaagucaaugccuguucugaauuuuaguggcggacuugcuuacagucacaugaaucagaugauagccaguugaacauccuuuuguuaccaucggacagccagcaucuauuauguaauucuccauuuuccuugcccuuauaccacucacugcccuaauugaaaauaagcuacuuaaaugaaacugcccuuguaguacaacucaauacucuggucuucuaaaccagaaauggagagucucuccccaggacaacucggagaaaaagcauucccgcuucaccgucaacacugcuucaccaucaauaccgcuucaccaucaacacccaaagcugaaguuguaauuaaacuauucucuguauucuuuuuggcacauauuuuaacuaauaugucaguauugacugccaacacuaauauauuaguacuccuauguacuuugugcauuacuguuaauccccaugaaugauauaugugcuauaaaugcuugauuguacauaguacauacacacauaaccuuacacuaaagagccauuccacaugcauauaagcauguacuaacaaucccuuaaucaacuaucacucauucagacauuacacucacaugacgaaacucgauccacaugaauaucgaccaguacuggaaacccuugauauuacauagugcauacguucauucacugacguaguguauuucagucaagauuaaccucgccaacauggauauccccuaccaagcuuuggucuguuaaucuaccaaccuccaagaaaucaucaucccucucgggcguguuacucuccucgcucugggcccauaacacuugggagugacuauacugaaacuguaccuggcaucugguucuuaccucagggccaugaaacuaagauugaaacuaagauugcccacacauuucacuuaaauaagacgucuugauggacuagugacuaccacccuauuaaccaguuacgggagcacugucaugcauuugguauuuuuaacuuuuggggaugcugucacucaccauuguggaaggccuucuuugccuuuuuuaaaaaaaaauuuuaaauuguuguugguuuaaagucuguuuuaucugauauaagaauguuuacuccagcuugcuuuuuuucccaguugcaugauacaucuuuuguuaccccuuuacuuugagucuauaggugucuuuagccauuaggugaggcucuuguaggcugcagaugguugugucuuguguuuuuuuuuuuugagacggagucucgcucugucgcccagacuggagugcaguggcgugaucucggcucacugcaagcucugccuccuggguucaugccauuuucccgccucagccuccugaguagcugggacuacaggcgcccaccaccgcgccuggcuaauuuuuugaauuuuuaguagagaugggguuucaccgaguuagccagugucuuguuuuuuuauccaguuugccguuguaucuguuagguggagcauuuaggccauuuaccuucaagguuaauauugauaugugaaaguuuguuccuguuauaguguuguuagcuaguugccuuggagucacaauugaguaauagcuuuauaggaucugugagcuuuguauuuacaugugcauuuaucauggcaaacaucauccuuuuguuuccacauuuagaacucuuuugcgcuuuucuuauaggucuagucuaguggugaugaauuccuuuaguguuugcuugucuguaaaagacuucguuucucuuucguuuaugaagcuuaguuugguaggauauaaaauucuugguuauaguuuuuuuguucguuuguuuuuggagucuaaaaagaggccccaaacucuuuuggcauguaagguuucugcugagaauuucacucuuaaucugaugggauucccuuugucaaugauuugacacuucugucuaacugcuuuuaagauucgcugauagucugaugacuacauuccuugguuauguucgucuuguauaguaucuuccaggugcccugugaauuucuaauaucuggaugucugcauaucuagcaagaucaggggauuuuuccuguuuuauuuccucaaauauguuuuuuuaaaauuucuuacuuuuucuuuuccuucacaaugccuguaaguuguagguuugguuguuuuacauaaucccauauuuuucaaaggcuuuguuugauuuuaaaaauucuuuuaagauuuuaaaacaaauucuuuuuuuuugucugacuggguaauuuaaaagaccagccuucaagaaguuuuuuuuuuuuuuuuuuuuuaaagacaucugucucuuccuucauuuccuagauugcuuuucugguuauuuuuguguugguuuucaaccuucucuugguucucauugagcuucuuuacaauucccacuuugaauucuuucucucauuucugaauuuucauuuugguuguaguccauugccagaaagccagugcagucuuuuugguggugucacaacauucagauuuuucaugguaccugaauucuuaaugcugguuuuuucucaucuagagaaacugacacuuguuguuguuugaauuuacuucauuuaaauggcuuuuuuuuuucucucccccaaccugccuugugccuauagaguaugcucuaggguagagucuuuugcuuugcuuuuauagccuuguguacuuuuguuggcagguuuuauauuuguugugcaauucaaccuacaggccuguaggugguacuuacugguaugagccagcagcagcaaaagcagacagauguguaccugaucuuuguuuauugugagauucacuguguuguuucaggugaugggcuagacaguggaaauucccccauccccugagcuucuguuuagcagugggucagggcgagauagcuggauagagcuggaucgucuagcuugcccacgaauacuccaaugauaagcauaggcacuaguccugauaggggugguugaggucucugcugcauguuagggagcugcacuggcuucauguccuggacagggaggaaugugauguguucccugucacacccuuguucuggggcucgugacucucagugcagaugcacaguguugucugucuccaggccacaguguagccgagagucacaguaaaugccugucaugcaguucuccugggauugguuuaaggacaugagggcagagucuugauggaugaguaggaauuucucuggugggcaagugugggagaccauuuuauguaauagcaaaugcaaagggaugaagcaugagaacacggucuauucagagaaguauagcaaguuuaguuuuuuauaggaguauaaaguaagagguagaggaaugauggaugauaaggcuggacccacggcaugaaaccugacccugaaagguguuguuugcuuuuauaucugaagggauuuaguuuuaaucuagccaaugaugugaaaacucugcagaauuuuuaguauaagugcauuuugaaggauugcccuggcagcagcauaggggcuggauuugaaggaagguaagaugagagcugggaacaucucagugaggaggcacaaugccucuuauggggaaagaagggucugcaccaccagcucuuagacuguggcaaguucuguuauggaaaugugaccaaagcacaccaaaagaauaauaauuaauucucucuggaugauuagaguguaccauggaaauuuuguagaggaagugauauuaucauauaauuaaauggaaauuauguuggguaaaauuguaauguaauaaagaucucaguuuuauucuggaaagaagaaaugcuggauacucauuuuauccuagaaggcaagagaaauuuaguuugaagaguaacucacccucugggguaagaguaugacauggcuugacauagcaguucaaauaauuuugcacauguguucuuggcuucccuuuagauuucagguucauccugugagguugaaaaugauuguagcuaaaauguuauguuaaaugauagguugagugagucaagcaugaaaagccuaauaacuguggaaagcuuacccugguuuacauggggaaaaggauuguucacugugcugaaaagaaaacuggucuuuggaaauggaucuuguuucgguaguuguugugaguccuugggcagaaugguuaacuaccuugagccucaguuauaaaacuaugaaagacguuuacuuccugggguuguuuugaugauuuagugaaauaaagauacagaaauuuccagcacauaguagauuguuaagucuguuuguauuacauuucuccucauaaaguuucuuuuuucuuuucuuuuucuuuuuuaaacauuuuuguuugagacaggaucaugcucuguugcccagacuggagugcaguggcaugauuguagcaccuggccucaagugauucuccugcuucagccuccugaguaguugggacuacaggugugugucaccacaccaggcucauuuuuaaaauuuuuuguagagaugguguuuuucuuguccagacuggucuugaacuccuggccugaagugaucuuccuguguuggccucccaaagugcugggauaauagaugugagccauugcaacuggccuacuuuuauuguuuauauaagauauggggucucacuguauuguccaggccagucucgaacuccugggcucaagcaauccucccacuucagcaaccugaauagcugggauuacaggucugcaucacugagcucaccuaccaggcaccuuuacuuaugaaaauuuucuuuauauauaaauuauuuucauaaaagagguuuucagaacuguuuuuaaugucuguaguuucucgaacuaaccagcuucaaguaauaugccaaaaaauauguuuugggauggcauauucuggucuccugcagucauuuuuugggaggguauguucugagccccaaaaucucucuuccuuucuuuccauuccuuauaccaagagguccaacaggcaaccaagguauucaguuacuuuugugccaaccuaauaagacacuauggagaaacuacagaguagcugagaaagcuacuguguuuagaaggagaaagagcaagguaaagugaauuccaaucagcuuuuugcuguauuagaugaaauaaggaguucagugcuuuuggugacuaaaauggcagguaguugcucaguaaguugcuuuggguauccuggacuccugcuuuuucuguacuugaccuccauaucuagccuguugauauaagucaugugugucuuuuuucucucuuauuuuuucuguguucacugcugcuacuccauggucaugucaucaucauguugccuggauuaucauguagauacugaauugguuuccuucuuccucucuggauguuuauuagagucaccuagcacuuaaaguguuccgcuccagaauaauuaugucaugauggcaaggagagcuagcugaaauacuagacauuuuuuuuaaagccucauuaaucaugugacaucuaggcauuuaaaugucauguccuuuguuuuuggauggucaguuucccuauuccagccuuuucgacaaagguagcauccuuccuacuuuuccuucagguuucaggugagccuucaggggaaucccccgagggcuguccaguggaacuuuccgcgaugaugggagauauuugguaucauuugcauugucccaugcagugguguuggagcuuaggucacgcuaccccaaaauaugacuucaggagcccacaauaugcuacugcaaaauaugucucuuugucauauugguuauuuagaguugguuauuuugagaaacuguagacacaagaauagcucugaaaaguugcccuuuugucagagaaauuuacaucuaugagggaaaucuuuuucccugcucugcaguaggaggagaggggccgcuaaauggaaaaggcauugacuuaaaaacugcacaacaaaucuuacucuuguuuucaguuuuuuccuggccaucccccuguaacagauuuccccaucacccuccacuuccuuuauuuuagcaaaugaugguauuccgcugaaguuuaaacucucauugaaaucuacucuggagauuuacucgguucucuugaauuuucucgcauguauguuugagguauacauaugaaacaacucuuguuaaucugucuuuuguuacagggagucccaguuuaugaagauaaaaaauuauuuuuucucuccuauaccagccacuaguuauugagcacuuaaacuguuacuagugugacugugaaacaaguuuaaauuuuauuuaauuuuaacuguguuaggugcuuuaacuugugcccucacaguacccuguguacauucccccauuauaacacuauaguguauguauucccaacauuuuauuauuaaacauaucgcaaaguugaaagaauuuuacaguguucaucccuauacccaucaucuagauucuaccacuaauauuuuaauacauuuguuuuaacacauaugcaucuggacauuucuguauccaaccauuaauccuuuaaaaaaauacauuucaagauaacaccaguauacauggcccuaaauacuuuaacaggcauauaaccaacuuuuguuugcauguaaaauuaauguauaaugaaacguccauauuuuaaguguguauuugcugaguuuugauaaucacauauaacuguguaacccacaccucuaagcaugaugagaacauuaccagcaguucccuccugccucuucccagucugucuuuucucuuacccucccaagcaaccauuauuuugauuuucuucuguaauguccuucagcaccccaaagagcuuagcaucaugcucaccauaaaggagaaaugcguuggcuacuuaguuuccguacgugccuuugugcacauauuugaauaccaguacaacaaagcaacuuuauuuuugcuauggucugaauauuuguguuccccucaugcccccaauucauauguugaaaccuaaucugaugugacaguauuaagaggcagggccuuaaggagaaggugauuagaugaugcccucaugacugggauuaguggccauaugaaagaggccugaaggagcuuguuuuccccuuucaccacauagggacucaacaagaaagugcagucuauuaggcccucaucagacacugaaucugcugacaccuugaucuuggacuugcuagccucuagaacuaugagaaauaaauguuguuuauaagccauccaguuuaugguauuuuuguuauagcagccugaauagaagaacugagacaauuuucuaagaagauacagcuauccuugcagggaagaaauucuuacccauacccuaauggagaagacuccugguuccaucagucacguauccaucacuggcuacauaaauuacuacucuuacuccaucaccaucccacucaauauucaguuauauaaagacuaaauuguaaaguuaacuucaguaauuuguguauaaaauaaaauugggaauuagggagaaaaauaugguuaguacagucaauucuuguuauucauggugguuauguucuguaaagucaucgugaacacugcauuagcaaauauugaaccauuucucuuaggggaaauacaggguuaaguuucugcaagccucaaaucacaacuuaugucaacagaucaagacauaaccuuguuuucuguguguuucuguuuaaagacaccuuacuauguaugguugaucuauuaacauugaacuuacagcuaauggcagugucuuucauauuugaagaaagcuuaacuaaaacacgauuuuuucaguaagguacagcccagcuuucaugagcauaggaacaccugacaguacuucaguacuaugcuugggagucacucaaaguggugaaaucagugacaggaagcauacacaaaaaaguggcaccaaaugcacaguggaaaggacaauuguuuauacuaugaaagcugacacaggaagauggaguguuaccuuguucagccucagcuggaacauaugcuuggagugauuucaguauuuugcuacccugaacaugcauguguucuugaaugacugaaaaugcugugaauaugaguuuggggauuacgaaugaauuuuagugcauaggcaaauucacaaauacagaaucuaaauuaugaagauugacuguauauacaaauaaacauguauauaaucaaagagaaaauaugcaaagcuacugcauagcuugugucuguaacuggucugaggugguagcugaaauauguggcuuccuucaucuacucccuguucuauagcucucuugccuucugccagaauuucaguuacucuggcuuuuuuuuuuuuuaaccugauugagugacucauaaacuuuccuucuugaagggacugugucuuauuugcucuguuuuuugguugcuguaacguuucauuaaccuuguauugagcauggaaguaguaugacaugcccuaggcaaucuucuggguuccacuuacccuacuuugccuccauugcaaaauagcacacuuguuugcccuugguaauucggauucauuuuuccaacuaguagauuaaccaauguuuuuggcuuguugguuucagugacauaagaaguacaaaauggccauaugggagucucaucuuccaauuaaucggaaacauuguuguguccccuuuggaagcauuucuccuuuaaggacuaagaucuccaaaccaucagagcucaaaguugccaggacuagaaacagaaauuuugcaaguggcuuauguggguauaauaaugagaggagccaugccugcuucuacuuuuugauuccuggacugacauauucuggcugugggcaagauagcaucauauaauggucugugauugaaauaauaaacugcagcuuguaaaacagagccccauccuuucagguuuuugucuccuaacuagugcugcugcugaagucuucaguaagccauucuaugugauggaguaaugguaaaaccaguuaaucuuagugucaugagcacauuguccaccucuuuugcuaugaagugaauuccuuaaggagauacagugcuguauagaaugcuguaaugauagguaauacauucugugagucuaugaaugguggaguuggcagaagcauugcaggcaaauucauaucuggaauaugagaaacggauccauuauggaagagaaccaaauaaaaucaaucugccacuagguggccagcugucucuuucccacccauggugccauacugggaauucaguguuggucuccagcauuggcagaucagaugcucugcaguagcuuuagccagaucaguuuuuucaguuuuagaaaggacuaaucuguguguguguguuuuuuuuuuuuuuuuuugagacagagucucgcagugucgcccaggcuggagugcaguggcaugaucucagcucaccgcaaccuccaccucguggguucaagugauucucaugccucagccuccccaguagcugggauuacaggcaugcaccaccacauccagcuaaucucuguauuuuuaguagagaugggguuuugccacguuggccaggcuagucuugaauuccugaccucaggugaucuguccgccuaggccucccaaagugcugggauuacaggcaugagccaccgcaccuggccuaaucuguguuuuugaacccauucauaaucuccaucccugccaccauggccacuuuguucauggguccauugcacaagcuuagauaugauggagaaggagguugagugccacccauagaguaugucauuuuaucuaccugauuauuaagagccucugcauugaugugcccaccuagucucucaugguucagugcugcugcuuaaguuucugugcaacucuaaaaucccaucauccgcacugaauucaacuuaucucaauauugacuuccuccuguagucauaccuguccuacaaaggggagugacaagaauuuugaaaaccuuguuagguggucccucacuaauacauuucucccucucucucucucucuuuuuuuuuuuuuuaauuuuguuucagagacaagguuugcucugucuccuagacuggaguauaguggcacgaucauagcucacugcagacuugaacuccugggcucaaaggauccuuccuccugccucagccccccaaguauuaaauagcugggauuccaggugugugccaccaugccuggcuaauuauuuuauauuuuuuagagaugaggucucauuauguugcccgggcugcucuugaacuccuggccucaagcaguucuccugccuuggccucacaaaguguugggauuacagacuugagcuacugugccuggccacuaauagguuucuaaaugucuuaguaaaaggaguguuuucuaggcccucucauggacauaaguggcaauuugguguguagguaacacaugauaaauccaguccaaccuuccuaucucucuaaaccuuuggaucccucucucuuauuaugcuagggaaacuuuggaaccucagccuuauuaaauguuaaauuaauauaauuaaugcuuaauuaaauuaaacuucaaguuucagucagccaaucaaguaagcuguuaaagccacuuccaguuuugugaguuaacacauuaaaugugggaucucuaguacagaaguagucaaaccuuuucuguaaagggucagauaguaaauauuuuagguuuuagaggccauauggguuuugucacaacaacucuguucugcugcuauagugugaaagcagccauagacaauauggcccauccauuaaugggcauggccccauucuaguaaaacuuuaguuacaaaaaacgguuuguugaccucugcuuuauaaguauauacauauaaaugaauuagagccaauguaguguuauauuucacccuccuggucuagcaccuuuagaauccauugccauacauguucugugggauugugcuaguuuaucagcagaucuuuuaguguguucagcuacuuccuuugggucauaguauauaccuguucuucuggagccugucaaaauuugacauggguuagugacaauggcagugguuagggugugucuugaggaggacugaacauccucuuuuaaggcauccaccauggguaaagcuguccucagguuuuuaagcaguggaagagucaucuccucagacaaggggggaaaacuacuucugguaagggagacucagacggacuuggggguucaaguuggucaguuucauuuggguccaaauaaauauucccauuccaaauuuaaggauuccauucuuuacuaaucuguccccuuucacaggagaaacuuggugagaccaugaauucagcuauuguuuuaauucagcaacccucauaauuaaauuaaauuuuauauuugauuuucagcuaaaucagcucuaagaccaugacuugaucugaaaguuggaucugagcugguuauuuucucccuguaggugccccagugcagcaguccccaaccuuuuuggcaccagggauugguuuuguggaagacaguuuuuccauggacuggguuggguagggggaggauaguuucgggaugaaucuguuccacuucagaucaucaggcuuuaguuagauucucauaaggaaugcacaaccuagaccccuugcaugcgcaauugaugauaggguuugugcuccugugagaaucuaaugccuccacugaucugacaggaagcagagcucaggugguaaugcucucuggcuugccgaucacuuccugcuguguggcccaguuccuaacaggccauggacugguacugguccguggcugggggcuuggggacccugcucuagugcucucaaaagaacccaccccacaucaaaguccuuauuuucauaauuucugccauuauggucaguugcagcagccacuugggcuucuaagacaugucccucaguacuucauuacagucaaccaaagugauagcuuaguuaauugugacuccaauaccuacuguggauuacuagcauuucaucucccauuggcgaggaacuuagcacugcacugaagcccaaggccaugaccaaaccaguccucgaauugcaucucugugggccugucuccuaggacugcucccaauaccaauugugugucacucaugguccguugaggagagaccgaaaucauguaguuacuuagaaaggggaaguuuaaucuaagaacuguuaaguugugauaggagaguaacuaaagauguaaagagaacucuaacggauauucuaggacuaagagccucaaggaaggaccaacuugcaagagggguccccucuaccaggcugggguuuagagcuuauuggagaagguauagcuguagcccagguuugcugguggagaagauugcuguguggcugguccauaguaauugggcaagcaggaaacaauccuuucauguauaggugagcgaaggcugguuagccugucuacgaagggaguccaggugcuucugugggugugaaaucuggagugugugggcugagguugccagaucacugaggaacuggaccccugggcauaagcuguggcuaaguaccccuggauguccuccucauccauaccaugcagcaggaaguccaccccaugacagaccaugcagcaggagccagaagacaguaaaaugcaccaagcagaacuaggaaguguccuuucugcaguguugcuucagugcccuguacugacaaagcauaacauuguacucacuguaaagaggaaaugccugcaaacuccaggccuuuauugcagugcagguaccgaaggaugaauucagagcggagaggcaacauauugauaauuggccuaguccaucagaucauguuauugauuccacaguaguucccuguuuuaagacaaguaaauauucaaagcuguagacagguccucuacuucuuugaccucauacuacuaucuuccucuuggcucugcugcagccauccaggccuuucuccuguuucuggaacauaucugcaugcucccgacuuaggacccuugcuggucccucuuccuggaagcuauuuuccuagcugucugcauggugaguuccucauuuuuuucaagucuugcucagaugucaguuucucaagaaggccugcccuuuacgcgcuuauuugcuacucuaaguccccugaacuccuuaccucuucacauggcuugacuuuuuccacaguacuuuucacccaacauacuauauaauuuacuuauuuaucaugucugucuccucccacgauaacaucaggcgccaggacgguaugaggggcaggaguuuuuuaauguugcucacuuauugcagauaccuaaaauagugccuagugcauuauaggugcuuaauaaauacuuaaauauuguaacagucucuaugauguucauuaaaggugagauucuaccuucaaacaauuuucauuuuauuauucaaaauauuuuuacuacuucugcauuacacaacuucccuuuauuuucuggacugguuacauucuuuugacugauuaggucaagauggguacauuuuuugucuugugcuccauauaaugaaauaggguuuguauuuuauguuacguucuuuacaucauuuuucagcuucugugacuuuucucaucugaguagaugacugagacagauaacuauuuuuaauauuauauuuuuuagaauuaaaucuuaguucguggaaaguuaacugauuguuuuuaauuuuauuuuuaggugcugaauguggaguaaaugcagauguugagaaacaucuugaauugggcaagaaauuacuugcagcuggacagcuagcugaugcuuuaucucaguuucaugcugccguagguuuguaucauggaaccaaaucacucagugucugucuuagugaauucuaguaauagcucuuuuuuuaaaaauaacauuuaaaauaaacauuauuucauguuuaaauaaaacauuuaaauauauuugugggauucugagcgaaauagauggauaaaauaaauauauaacacuuaaauguaugugcaucuaacaugagagaaguuugaagguuagugaggccugcuacuaccaaggauaacucaagauauuucugacaaacagcuuuucucaguguauuauuuggcuucugacuuuuuuuuuuuuuuuuuuuuuuugagacggagucucgcucugucgcugucgcccaggcuggagugcaguggcacgaucuuggcucacugaaagcucugccucccggguucauaccauucuccugccucagccucccgaguagcugggacuacacgcgcccaccaccacucccggcuaauuuuuuguauuuuuaguagagacgggguuucaccauauuagccaggauggucuccaucuccugaccucgugauccgcccgccucggccucccaaagugcugggauuacaggcgugagccacugcgcccggccagcuucugacuuuuugaacagauuuuacugaaugcaguuuaauuuucuugaugacuuggguuuucaauauguucacuugauauccuugggagaugcugcaguucauugccucuucaguauuggucagaccccagcugcucuucauuuauacuguugcuucuuauuucuuacucaugucugucuguagaaucaacugucgugcagcugcucaucuguuaggacuguaagaagugagaugaccagaauaaauagguucuuagugaaggcuuaauggauuuucucuccuuuucuuuucuuuuuuuuuuuuuuugcuuuuuugagacagagccuugcucugucacccaggcuggagugcauuggugugauuauggugauuauggcuuacugcagccucagccuccugaauagcugggauuauaggugugugccacuauauccaacuacuuuuuacaacuuuuauuuuuuauauuuuuguagagauggggucucacuauguuguccaggcuggucugaaacucgugggcucaagcaguccuccugccuuggccuccuagaguguugagauuguaugcaugagccaccacaucuggcauggauuuccuuaugagucacugcuaaacuuuuguacugggacuuuuugaacuuuccucagaguucuuuacuuauauauuuuuaccuugauuugaaugguugagaguguguaguuaacaaccgagggugguguuuuguuuuguuuuguuuuguuuuuguuuuuguuuuuguuuuugagacaggaucuugcucugucauccaggcuggagugcagucacgugaucuuggcucacugcaaccucugccuccugggcucaggugauccucccaccucagccuccugaguagcuaggacuacagcugcaugccaucaugcccagcuaauuuuuguauuuuuuuuuaauagaaacuggguuucaccauuuugcccagccugucucaaacucuuguucucaagccaucugccugccucagccucccaaagugcugggauuauaggugugagcuaccgugcccagcugguguguuuuuuaauaagauacagcugugcucccagaaaaacuaucauccuauuguuguaauuuacuauauaaacucaauguaguuagguuuugguuugucauacuuuucuuuaugcuuuuucuuaaacucagauuuuuauuauucagauuuuuauuaaacucagauuuuuauuagcucucugaacucauaggaaacauauuuuuuugaugaaaaaacucuauucaaggcugggcaugguggcccacgccuguaaucccagaacuuugagaggcugaggugguggaucacuugaggucaggaguuugggaccagcccggacaacauggugaaacuugucucuacuaaaaauauaaaaauuagccaagcguggugguggccaccuauaauccuagcuacuugggaagccaagacuggagaaucacuuagacccaggggcccggagguugcagugagccaagaucgcaccauugcacucuagccuggguggcagagugagacuccaucucaaaauuaaaaaaacagaaaacaaaaacucuacucaagagacauggcauaauuauaagaacauacaaaaguugaaaaaugaggggaaaaguggaaaaaaagauaccuuugugaguaguagagaaagccauuccacgcaaauaaaggauucacucuaccagaaaaaauaucaauuuuaaauggguauaagccuaauaacauagccucuaaauacauaaaacaaaaauugacagaacuaaaaggagaaauaacaaauuuauaauuacaguggaaggcuuuagcgucuuucaauaauauauaggaaaacagacaaaaauaacaguaaagauguuaacgacccaauugaaauacacauaacacuuggacacagcuacagaauacacauucuuccaaguguaagaacauuacaauaaaaauauuauaggaaagucucaugaacauaacuacaaaaauucugaaaaacauaauagcaaaugaaucuaaaguuuaaagaaguccacauauuauguuuguacacacaaacacauacacacaccacugguuucuauuauaaggauguaaauuugguuuggcauucaaaagucaguauuagucaucacauuaaaagacuacaggagaaaaauauuauuucaaaggugcagaagaaauauuugauaaauauuuaacaccauuucugaaagaaaaagcaccuuuuaaacaguuugggaaucuguauuggugaguacaccaagaauccuauagcuaccaucauacuuuauggugaauauugauagcucuccccacaccucaccaccacugagauugagaacgagacaaggauacccacuauuacuacuuguaaucaacauucugcuagagguccuagccaaugcuuuuuucuuuuuuuuuuuuuuuuugaggcagagucucgcugugucacccaggaagcuggaguguaguagugcaaucucagcuuacugcaaccuccgucucccagguuuaggcgauucuccugccucagccucccaaguagcggggguuacagucaugcaccaccacguccagcuaauuuuuguauuuuuaguagagaugggguuucaccauguuugccaggcuggucuugaacuuccugaccucaagucauccacccgccucccaaagagcugggauuacagacaugagccaccgugccuggccuagccagugcaauuuguauaccaauuuucugucuugcaaccuugcugaacguguucauuagcucuaauaauuuuuguguugguguugauucuuuaggauuuuccauauacaagauuauguuauugggaaauuacaguuuugcuuauuuugucauggaaaggacccagugggaaguaauuuaaucacgggggaaaauacaguuuuacuuauuuuugucaugggagggacccagugggaguuaauuuaaucaugggggugguuacccccaugcuguucucaugaaagugaaugaguucucauaagaucugaugguuuuauaagggacuuuucccccuuuugcucugcacuuccccuuccugccaucaugugaagaggaugugucugcugccccuucugccaugauuguaaauuuccugagggaaauuuacucaugccgaacugugagucaauuaagccucuuuccuuuauaaauuacccagucuccgguaugucuuuauuagcagugugagaacgaacuaauacaauugcccagccccuguaauuuggcaagaaauagggcauaaagauugagaaaggaagaaauaaaacugucauucacagaggacuugauacacaaauaaucugcagacuaucauaacugaaaugaauuuagcaaggccacucacuagauaacaaauucaacauacuuuuguagcaacagagucucucuauauuagcaauaaacaaauauaaaaaacaccuaagaagaaaucuaaugaaagaugugcaagaacacuuugcugaaaaccacaaaaauaguuauaagaaacuuaagaaagacuuaaaugaagagauauaccauguucaugaauaggaagauucaauauuguaaaguugucaaguggcccccaaauuggucuacagauucaaugaaaucuaaucaaauucuagcacuuuauuucauugaaauugacucgcugauucuaaaaugucuuauggaaaugcaaaggacuucuucaugaguugccuuguggacgagauuuaagacaacccaagccagcucucuuuggucugugagaagcauacauguauucuuugccuugaccaugucuguagacagaggacaguccaaauagcaaccccuucuuccuucuuaugagagcagagagccugcuagucucuugccauuuagaguuuucagggaugagucagauaccccagucagucuacucuguccugcaaagaggacacuuacaaacuuuuccaaguggcccuagaaaucucaccuuggaauguagggguagcugguaccuguugggaugucaggugaaacauaaauaguugcauugcaguagccugcuguauaaauauacggagaacuucuaucguauguacucuaugaagguauuagaaaaauauggcuuuguggauuaccuugaaaagggaaacauuuuaaucuuggcguugccacuggguaauccugugacauugguccaguuauguaagaaaaugcacacuuuaaaaaguuaccugcaaguucccagcaguuuuugcugugucacccaugggaauuuuugugaagaucagaugguaauaaugaauauaaauauuucuuugaaaauaguauauaaucacucaggaggcugaggcgggaggacugcuugagcucaggugcagugagcuaugauugugucaccacacuccagccugggcaauggagugagacucugucugucuccuucucugucuugcuuuuuuucuuaaaaaaaaaaaaaaaaaggugcaguaggauauguaaagaauguagaaauauaauuuuugugucucugaaaauuaaggcuuuucuaaaaacagguuugcuauaauaacagggguuucuuaacuaugugacauuucuguugggaaguuugcauuucgaugacuaacucaccuuaagaaauagugguuacuuugcacaauaauuugcacaagauuuuucauuaagggcuguuuacugugugaccacaucguuacuaaguccacuauuuuucuggugauucaaacugucuucagugcuucagcauggcaauuuaaauucuuuucaguuacugucuuagaaaaagugugucuuaaaguauuuauucuuaccuacuaccauuagaauguuugcagaaauguauauaccuucuaccuauuuuauacuuuauuguuuguuuucuuagucucacauuuauuagaaacaucaagggcuauggcauauaauuaaagucgguuuaaaugacugcuccuuuuuuuuuuagcuuuaucacugcaauacaagacuuuuugagacagcucuuucccaaaauucccaguaaaauguuacuguguucaccaagagguguaaaucagugaugcugaaacauggcaauuuauuggugugauuuaguaaagggagaauguaaauaauugcuagugcauucugaaucugaauaacaggcagugugguggcuuacaacuguaauucuagcacuuugagcacuuucgaaggcugaggcaggaggauuguuugaggccaggaguuugagaccaaccugggcaacauagcaagagcucgucucuacaaaaguaaaauaaaaacaaaauuagccaggcauggcagugcccaccuguaguccuagcuacuugggaggcugagguggaaggauugccugagcccaggaguuugaggaggcagugagcugauggugccagugugcucuggccuggacaacagagugaaacccugucuccaaaauaaagugucauuuuguucaaugugaucuggcaaguagcagugacucucaaaugggauacacaucauaguuucuuuuucuuuuuuuuuuuuuuuuugagacggagucucgcucugucaccaggcuggagugugguggcgugaucucggcucacugcaaccucugccuccuggguucaagcgauucugccuuggccuccugagcagcccgagcagcuaggaguauaggcaugcgccaccaugcccagcuaauuuuuguauuuuuaguagagacgggguuucaccauguuggcgaggauggucucgaucucuugaccugaugauccacccccccuuggccuccaaaaauguugggauuacaggcaugagccacugcgcccagccacacaucaugauuucuaggaagaccauuuaucauuuuaguucauguagaacacauuguucauaacaaacuauagaaaauaaaguuuaaggcugggcgugguggcucaugccuguaaucccagcacuuugggaggcuaaggugggcggaucaccugaggucaggaguucgagaccagccuggccaacauggugaaaccuccucucuacuaaaaauacaaaaaguuaaccgggcgugguggcaggugccuguaaucccagcuacuugggaagcugaggcacgagaauugcuugaaccugggagguggagguugcagugaguugagaucaugccauuguacuccagccugggcgagagugagacucugccucaaaaaaacaaaaacaaaaaauccccagaaaauaaaguuuaaauuuucuaucauagugaaaugggaggguuuucauaucucccuugcagggcgugcaacaggguuguggcuucugucuucggggccccacugcucagacccuuacugggagcaugcagaugggcaggugcagaggccguggggagugcuuuugggcuccggccccacggcaaugucuaggacuccugaagcccaaguggguguguguuacagugugcugcuucagcuacgccaucugcagacggcuuguguuagucagcucaguagacccucucccuuauugcaaggacggggccagugugacagccugaguucuugcucgguuguacuggaagaaucagaucauauacaugggcuggaagguugagugcaagguuuauugagugguggagguggcucucagcgagauggauagggagccggaagugggggauggagugguaagguggucuuccucuggagucgggcugcccagcggccagacucuucuauggccacuccuggcugaacuccccucagcauccacgucguucugccaucgcugcucugccagugucugcugguaugcucuucuucuccucuagacauccagccauuuguaucugugucugcuuaaggucucugauuuauaugggcacaguauggggugcguggcuggccagagugaucucggaaaaugcaacauuugggcaugaaaacaggagugccuguucucacuuagguccgugggcacaggcccaagggugcagcccuaccugggaccccaccccucucuacccagcacuucccugccccccucccauaucaauaggauuaugcaguagguggugaugggguguugugaccuuuugaaacucuuaagagaugugcguuuaucagaagagaacuauggggauaaugaauccugggaucugaaacccuaaauuuaauagacuuuacagagggucuuagguauaucuggcacgaacaaaugucuuaagugguagauuaaauggugggcagugugaaaugaucgauuucuucauuugcuugguaagaaaacuagcacaacccuuacauaguuuugcugaauccaaaaacaaaauccauuucuagauuuuuauaucacuuaaacuuguuauggugcuuucucaucacauuucaaccucacuucugaaaugaggacaaacauuacuguuuacauuuagacaaaaggaaacaaaaagugcucuagcaacuuucugaaggugauauuccaguucaaaagauucugagcuaugcuacuauuuuaaugucuggucaguucaguaaauuguugaaugaaggaguucaguugggugagcugagagaaugaguaaaacauuuuccguaucuagaugauaugguuuggcuguguccccacccaaaucucgaauuguagcucccauaauucccacauguuguuggagggaacuggugggagauaauugaaucauggggaugguuccccccauacuguucucacaguagugaauaagucucacgagaucugaagauuuuauaaauucgcuuggcucucauucucucuugucugcugccauguaagaugugccuuucgccuucggccaugauugugaggccuccccagccauguggaacugucaguccauuaaaccucuuuuuuuaaaaaaauacccagucuuggguaugucuucaucagcagcaugaaaacggacuaacgcaccaguccaguguguuuuuccuaugccucucacuaccaccauuuacaacaucauuuguaauuggcuuucugauguguuuucuccagauaguaguuguauuguuuuauucuggcuaauuuucucauauuugaauuguuugauaguucuaggauucuggguagagguuaaauccaucucccauguucaaguuucuaauaagcuaguauaaggauuugaauuaugugguuuaaaaugaaauauaguauuuccauauuuccacauguagacuugcaaauaauuuacauaaugaacaauauuauauauuggauggauaauaggaaaaauacuuauuuucaagguuauccagucuuguauugguaaaaacuaagcaugcauuucuaaaccaauucuuguuucacuugcuacuucaugcacagugauguaggaauggacucuaguuccauuaacuguugguauuuuaagaugaagaaccagggaaggcuauuuugauuuacugugcaggugaccccaugccucuaagaaaauugagacggagucucgcagugucacccaugcuggagugcagugguaugaucucagcucgcugcaaccuccacuuuucggguucaagugauucuccucuucagccucuggaguagcugggauuauaggugugcaccaccaugccuggcuaauuuuuguauuuuuaguagagacgguguuucaccauguuggccaggcuggucucgaacuccuggccucaagugauccacccgccuuggccucccaaaaugcugguauuacaggcaugagccacugugccuagccagaaaauugauucuugauucauguguuaaacuauugucauuugauucucaguggacaaaaaaauucaguuucuccuauuauauucuccccgugcagaauucuucugugaccucuggucaccaaaaugugugggaauuucucuccaccaaguaauccuacagauucuucagcagacagcagcuggauguccucuaauucuguucaguucugacacugucuaucuggagguagccuaagaucccacagauugagagcucagugccacaagaccacuccugacuucagaagccauucauaaggcccugguuguuuuaccuguacuucugacugacuggcuguaaaugaggauucccaugaccccuuccuuggguucaauuaauuugcuagagcagcucacagaacucagggaaacacuuacguuuacugguuuauuaugugauauuacaaaggauacagacgaacaaccaaauagauggaagagaugcauagggccaggcauaugggaagggauauggcgcuucuuugcccucucuggguguaccacccucuaggagccuccauguuuuuggcugcauggaaguucuuccaaacccuguccuuuuagguuuuuguguacacauuaucacuuaggcaugauguauuauaucauuggcuguugguaaccaacucaaccuucaacaacccgaggcuuuaucacuuaggcaugauguauuauaucguuggcuauugguaaccaacucaaccuucaacaacccgaggaggguacagaguacucaaaguuccaaccuuuucaccugguagguuccccuggcaaccagcucccauccugaaacuaucuagugcccagcuggugcccagcuaccagccguuucguuaguauacaaaaaaguaaucacuccagagaucccacggguuguaggagcuauaugucaggaagcuggaagaagaccaaauauauaucuuauaguacaacagauuccuuauuuauguagauuugguguuauaaauugggguuccaauuccauuuccugucuuaaaaugccuaaaaacugaacaguagaauuagugagcacuccagaaauauuguauguagacaauuuuuguguaugaugggauccuuaauacaaaaguuauacacaguccucuguggagauuuuuucuucauggauuggaauggucagguuuuuccaaauagaaaucuaauguaguuuaccguauaccauguaaaugcuguguaaauaguuguuuuacuguacuuuuuagggaauaaugaaaaaagucuguacauguucaguacagacacaguuuuuuuuuuccuaaauauuuucagucugagggugguugaaucuacagauguggaacccauggauacagagggccaaauguguauaaauaauuaauaaucagugcuuaggguuaggugcaguaagggauauguauuauagaauguuauggaauuugagagaaggaaagguuuauuuuuccauguauagucaaauaagucauuugagcugugccucaaagauugaguaggauuuggacauaugaaauugaugggguuguguacuuuaggccuuaaaucaucguauuuccaguauuauucuuugcuuagugugaauaagccauggauaacuuaaauuuuuuaaaaaacuaaugaauaugaaaguaauccauauguauugugaaacauuuuggaauacauggacuacagaaagaagaaaccccaucucucugcuuggauagccacuguugacacgcagugaacugccuuugcugucuggugcgucacuuaaauguuaguaauucuuaaguaugaaaucauucuauggccaguucacaaaccagacccauaaaauuuuaauuuauuguaccuuacaaauaaaauauaagcugaacugaaaaauacuguauaucaagcaaguucuaaauguaguuacucugauuccuacucuuuccucaaguuaauuacaguauuuuguaagaaauauccuauauucaggcuacugauuuugcuguccuguccuugccuccuaaaggaaguuauuuaguaaagaaauguuagugacgcuuagcugggaucauauauuuuuauuuuuagauuuaagaaaaagaagguuuuuuuuuguuguuaaaauaccuaauuccuuuuuuaaaaaauacauuuuuuuuuucugacugguucauguuuuuacuuuuuuauugugguaaaauguaugaaaauuuaccauuuuaaccauuuguaaguguacaauucaguggcauuguguucacauuguugugcagucaucacuauccauuuccagaacuuuuucauuaucccaaacugaaacucugcauccauuaaacauuagggcccuauuccuaacccuuuacaccagccccuggcaaccacuauucuaccuucugucucuauuauuugaauauguuagguaccucauauuagugaaaucauacaguauuuuccuuuugugucuuugcuuauuucacuuagcauaauguuuuuaagguucauccauguuguagcaugccuaggaguuucauuucucuguaaggcugaaugaauaaccugcuguauguaugguauaucccaccuuuuguuuauccauucauccacugauggacuucgggguuguuucugccuuuggacuauugugaauaauacugcugugaacauguguguuugaaugcauauuugacccuucuuuuuauuucuuugggguauauacacaggaguagaauugcuggcccacauuguaauuuuacauuaaauuuuuugagaaaucaucuuacgguuuuccacagugccauaccaucuuacaucccaccaacagcgcacagguguuccaguuucuccacaccuugcgaacauuuguuauuuuaucuuuuuauuuuucauaauagccauccuaaugggugugaauugguaucucaauguguguguuuuuuuuuuuuugguuuugcuuuuuuaguuuuuauuaguauuuuuguucccccaugcagaucaaugugguuuugauuugcauuuuccuaaaaacuugugauggugagcaucuuuucaugugcucuuuggccauuuguaugucuucuuucauguuugguuguauagccuaaucucuuuuucugacccaccuuccccuggcauuuucaaugccauuaacaacuguucacaaccauaauuuugaaugauuauggacuguccugccguauagauucuucuauuguaauguuuuccaaaugacaagaacuuuaggaguagaacuuuuagggaguuuaauuguauaucuuaugaugaugaacaccugaguagauaaaucuuuuauuuuuaaaagauugauggcuggcuuuugucaagguuaguuuuagaauucuuuauaugcuucuauuuccaaaugcuuuuuagaaggauuguucugcagcagauuugcuucugacugaauccacucuuuucuguacuucguaggugcugauaagcagaguaaaauuagcucggaaaccuaauucaucugucugcuuuccuuacaaauguuaacuucucuagccccuuucucuagucucacucucauuucuguucuccuccuuuguccuuguaccuuuauuucuucaccuccauucuaguuggaguuugugagggagcagagauuauacauucaauauaucaauuuagucagagguuuauacauuucuaaaacccuggacaccaaugugcauaguccacauucuuaguauuucacuuaggagaaucuccauagagacaaacugaauugcauacuuaacaaaaguuaugaguugaggcugggugcaguggcucaugccuguaauccuagcacuuugggaagcugagguaggaggauugcuggagcccaggaguucaagaccagcuuaggcaacauggugagacucucuacaaaaaauuaaaaaaaaaaaaaaauuagccagccgugguggaauacgccuguugucucagcuucucagaaggcugagguggcgaauacgccuguugucccagcuucucagaaggcugagguggcaggauugcuugagcgugggaggucaaggcugcagagggccaugaucaugccacugcgcuccaaccugggugacagacaccuuguccgccccccccccccccccccccccccgccgaaaaagguuauaaguugaauauaguuaauauucuagaccagggguuugcgaacuuuuuuucuaaagggcuagacaaguaguuucggcuuugcggccacagucuuauguuuuucuuuuguucuuucuuuuuuuugggcaacuuuuaagaaauguaaaaaacauucuuaauugaagucuguaggucggauguggcuugggcuguacuuugcugaccccuauucuaggucuauuugcacugaucuugcuaggcaacaugacucuuuuuugaugaugagauucuuuucuuaauguccaucuuaguagaguugcaagugcugauacuguccaggugauuuguuuuuuuuuaaauuuuuauuuuugaauaaaugacuaagagguaauauuauuuuaauuuucagauggugacccugauaacuauauugcuuauuaucggagggcuacugucuuuuuagcuaugggcaaaucaaaagcugcacuuccugauuuaacuaaagugauucaauugaagauggacuucacugcaguaaguauaucucaacuuucuuuaaaggggaacuuaacagaacuuggggagagauaauuuguuucauaaggugaggacuggcaugcuagacauagcuggaagagaucaaagcuacagugauguuguggacugaggaacaagagaaauucaaagucccuagaaucaaagaucugugugaaagagaacagcggguacauuagauguuuuuuuuucagaagucuggcagugaugucagcuuugugguuuagaaagacaaaucuguguggaggcuggagugugaggcaagaugugaggcugagacaugaguugaugaagaggcugaauuaagaugcuaucaggugacuggcagcaguugcacuuaaggcuguaccaggaagaauaaaguggggauuacuuaauugggcuaugauuuguggugacaauaaaaugcuaaauuagcagagacauccccuggaaccaauccacaagcuucagagguggagaaacuuguagccuaguaggaaauccugaugauuggcaggucaccauaaagguugugacagaugugugaacagggagggacucaugagguagaacucagguggggcuuucagaggcagaauugacaaccacugaucaauuagacgguuucagaaguaauuugauagccauuuauuauuuauuuccuacuguauuucgagaaggauuugagauaacugauuagauauggggugaauguuugauuugaaauauuacuaauauuuuaagauggaauucccaaaucucaaauauuuuucaaauuuaucuuacacagcuaagcaagcacaaccuuucacaaagguuaaauggcucauuuucuuaguauuaugauaguuggaguggcuuuuuuaugauaguuuaaucuugcuuuuuauuguauugaugaauuuaacaggguuaggaaaauuuuauuuacuguaaaaguaauguauauaggguuaaguggaauauuaauguggcuucauuggucauccagaguugguauucuugaaagaaacgggauuacacacauuagaagaagaggaauaucagaugaagggggagaaacuggugcauguuagaagggaagagucauugguaaagucccaacuuacgcaacuuuuauuguagggcaaaaaguauuuuuaaaaauugagauauaauuuauaugccaucagacuuacccuuuaaaaguauucagugguuuuuaguauauucacaaguugugcaguggucaccacuagcuacuucuaggacacuuuuaucgacccccaaagaagcccuguaccuauuagcggucacuccccauugcuccccuagcuccuggcaaccacuuaucauagauuuguuucauauaauguaacaucguauaauguuuggccuuuugugucugacuucuuucacuuagcauaguguuuucaagguucauucauguagcacauaucaauaugucauuccuuuuuauggcugaguaauauuguauggauauauuauauuuguauauugauuuaguugaugggaauuggguuauuuccacuuuuuggcuaucauugugaacauacauguacaaguuuuuguguggacauguuuucaguuuucuuggguagaacaaaaaguauuuuuaaggaagcauacuuuaagaaaaauuauacacauucauugguuccaggaauuauucuuggugucaagucagaugugcacuggaaaaauaaauauuuauuaauaauuuguuuauuuaguuuuauucuucguguuuaaaaaagauuuagaaaucuauaauauucaagauaauccucugcccccuuuuuuucuaggcaagauuacagagaggucacuuauuacucaaacaaggaaaacuugaugaagcagaagaugauuuuaaaaaagugguaaguucaauauguauuugacucuaggaagauguuauuuugagagaacguauuugaccuuuuuuauauuaugacaguuaauaguaauuuuauagcuaagagucaauagucuuagacaguaaauagagaauagccagauuuauauauuuaagaaucacaaauccugaauuacuauuugauggcagacaucaaagaauccuguuaacaguuggaagguaaagcguacccaauagauauauaaucuuaacucaguuuauacagcuugcuuguucugcuuuguccaccaugagaaucuaaagaugucagcugaacuacuuuuaaagcccuuguuaauccuuauuaggcuuuggaucuguccuuuuggagauccuucauuugauuugagaggaguaaugaaacagauucuuuuuuuuuuucucuuuuuuuuuauuauuauuauacuuuaaguuuuaggguacaugugcacaaugugcagguuuguuacguauguauacaugugccauguuggugugcugcacccauuaacucgucauuuagcauuagguauaucuccuaaugcuaucccuccccccuccccccaccccacaacaguccccggagugugauguuccccuuccuguguccacguguucucauuguucaauucccaccuaugagugagaacaugcgguguuugguuuuuuguccuugcgauaguuugcugagaaugaugguuuccaguuucauccaugucgcuacaaaggacaugaacucuucauuuuuuauggcuguauaguauuccaugguguauaugugccacauuuucuuaauccagucuaucguuguuggacauuuggguugguuccaagucuuugcuauugugaauagugccgcaauaaacauacgugugcaugugucuuuauagcagcaugauuuauaauccuuuggguauauacccaguaaugggaugguugggucaaaugguauuucuaguucuagaucccugaggaaucaccacacugacuuccacaaugguugaacuaguuuauagucccaccaacaguguaaaaguguuccuauuuuuccacauccuccccagcaccuguuguuuccugacuuuuuaaugauugccauuccaacuggugugaguugguaucucauugugguuuugauuugcauuucucugauggccagugaugaugagcauuuuuucauguguuuuuuggcugcauaaaugucuucuuuugagaagugucuguucauauccuucacccacuuuuugaugggguuguuugugaaacacauucuuaaaagggaauuuugcagucauccauuauggcugcuuuacaaaguguaaagugcuuuggauuuguuagggaauguuacagauuuugugucauugaaggggguauauacuaaaaaaugauuugguuagagacacuuagcuggucuuuuuaugcccucauuaggcuuguuuuaaagaccagcauuuuuguuuuacauggguuugcuucuggaauggucuagaaaggguauauaagccacuguuuauuauuugcauuuuuuauaguuuauggaaaugcuuaguuacuaugaugauaaccacuaugaaaagaaaacuaaaauuucuaacauuaucauaacacuugucacaauacucugucaucuguggauaaauccaaaaacauuagauuuaauuguauuggaucagaaacugccuuguggucucaauaaaaucggcugucauuuucuuuuuaucuaucuccccuccuacuugggaagaugcuugagagcaggcugaagacugggugguggggaggugauagugccggaguaaucuuucccuagcccaggccuuuguucaaagaacguguugcauaaacauuugucaaauggaugaaugaauuauaaaacaugagaauguguuucugcuucuagcagaugcuuaaaucuguuacuuagguuuuuuuuuuuuccaauuaaacuugagaguaguuuuuuagaaauaauuuaggauauaguuuuagcacaaauuaauccuuauugggcauuggauguuucuucuggauaacugagaucuugguaccuuggauaugccuuggguuaaugucuuuucugugaucaguauuaaaacuucucagaaacaaggagguggacucucacagaccuucuacuuuuuagauugcucuuuggcagucauacuuguagaguguucuuaaagcaaacuauuuuuuuagcucuuacuauuguuauagggauucuuccaugagaaugcauaucugucuuuaauaaucuuuuaguuuuaauugaacuuuuuacugagauaauuguagauuuucaugcagugguaagaaauaauacaaauagaugacaggugccauuuacccaguuuccuccaauaagaaaauuguuuuuguaccuaugaauuuauccguaguguaaaacuauagcacuguaucacaaccaggauauugacacugauacaaucuaucaaucuauucagauuuccucaauuuuaguaguauucauuucuuuguugcauguauuccauauacuuuaucacauguguugguucauguaccuaccaccauagucaagacacugacuugguauucuguuacccugggaucccuccuguuacccuuuguaaccauaccaauuuccaucccacccugcucuggcccccuagucauacuuucuggcauccacuaauuugauauucauuucuuaaauuuugacauuucaaaaaucuuacauaacuggaaucaaauguuauacaaaaaucuuuuagaauugacucuuuuuacucaguguaauuuucuggagauuuaucuagauuuuuacauauccuacuuaguuuguuccuuuuagaugcugauggacauuuggguuguuuccauuucuuggcuauugcaaauaaagcugccgugaacauucucguacagauguuugugugaacgugaauuuuuguuaucccugggauaaauguccaggagugcaguuacuggguuguaugguuauugcauguuuauuuuguaagaaagcaccaaauugcuuuccagagugacuguaccauuuuacauuccucugcauccuugccggcauuugguauugucauuauuuuuuauuuuggccauucucauagauguguuacuauauugugguuuuaauuuggauuucucugauuacuaaugauguugaacaucguuuccugugcuuauuugccaucuguaaauccuuuucagugaaauuucuguucauguuuucugcucauguucuaauuggcuuguuugcuuuuuuauuguuguguuuuaaauguccuuuauauauuuuagauacuuuguuggauauguaguuuacaaauauuuuccccucagucuguagcuuuuccuuugauccucuucacaggauguuuuauagaacaaaaugucuaauuuuuaaauuaauacagaauauuugugcauauuuauguauuuuugaggaacaugugaugccuuguuacaugcauagacugugugaugaucaagucaggguauucagaauaucuaucacugaauauuuaucauuucuguguguugggaacauuucacguucucccagcuauuuugaaauagacaauauauuguuaacuacccuacuuugcuauuaaacauuaccucuuauucuucuuugcuguguguuuguacccauuaaccucucuucauccccgccucccacugacacacccuuuccagucucuaaugucuaucaugucugucauccuacucucuaacucugugagaguaacuuuuuuuuuugcucccacauauaugugagaacaugcaauguuugacuuucugugccuggcuuguauuucacuaauaaccuccaguuccauccauguggcugcauaugaacaugauuuuaauucuuuuuuauggccaaauaguaucccauucucauucacucauucucucucucucucucucucuuucucucucucuuuucccccgcccucucccucucccccucccacucccucuccgccucccucucccucucccccucccccucccucuccuucucccucucccucuccuucucccucucccuguccuuuucccucucccucuccuucuccccauccuucucccucugccuauccuucucccucucccucucccucucccucucuccauacacacacacauaccccauacuuaacuuuauuaauucaucuguagaugagcacauuugguaagauuccauauuguggaauagugcugcaauaaacaugaggauacagguaucccuuugauauacugauuuugauuguauaguaguucuauuuuuaguuuucugagaaaucuccauacuguuuuacauaguggcuguacuaauuuacauuccugccaacagcguauaagaguucccuuuucucugcauucuugccagcauccauuauuuuuugucuuuuuauaguagccauucuaacugggugagguguucucauuauuguuuugauuugcauuucccugauuauuagugauguugaacauuuuuucauauaccuguuggcuauuuauaugccuuuugagaaaugucuguuuauguccuuugcccauuuuuaaaugggauuauuuguuuucuuacugcugacuucuuucaguuccuuguauauucuguauauuaguugcuuguuggaugaauaguuugcauauauuuucuguagucaacagcuugucuguccacucuguugauugugucuuuugcugugcagaggcuuauuauuuuuacauuuuugaguuggggucucugucaccuaugcuggaguacaguggcaugaucguggcuuacugcagccucaaauuccugggcucaagugaucccccugccuuagccccccaaguaacugagacuacauguauguaucacuaggccuggcuaauuuuaaaacauuuuuuguagagaugggaucuugcuauguugcccaggcuagucuuaaacuccuggccucaagugauucucccacuuuggccucccaaagugguagguuuacaggugucagccaccauucccagcccagaagcuuuuuaguuuaauauaauaccauuuguuuauuuuuguuuuucuugcuugugcuuuugagaucuuggccauaaaaacuuugcauagaccaaugucuuaaagcauuuuucccauguuuucuucuaguagcuuuauaguuuuaggucuuacguuuaagucuuuaaggcguuuguguugauuuuuguacuuagugagagacagggauccaguuucaaucugcugcauauagauauccaguuuucacagcaccauuuauugaagaggguguguguccucuccccaauguauguucucggccccuuuguuaaaaaucaguugcuguaaguacauggauuuauuucuggguucucuaaucuguuccauugauguaugugucugguuuuauaccaauaccaugcuguuuuggucacuauagccuuguaauauacuuugaagucagguagccugaugccuccuuacucuuuuugcucaggauugcuuuggcuauucaggcucuguuuugguuucauaugaauuguaugauuguuuuuucuauuucugugaaaaaugacauugguauuuugauacagauauccuugaaucuguagauugcuuuggguaguaugaucauuuuaacaauguuaauuuugauuugugagcauaggaugucuuacuauuuguuuuugucuuuuuaaauuucuuucaucaguauuuuguaguuuucuuuguagaagucuuccaauuccuugguuaaauuuuuuccuggguauuuuauuuuuauuauugcuguuguaaaugggauugccuucuuaguuuaagugauuucauuauugguguauagagaugcuauugauuuuuguauguugauuuaguauccugcacuuuacugaauuaaaaaaaauaguucugagaguuuauuuuggauuuuggguuuucuaaauauaagaucaugucaucugcaaagugggacaauuugacuucauguuuuucaauuuggaugccuuuuauuucucccucuugccugacuggucugccuaggaaucccaguacugacugcauugaguaggaguggugaaggugagcaucuuugucuuguuucaguucuuagaggaaaggcuuucaauuuuuucccauucacuaugauguuaacuguggauuugucauaauggucuuuauuuuguugaaguauguuccuucugugccuaguuuguuuagaguuuuuguccugaggaggcuuugaauuuuaucaaauguuuuuacuguaucuuuugagaugauuguaugguuuuugcccuuuguuuguccaugugauguaucacauacugauuucuaaauguugaaccauucuugcgucucugggauaaaucccacuugaucauggugucuuauguuuucugguuuuguuuuuguuugagauagggucuuccuguguugcccaggcuggagugcaguggugcggacaugacucgcugcagccucaaccugcugggcucaggugauccucuggccugcaguggugcagacaugacucacugcagccucaaccuacugggcucaagugauccucuggccugagccuccugaguagcugggaccacaggugugcaucaccacgccuggcuaauuuuuuuuuuuuuuuuuuuuuugagacugggucgcacuuuguugcacaggcuggucugaaacuccugggcuuaagagauccuuccaccuuggccucccgaagugcugagauuacaggcaucagccacugcacccagccggugucuuaccuuuuugucaagcuauuggauucauuugcuaguauuucguugaggauguuugcaucuguguucaucaaagacauuggccuguaguuuucuuucuuuguuguguccuugucugguuuuggcuucaagguaauucuggccucauagaaugaguuagggagaauucccaccacuucaguuuuuguaauaauuugaggagaguugguauuauuucucuuuuauauguuuggaagaauuuggcaaugaauccauccaguccugggcuuuucuuuguugggagacuuuaauuacugauuuaaucuuguuacuggucuauucagguuuucuguuucagccuugguagguucagccuugguaggcuguagguuuccaggaauuuauccauuuccucuagauuuuccaguuuguuauuagauagcuauuaauaauagucuuugggggauuuuuuuauauuucuuggguaugaguuacaauauuuccuuuuuguuuccgauuuugauuauuugggccuuuucucguuuuuuucuugguuaaucuagcuugugguuuaucaauuuguuuaucuuuucguaaaaccgacuuuuuguuuugugaucccuugcauuguuuuuuuagucucaauuucauuuaguucugcugugaucuuuauuuuuuuuuccuucuacuaauuuuggguuuguucuuccuuuucugguuucuugggaugcauguuagauuguuuauuugaaaucuuuuuuuuuauauauguguuuauugcuacaaaguuuccucuuagcacugcuuuggcuguauuccauagguuuugguauguuguguuuccauuuucauuuguuucaaaaaaauuuuuuuauuuccaucuuaauuucuugacagaguuuucauguauuuguauaguuuccaaaguuccucuugguauuguuuucuaguuuuauuccaauguggucugagaaaguacuuacaugauuuugauauuuaaaaauuuguugauacuuauuuuauggccuaauauacgucuguccuugagaauguugcauaugcugaugagcaguauguauauucuacuguuuuaggguaacauguucugugaaugucuguuaagucuguuuggucuaaaguucaguuauagccaacuuuuuuuguugauuuucugucuauaugaucuauguaaugcugagagugggguauuaaagucccccacuauuauuaucuuggagauugucuuuccuuuuauaucuaauaauauuugccuuaacauaugugggugcuccaguguuggguacauauauauuuagaauuguuauauccucuugcugaacugauccguuuauuauuauauaaugacuuuugucuuuuuguuuuuugugaggcagagucuugcucugucacccaggcuggagugcaguggugcaaucucagcucacugcaaccuccaccuccuggguucaagcaauucuccugcuucagccuccugaguagcugggacuacaggcgcauaccaccacaucaccacauccagcuaauuuuuauguuuuuaguagaaacgggguuuugccauuuuggccaggcuggucucaaacuccugaucucaggugaucugccugcccuggccucgcaaagugcugggauuacaugugugagccacugugccuggccugucuuuuuuuuuuuuuuuuuuuuuuuuaacaguucugucuuaaaccgauaaauacguuuuauuuaaauauagcuauucuuguuugcuuuagguuuccauuugcguggaaugucuucugucccuuuacuuuuagucuucgugugucuuuacaagugaaggaaguuucuuguaagugccauauaguuagauccauuuuuuaaaaauccauucagucaguccuuuaaggggaaaauuuaaucuguuuaaauaaccuugaaaaguuauuacugauaugugagauuucauccuggucauauuguuuguuguuuucuggauguuuuguauauccuuuguuccuuucuuuuucucuuauuguuuaucuuuuugguuuggugguuuucuguagugguaacauuugaauccuuucucauuuguguguuugcucuaccagugaguuuuauacgguguguuuucaugacaguagauauuguccuuuugcaucuagguuuaggacucccuuaagcauuucuuguagaauuggucuaguggugaugaaccugucugggaaaggcuuuauuuuucuccuucauuuaugaaggauaacuuugcuggguguaguauuguugguugacaguuuucucuuagcacuuugaguauaucauuccauucccugcaggccaguaagguuucugcugagaaauaaucccgauaguccaaugggguuucccuuauaaaugacuaaauguuuuuaucuucuguuuucagaacuuucuccuaguuuuugacuuuugacaguuugauugcuaugugccauggagaaguccuuuuugaacuguaucuauuuuggguuaucugagcuuucugucuaucgacgucuaaaucuuuugcuagacuugggauguuuucagcuauuauuuuguuaaguaaguuuuuuaucacugugguuuucucuuuaccuucugugacaacaaaaauucaaauauuugguuacuuuauggaguucugugugucauguaagcuuguuuauucuuuuucauucuuuuuucuuuauauuuuucugauuggcuuauuucaaaggaccugucuucaaguucugaaauuguuuguucugcuugcugucgucuauuguugaagcucuuuuuuuuuuuuuuaauuauacuuuaaguuuuaggauacaugugcacauugugcagguuaguuacauauguauacaugugccaugcuggugcgcugcacccacuaacucgucaucuagcauuagguauaucucccgaugcuaucccuccccccucccccccaccccacaacaggccccagagugugauauuccccuuucuguguccaugugaucucauuguucaauucccaccuaugagugagaacaugcaguguuuuguuuuuuguucuugcgauaguuuacugagaaugaugauuuccaauuucauccaugucccuacaaaggacaugaacucaucauuguuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuuccaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugaguugguaucucauugugguuuugauuugcauuucucugauggccagugaugaugagcauuuuuucauguguuuuuuggccgcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcaaaaauuuucucccauuuuguagguugccuguucacucugaugauaguuucuuuugcugugcagaagcucuuuaguuuaauuagaucccauuugucaauuuugucuuuuguugccauuccuuuugguguuuuagacaugaagucuuugcccaugccuauguccugaaugguaaugccuagguuuucuucuaggguuuuuaagguuuuaggucuaacguuuaagucuuuaauccaucuugaauugauuuuuguauaagguguaaggaagggauccaguuucagcuuucuacauacggcuagccaguuuucccagcaccauuuauugaauagggaauccuuuccccauugcuuguuuuucucagguuugucaaagaucagauaguuguagauaugcggcguuauuucugagggcucuguucuguuccauugaucuauaucucuguuuugguacuaguaccaugcugcuuugguuacuguagccuuguaguauaguuugaagucaaguagugugaugccuccagcuuuguucuuuuggcuuagguuugacuuggcgaugcgggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucuguuugucuguuguugguguauaagaaugcuuuugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuccuucuccugccuaauugcccuggccagaacuuccaacacuauguugaaugggaguggugagagagggcaucccugucuugugccaguuuucaaagggaaugcuuccaguuuuugcccauucaguaugauauuggcuguggguuugucauagauagcucuuauuauuuugaaauaggucccaucaauaccuaauuuauugagaguuuuuagccugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggagaagcuuuuugaugugcugcuggauucguuuugccaguauuuuauugaggauuuuugcaucaauguucaucaaggauauuggucuaaaauucucuuuuuuuguugugucccugccuggcuuugguaucagaaugaugcuggccucauaaaaugaguuagggagaauucccucuuuuucuauugauuggaauaguuucagaaggaaugguaccaguuccuccuuguaccucugguagaauuuggcugugaauccaucugguccuggacucuuuuugguugguaagcuauugauuauugccacaauuucagcuccuguuauuggucuauucagagauucaacuucuuccugguuuagucuugagagaguguauguguccaggaauuuauccauuucuucuagauuuucuaguuuauuugcguagagguguuuguaguauucucugaugguaguuuguauugcugugggaucgguggugauauccccuuuaucauuuuuuuauugugucuauuugauucuucucucuuuuuuucuuuauuagucuugcuaguggucuaucaauuuuguugauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguacccaguagucauucaggagcagguuguucgguuuccauguaguugagcaguuuugagugagauucuuaauccugaguucuaguuugauugcacuguggucugagagauaguuuguuauaauuucuguucuuuuacauuugcugaggagagcuuuacuucccaguauguggucaauuuuggaauagguguuguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucuaguugcuccuguauugggugcauauauauuuaggauaguuagcucuucuuguugaauugaucccuuuaccauuaugucauggccuucuuugucucuuuugaucuuuguugguuuaaagucuguuuuaucagagacaaggauugcaaccccugccuuuuuuuguuuuccauuggcuugguagaucuuccuccauccuuuuauuuugggcuuaugugugucucugcacgugagauggguuuccugaauacagcacacugaugggucuugacucuuuauccaguuugccagucugugucuuuuaauuggagcauuuaguccauuuacauuuaaaguuaauauuguuaugugugauuuugauccugucauuuugauguuagcugguuauuuugcucguuaguugaugcaguuucuuccuagucucgauggucuuuacauuuuggcaugauuuugcagcggcugguacugguuguuccuuuccauguuuagugcuuccuucaggagcucuuguagggcaggccugguggugacagaaucucucagcauuugcuugucuguaaaggauuuuauuucuccuucacuuaugaagcuuaguuuggcuggauaugcaauucuggguugaaaauucuuuucuuuaagaauguugaauauuggcccccacucucuucuggcuuguaggguuucugcugagagauccgcuauuagucugaugggcuuccuuuugaggguaacccgaccuuccucucuggcugcccuuaacauuuuuuccuucauuucaacuuuggugaaucugacaauuaugugucuuggaguugcucuucucgaggaguaucuuuguggcauucucuguauuuccugaaucugaacguuggccugccuugcuagauuggggaaguucuccuggauaauauccugcagaguguuuuccaacuugguuccauucuccccaucacuuucagguacaccagucagacguagauuuggucuuuucacauagucccauauuucuuggaggcuuugcucauuucuuuuuauucuuuuuucucuaaacuucccuucucgcuucauuucauucauuucaucuuccaucgcugauacccuuucuuccaguugaucguauuggcuccugaggcuucugcauucuugagccuugguuuucagcuccaucagcuccuuuaagcacuucucuguauugguuauucuaguuauacauucuucuaaauuuuuuucaaaguuuucaaccucuuugccuuugguuugaauguccucccguagcucagaguaauuugaucgucugaagccuucuucucucagcucgucaaagucauucuccauccagcuuuguucuguugcuggugaggaacugcguuccuuuagaggaggagaugcgcucugcuuuuuagaguuuccaguuuuucuguucuguuuuuuccccaucuuugugguuuuaucuacuuuuggucuuugaugauggugauguacagauggguuuuugguguggauguccuuucuguuuguuaguuuuccuucuaacagagaggacccuuagcugcaggucuguuggaauacccugccgugugaggugucagugugccccugcuggggggugccucccaguuaggcugcucgggggucggggucagggacccacuugaggaggcagucuacccguucucagaucuccagcugcgugcugggagaaccacugcucucuucaaagcugucagacagggauauuuaagucuucagagguuacugcugucuuuuuguuugucugugcccugcucccagagguggagccuacagaggcaggcaggccuccuugagcuguggugggcuccacccaguuggagcuucccggcugcuuuguuuaccuaagcaagccugggcaauggcgggcgccccucccccagccucgcugccgccuugcaguuugaucucagacugcugugcuagcaaucagcgagacuccgugggcguaggacccuccgagccaggugccggauauaaucucguggugcgccguuuuuuaagcccgucggaaaagcgcaguauucgggugggagugacccgauuuuccaggugcuguccgucaccccuuucuuugacucagaaagggaacucccugaccccuugcacuucccaagugaggcaaugccucgcccugcuucggcucgcgcacggugcacgcacccacugaccugcgcccacugucuggcacucccuagugagaugaacccgguaccucagauggaaaugcagaaaucacccgucuucugcgucgcucacgcugggagcuguagaccggagcuguuccuauucggccaucuuggcuccuccccugaagcucuuaaguguauuuuaaaauuucauucagugaauucuuuaguuccaguauuugucugauucuuuuuaaaaaugauauguaucucuuuuauacauuuuucauucauacccuggauuguuuuucuaauuucuuuguauugucuaucucuguucucuuauaucucccugagcuuauuuagugucauuauauugaaucauuuuucugguauuucacaaauuucuuuuucauuggaaucuguugcuggagaguuauuguuuucuuuuggaggugucauauuucauugcuuuuucauguuuaaguucucauguugauauuugugcaucuguuaauaauguaacugucaugucuuugaauuuuuuggauuuguuuuuguaggagaggacuuuuuccuuaagauguguuugugauuuugguuggguagagcacuuuggcuuugauucuugguguauguaguaguauagucuccauauaauuuggcuggcuguaaucagugucagugguaucugugauuucuucaguggcuuagggugcaguuguuauuggaagcuguuuuguaguuuugcuggggauggggaugucagauaagccaguucuugggcccuagugggggcaauaacaggccaaacaugccuaacuuagggcuucaagguggcguaugcuggcauuuauguuaguggguccacguggaccaauucuugggcuuccggguggccuacuuugguacgggaauggcagcaguggauuggacagguggguggguccgugggucccugggcagcaguuguggccugggcaaugacaguagcauuggugggacaacccuuuggaucccagcuggucugagguggucuuggcgauggcuacacuguguugaguggggcagucccaggccacaggugguguguccugguguaugcuacugugguggcauggcaagcugggugggcucacccucaggcuccaggaaggagugcucaggugccaauggguauagacugggcagagaaauccucaggccccaggauagugugcuugggcacuugggcagaggcagggguagugagccaugccaggcagaacuauccucaggcccuuccagugauguguacaggugcuggcugugguggguaaggguggggugauccccagacuuucagugaagugcuuggguggaggcagcaguggcugugcugcaguccugcuacuggguaaggcggggauuuuuucaguggcagcagcuguaggcagguggcuggggagcacacacuuugucccuagguggcggcugcuggcaagagagccugugcucaguacauuuuaaaauguguagcaauccuucuccugggguggugggcuugcugcuagugucuugugcuuggcucugguggcagcaaccagcuacaguggcaucugcaggugggggaugucaauggggcacaauggauguggagaugcagaaacuguggggugggccccagggcaggaugcugccugguaagggcuguauucuuacagaggcaccauguuguaggugcauaggacuuggaagguguguaggauccagugugaucuccuucuuugaagcaaugccaucaugcagucuccaugcagcugguuacuuucagggcccacaaggguugagaggaucuccagcuaggauuggaggaguccacaguggcaauguggacugcugggggucacuuacuuacuuuuuccccacauucagagccucuuugggcucuuaucccagccaagcaggcugccucacuucucucuucuucuucuucuuagguguuuccuguuccuucucuguugggacuccagcguucucuccuagaugaucuauacuugcuauuuugguucuuccuuaugaagaaggugacuuucagaugccucucgucagccaucucugaaugccuuccucagucuuuaaauuugaugaaguucaauuuguugauuuccuuuuuacuucuguggacugugcguuuggugucaugucuaagaaguauucacuacgccguaggaucuaaaacuuuucucauaucuucuaaaaguuuuaugguuuuguguuuuauuuuuaagcccauagucuauuugaguuaauuuuuguaugaugguaugagguuuaggucgaaguucauuuguuuugccuuuagguaucagauugcuucagcaccauauuuugaaaagacuuuguuucuuucauugaauugcuuuugcaccuuauucaaaaaucaguuggcuguacuuuuaugggacuauuucuagguucuuuauucuguuccuuugaucugugugucugucccuuugucauuccugcacucuguugauuacuauagauaguauuaaaagaaaaacuuuugagaauuuaaacuuagcagaguuuauuugagcaaagaaugaucaaugaagucaucacuccucacaaccagaaaagguucagagagcugggcucugcaaugugggcagugaguacuuauagacagaaaaugugagguacagaaaucguuugacugguuacagcuaggccuuugccuuauuuggauauggucuggucaguuaccugccugugauuaguggcgguuuggcugcuuaugauuggccgagacaccacuguuauuaccuucuuaaguuagguuuucaguuuaaguuagguuguaguucauuaagugggaacugaaaguauggagacagccucaggccacuggccuccugcuuauugauugauugauugagacagagucuugcccucucaccuaggcuggaguguaguggcaugaucucggcccacugcaaccucugccuccuggguucaagcaauucuccugucucagucucccuaguggcugggaucauaggugcccgcuaccacacccagcuaauuuuuuguguuuugaguggaaauaggauuuugucauguuggccaggcuaguguugaacuccugaccucaaaugauccacccaccuuggccucccaaagugcugggauuaugggccugaaccaccacgcccggcugccuccugcuuauuuaauaguaguuauccuuaauauuggguaaagugauucuucuuuuguucuuugucaaaauuguuuuagauauuuuaagguuggugucuuuccauauacauuuuagaauaaacuugucuguguuuauaaaaagucuugagauauuugguuaggagucguaauaaacuuacagauuaauuuggggagaauugacaccuuuauuauguugaguccagugcaugaacauaguagggaugucuccauuuguugaggucuccuucaguauuuuucaucagcaauuuuuaauuuaauauacagauacuguauguguuuuuuacauuuuuuuaaaaaguguauaccuaaguauuuuauauuuuuacugugauuguaaaugguauguuuuaaauuccaacuuuugcaugggauaauauuuuugugauuauuucauaggaaaguacucaccuuguacuuaauucuaugagagaaaucuuagugggcauucagaugggagaccaaguuaaauuucaaaacuacaagucauuuuuaaaaguuauauuaaaacaauuuuguaugcauguaagaauaauuauaauuagauuggauuugguuuagagaaaaauacaagcacaggauucauauauuucagaaucauuuuauguuaagcuuuguuugaaguaaauuuaggguaccuggaauaguuuguccaaacucauuguaggacuuaaaauucagauuaacaauuggcaaauucauauguauguacuuugaucaauauguauaguccugcucaaggacgguagagagggagacacagggucauggaauuggaaugcugagaaaaauuuauuuaacauauuaaaaaauugauuaaauuuuaagcauucggaaccuugauuccacaggacagaagauaaaagaauauuaucaggcagguaacacaagaaauacaaauucaaaaucagugcauacagugcgcagucuuccaaaugaagagaugaauguuaaaacuauucagagaccacuggucauuaaguugagcaaaaaucaagacguauuuuacagcguaauauugauaggucuuaaaggaaauguuuucagucauauaauauguugacacugcaaacauaagcagagcuuuugcgguacagucuggcauuaaguauuacgagagaaaaacauuuugcccagagacacuuacuggggcucuauuugcucuggaaacuauuagagaauguuguaucuauauaauagaauaauauucauuaauaagaauuauuuaagguuugguuuauaaacuugggcauacauaauaaugucaauuaaauggcaauauaaaaauuguaaauguugauaacuacauaaaauuuuuaugucuguuaaauuaauaugauaugaaugacaauuauuugaaguuucuagcucuuuucccuugugagaguugucagaaucaaaaugaagucacuuguauuaaauucuaacaaaaaauaaauaaagccaggagguuaagaagggagcucucacacacgucuaucguaagaacugcuacaaagcaucucugaagggcucuucugcacauaugccuguaauaagaacuuuugccagcagucccugcaucucuacauccauggagccccauugacauuccccaccugcagcggccacugcagcucaaacugcagcuugcuacgugagucacaaggauagcuagcuggaugcauaagaacauuugacugacacagucuccccuguauccaauguucucuuuguuuucaaacaaauuccuuaugcuuuucccuuuugccuuuaaaagcuucuccuggcuucaaccuguuuggauaugccuguggucccuauagcccucauaugcuggauuugcaaauccccugcacacuccagaauaaacucaguucaauaaacucuuugaagaaugcuuguuauuuagguugacacucuuuuguaaaguuguauucaauacacuuugaagaaaaaagaaaagcuuuggaacaagagguaggaaccuugaguuuuagauuugacuuuguacuucagccaugguuugugcagcacucaccauguacuggguguguugcugagugguuugcauggauuauuccaccucuaggggcagaggacugcuauauucguagucucaguuuacagcagaggaaauugaggcuuagagcaguuuaguaacuugcucaagauuacaccaguaguuggcaaguagguuuuagauuccagggccugcacucugaagcacugcgcuguucugcccucuguuauaauuaguaauuguccauaugcauccuuugaagaugacuucuguagaauaugggcacaggucucaacuguauggacaguuuuacaaagugcagaauaggauaguugcuacuaucugcauaaauguaagaacauacauauuugcuugaauguggauaaaauaccccuggaaagauaugcaagaaacugauaacacugauuaccuucuggaggaagauuacaccaugugaccuuauuaccuucucaaaaaaaguguaaaguguagacuuuauacauuuuguguaaguggccuugaaaguucuugccuucuaaggaccuuauuuuccucauugugaaguguagaaguugaauagaugacauauuccuaucuuuauuguugauacuauauaauggaugauuucugagucuaguuugaaaagaucaaauuuauguuaugccuauuuuauauuuaccaauuacaggauucuuauacuuuaauuuuugaagauuugugaguauaaaugauauauaaaaguuugauuguuuuauauguucuugguuaaaugagcuuuuuguguaaugaucauuuaccaggcuauaaaauguacuaagcauuucaucuuacuaauguggugcuggauacagccagguggauauguuuagcuacauuuuauauaaaagaacaaaaauuugaauagguguaaucucuuucugggcuccagugagaaucucauucuuuauuauguacuguauacugauuacucagcuggggugaggguugccugcauaaaaguaucuccucagguucauaauugcugucuuagucuuaaauuggauuugacuuagucuuaaucuauucuuggucuucauuguuuacuauauauuugcuauucaugcuuugggcuuacguggauaauauuuaaauuuaggcaguuuuccaugagauccaaauauaaaaaagcaacgauaaauuuaaauagucauuucauauaacuuagaucauuuaauuugucuuugagcugucaguuacucuuaaucagugcauacaaucauuuguuaguucagugagcauuugagugcauguucuuugcaaagaagcuagucucugccuuccaagaaaugauacuagaguaagaauuaaucaggcaaauaugauauaugauaagugugugauugaguccucugggaacauauggaagggucaucuaacuuaacugggggaggaagggucuggauucaagaagggcauuccuaaaggagguuacuugcuugaaaucugaauuuuaaaaggaugcauccguguaagcaagguggguaggaggaccauccagggcaaaggugagagccuguguaagaaucagaggcaagcaugugccugucauuuaggaaauguccaguaagcuggaguaugagacucuugacaggcaugugggggaucgugauuauaaggaggacauuauauagugccaggaauuggcucuuuauggccauugaagguuuauguuggaaguauuaugaacaguuuuuugcuuagcgugaucgacugguugcucugaagaauggauuggaauaagacaaggggagaagcagagagucugcuaaaugagacuguugcaguaaauaaguaauccaaguguaaccuuacaguggucaaagaguaggcuaauguaggugggguagacguuuaggaggucggcucuagagagauucauugguuggggugauaggaaaaaaaggaauuaugauauccagguuucuggauuguucaaauuguccaugcuauucccugagauaguccagagaaaaaucauuuaggggagagggacagguagagaaaauaugacugucuuauuucuauaaaaacuuccugguucucacuaacuuguuuuauguaauaauuuguaaucugugaauucuucccuuuuaucucaaauccaacauacuuuccuaagugcaguuuaaacucaucuauucuuggucuucauuguuuacuauaucuuugcuauucaugcuuugggcuuacguggauaauauuuaaauuuaggcaguguuccaugagauccaaauauaauuggaucaauuauauuuaauucaauuuaaauaguccuuucauauaacuguauuuuuuuacuuugacagagcagaaacuugcauuuugauugugagaaaccauauauuagguaaauaauggugccaauugcaauuuaauuuuuaaaucaaguauaaaccuuugguaagacauuugauaaacucuccuuugguagucuguggaucuguaucaauuguaaacaauucaaacuaacauaauuauaucuauuauacaucaaaauaacugucaucauuuuuuuuccaucuuuaauucuuuaaugcagaaaggaucauuauauuguuucaggauagcuaacucagaaauaaccaaaguuucggcugggugagguggcucacgccuguaaucccagcacuuugggaggucaaggugggcagaucaccugagcucaggaguuugagaccagccuggccaacauggcgaaacccugucuccacuaaaaacacaaaaauuagcugggcauguuggcacacgccuguaaucccagcuacucaggaagcugaggcaggagaauugcuugaaccugggagggaaagguugcagugagcugagauugcaccacuauacuccagccugggugacagagccagacuccgucucaaaacaaacaaacaaacaaacaaaaaaacccaaaguuuuaaaagaauacucaaaguauugugaacugagaauaaaggagaaugguacuuuuaagucauaaagucauuuugguuauaauuuaaagauagcacuuuaugcuaugauucagauaacuguucugguuuuuauugguucagauuuaauacuggaucacauacuguaauucaccaacuguaaggagcuaucaauuauaagacaaauuauuuuauguacuacuagaagaauaaaugcugccaauuaaagccaucuuauaacaauauuuuuaauuuaugcuuauggaaagaacuguuugagacuuagauaugcauuuuuguuauaucauacugcuguauucauugccuuccugcauacauuaauuucuugaagauuuuaaguggaauuuaaacucagcauguguaguaaguaccaaaaaugcccauaacacaaaugaagugugcuagaccauucuuguguauguaugaucaugcugacuggcugaugguaagacuccaucaauuuuuagauucaucccucuuugagagagauucaaauguguuuucuuaucagcuugcugagauaugggccaaagggaaagaggaaggggugagccuaaaagaugccagcaguaaaauggaguaagacucuauuacaucaggaaaagagggaacuacugacuuuuaggauucauggcuuaaaugauaaaguagagccauugauugaagagauugauggggagggauagcaauggguugaagaugggaaacagaauuccacuuugucccuguuacugagaugccauuuaggugauggauuggagacaucuaaaugugaaguagguagcugccugccugauauuggauguguacauaagaggguucuggaaacagcuaucugagucacagcauaaagugcuaucuuuaaaacccacaguuucagccaggugcaguggcucacaccuguaaucccagcacuuugugaggccgaggcaggcggaucaucaggucaggagauugacaccauccuggccaacaagaugaaacucugucuguacuaaaaauacaaaaaaauuagcugggcgugguggcccaugccuguagucccagcuacucgggaggcugaggcaggagaauugcuugaaccugggagguggagguuguagugagccucuaauuaguguuuuaaagauagcacuuuaugcugugacucagauagcuguuuccagaguccucuuauguacacauccaauaucaggcaggcagcugccuacuugacauuuagaugucuccaaucgaacgccuaaauggcaucucaguaacagggacaauguggaauuccguuucccgucuucgacccauugcuaccccucucccaucaaucucuucaauaaauggcugcacuccagccuggugacagugcaagacccugucucaaaaaaaaaaaaaaaaaaaaaacccagaaaacaaaccccacaguuuacuccuguauagaagggagauaaucugaucugcccuuuaagguuuuagguuuagcuuagaguagugccuggagcacagaaagcucucaauaaguguuuucugcugucaugauugaucuccaucgucaucuauagcaugggcuuuagagauagagaccuuaguuugaauuuaagcaagacuuacagcaaguuauauaauuauucaauuuuuuuuuuuuuugagauggaguuuuggucuguugcccaggcuggagugcaguggugugaucucugcuuacugcaaccucugccucccagguucaagcaauucucaugccucagccuccuaaguagcugggauuacagaccugcgccaccacucccagcuaauuuuuguauuuuuuaguagaaaugauguuucuccauguuggccaggcuggucucaaacuccuggccuccaguauuccacccaccucagccucccaaagugcugggauuacaggccugagcccccacaccuggcccaauuauucaauuugucuguaaacuggaaauaguaaaaccaagcucauggguaguauucuuaguacuagaugaaaaagaaaagcaaggaagcaucucuagugggaaguuaucuguaguaaguauacaaaauagacuuaagacauauauucuagggccaguugaggaggcucacaccuguaaucccagcacuuuggaaggccaaggugggaggauugcagcuugagaccaaccuaggcaacauagugaggccaugucucuacagaaaauaaaauaauuaacuggguauggugacacauaccuguaguccuagcuacuugggagguggaggcaggaggaucacuugaacccagggcucugagguuuacagugagcucugaucaugcuccugcacuccagccagagugacagagggagacccugucuaauuuaacaaaaaagacauauauucugcucuuuagcaauuuacacuuuaguugcaggaaauaaguccuaaacauguaugugcaagaugaacaauacagagaaacuugugagaaguugacauaugagcugucuagguaacaagauaagauugagaacuacauaggagacccacuucaguuuuucucuugauuaacugugugauguugggccaguuguuuacugucugugagacucaggauuuucacuuauaaugugagaguuaauuggacaagaugauuucuuaggauaccuccauuuugaaggguuucuuaaagugauauaaauauuuagaggaaaggcgauuacuccagaaagcuuggaggaggugggacuugagaaaacagagugguuugauuaaaaacuacaagauggcacaagagucuuuuggaauuuuugaagguaucuguuuuauguguuacaauuaggagacauuagcuguauuagucuguucucaugcugcuaauaaagacauacccgacacuggguaauuuauaaaggaaagagguuuaauagacucacaguuucacauggcuggggaggccucacaaucaugguggaaggugaaggaggagcaaagggacuucuuaaauggcagcagucaagagagcaugugcaggugaacugcccuuuauaaaaccaucagaucaugaaacuuauuuacuaucaugagaacagcaugggagggacccacucccgugauacaauuaccucccaccaggucccucccaugacacaugagaauuaugggagcuacaauucaagaugagauuuggguggggacacagccaaaccacaucaauuagcuauauccuuacauuuuccugcuucauuaguuaugaauuaaucaacuauuugagcucauccucuguguccguuuuccuugugcagggugugucuaggacagugguucuugggauuggccucaggaucucauuauaguguuaauuacugaggucaccaaagagcuuuguuuaucgguauuuacuauauuagaaauaaauuugagaaauuaaaauaacuuaaugaaaaguuacuacauguuaauguauuuuuuguguaaaaauaacuuuucaaaaaccaaauuuuauuauuaagaguaguauuuguuucacauauuugcaaauuuuguuaauaucugucuuaauugaagauaacaauucucauaucugcuucuauauucaaucuguugugauuugugcuuugguugaaguauauugaagauacuauggccucacagauaugcagguagaaaaggaagaauguuuuuguauucuuuuuagauaauuacgaguauucuucuuugauguuccacaaaacuccacucgcgauuauauagguuaguuacauauggacucugaauccuuauuaauuaacuuacagcacucucuguuauaauaaaaugcauugguuuaucuugcccuuugaauggguucuuuaucuuuuauccauacaugcuuuuguacucacagaccccugaaagggcacuaaggaaucccagggguuccuaggucacacuuugagaaucacugcuacaguguuaucugccucagagagugguuacuacuuuaagguuauggguauuuuuagcguggcagagaaauuuggccuguccuguuaagugguuaugugaauuuauauucccaccagcagcauaggggaguucuagguaugccacuucuucaacacuucaugugaacagauagugugaauuuugcuaaccuguuaaugugagaaaggcccuuugaggucucuuguguauauuucuguuggguucuaguuauccaacuauuucuuuuccauucguccauccuccuucuucuucccuccugcucucuccccaccccuaauggauuuagcugcuucuuccuuagucuguucuuuccguaugguuguacaugcuguguguuuuucucauacucguuaccucaggaauuuuaauaugcauguuuaacaagguaaucaaaacacaaggauuuuagaaugcuuuaauucagucgcucacccccugacuuguauacuauuguuuccaaaaacaguucuuuauguuuuuuucuuuuucuuuuuuuuggacauucaaauuaguguuauuuuuauauaguucuuuuaacaaagacugcagaaagaauaugugaaggcaaauucuagaagucacugcagaauguaauguugcauauaccucaaguguuacauauuuuucuauguuaucaaauaauaucaaaugaaaauuuaaauuuuugcuacuuaucccaaaacauuaauuaaauagaauuagaaauauuaauuucuugaggaauuagcaauucauugaauauauuuuaugccaaagucuaauuuuauuuugaauucagagaagucaaagaaagguucuauuauucuaggaccuuaaucacuguaacuuuaauacaagggacccaguuuaagugggcuaauaucuaaugcaauggaaaauaaauugagcaucuuuuuaaaguguguauuagcacuuuuuggaguacuugcuauguguuacauagaguaucuucuuaaucucucagugacugcccuacaggauauugguauuauuaucccucuuuuauugguaaagaaaaugcagaaaacacauagguaauuacugauugccaggaaugggguuuaauuaauucauucaucuagacuuuauuuaaaagcaauaucuguuuggaaauauucacagcccggucacugagaaaugguaaaacuuccacacuguguuacuccuguguuggcuaucugcugcuagauaacacauuauccaacguuagcagcuuaaguaacacacauuuauaugauuucacaguuuaugggguuaggaaucuggccaugguguagcagggucugcugcuuacugcagggucauggccuacagucaagaugugagaugggcugcaauaguagcugagggcuuggccaguaaacgauccgccccuaaacuuacucagcuggcaggguuuaguuccucuugagguguuugacuguuggccaaagucuucccuugguugcuucucacacgggccucucacaugucacaacauggcagcuugcuuuaucagagccagcaagugagaaggugagagggagugcuagcaccauggaagucaguuuuuugugaccuaaucaaggacgugacagcuuaucacuuuggucauacucuguuuuuuaacaaacuuuuauacugcaaaacaauaggccuagguucauaccucucuuaccuuauaguaggauaaauucaaaaugcaucaaagauuuaaauguaaaaaaaaaaggccaggcaugggcugggugcaguggcucacgccuguaaucccagcacauugggaggccaaggugggaggaucacaugaguccaggaggacaacauagugagaaccugucucuacugaaaacagaaaaaauuagccggguuauucuguuuguuaaaaggaguuaccagguccaccucaugcuccagaaaggcaugaauaccaugaggcgaggaucacugggggccaucuuagaaggcugcuuaccacaacugccaaccugguguuuuuauuugaggcgccagaaguagaggugcagucauacagaaggcagaucaucucuuugaacaagcccccaucccguagcuauuacggguuauuuuuccagaagcucagugaccaggauacauagugagaaguaaaaaauauaaaauauuguuacaggaagggauuuggcagaaagagucagaaaugugaaagcccuaaggaagagaaaggaugucaagaaacaugaaaaagggaagaaugagggaauugucagcaagggccauucucuacaugcagguguagagaaaacaagggggugauugagaggagucaacagccucaugguaauaauaaaaaucuucaucucagacgggcacaguggcucauauguguaaucccgugcuuuggaaggcugagacaggaggaucaccugaggcccggaguuggagaccagccuaggcaacauagugagacaacccugucucuacaaaaaauaauaaaaaauuagcuggcuguaguggcaugcaccuguaguugcagcuacuugggaggcugaggcuggaggauugcuugaacugaggagcuggagauugcagugagcuaagaacaugccacuacacuccagccugggagacagagcaagacccuguccccugucucuuuaaagaauaaaaaaaugggccuggcucaguggcucacgccuguaaucccagcacuuugggaggcugaggcgggcggaucacaaggucaggaguucgagaccacccuggccaauauggugaaacaccaucucuacuaaaaauacaaaaauuagccgggcaugguggcggaugccuguagucccagcuacucaggaggcugaggcaggagaauugcaugaacccaggagacggagguugcagugaccugagauugcaccacugcacuccagccuaggugacagagcgagacgccgucucaaaaaaaaaaaaaaaaaaaaaaaaaaaaagaauaaaaaaaaaucccccaaaacccuaauuucaucuggcuugacucucuuugaaacucucaggcuucuaaggaagccccucguuucuccaacuccuuucuuacuuccuuggaagaauccucucucccucuuccccaccucucuucuggccucacagaggccuagaugaccugagcucacucccucuuuccuguuuccauuaccugagcccuccagccucugucccgagauuuagggcuucuccucucaccuuccaacaagaaaaauuguguggaagaaauuagacuccaauguuugagaggaaaaaaaggugcaaauacgauccugaagaggcagucagucuuugauacauucuaucuaagagggucaguaguguacucauaggaaacacguuaucaauaaacuuuuacccagagcaaagugacagugcacacacauucauacucucuccgaugggguuuauccgaaguauucaagaccacccuaaggaugauaaaacagacagagacaagcaugucugacuccaaacaacacccuuaaacuggaugaugcaaucauuccgggaaacccucccccagagugaguggagguuaccaauuccuaguuaccaaugaguacuucaaguccuguucuucacaagucaaggguuaaaacagacaaaauagaauagcuaaaauagaauagcuaaaauauccuaaaacacaaaauggacaaguauaaaacccuuaccaagaaauaauauugauaaaguuucucauuuggaguguucugucccaccagguugguagugggaguauauuuuaaaaauuaauccacugaaaggaggaauaugauugacucauugaggagggagauuucuagaauuaacuuucccuugucuguaccuaacccaaaauuggaacccuuuaguuauaguuugcaucuuaguaagaauauuaagauuucaaaaauuauuaaauauaaacuacaaucuuaaccuccccucccucaggcuuaaaaaaauguagcuaccugguuuucugagauaauuauuuuuugucuggaggaagaaauuguuaagagucccugugcacagggcugggguugggaguggggaugaacuguaaguaaaaacaagggaucuuacuggggugauggaaauggucuaaaacuguggugauggcugcacaacuugguaaauuuauuuuuuaaaaaaucauagaauuguacauuugaaaugagcaauuuuaugcuauauaaauuaugucuuuauaaaguuauuuuaaaaagaggcagugugcagaucucuuaaagccacaucaugcaccuuuuaguaagguauuacucuuauuuccuucuaaauucuuucuuguacuuuaacccuuuugguaucagaucuuuuuuuaaaucuuacaaccucuaaaaaagcuggccccuucuuucaguuucccuauguguuucauuauuuugguuauuuuauacuuaaaaaaauacuuaggaacuauaaguagaaggcaaaauaaauaaaacucaaguuaauuuauucugcagagcuauauguaagaaagugaaaaacgugcuuuccuuccuccguucuucucuguccuuucacgugccuacauguauuugcuucccgguaaguuuuugggacccaggucuucugagucuagaucuguuguucaugcucauggaccauaucgguagaaaucaagggccuucccugcugcauccagucaucagacaagccaguuuuuccaguaucucuuuacccuuuuuacccaaugaacuuaaguauuuggaaugguuuacccuuguguauauuacagguaucagauuuaagagauuaaaaacucugcuuaguuuuuuauuuuccuuauagcucaaaucuaauccaagugaaaaugaagaaaaggaagcacagucucaacuuauaaaaucugaugaaaugcagcguuugcguucacaagcacuuaacgcuuuuggaaguggagauuauacugcugcuauagccuuccuugauaagauuuuagagguaaguuucuuagauacugcaguugaccagccugacacuuauuguaaggcacauuuauauacuucgacaugucacauaccacaaagaccuagacaggagaaaaucagguugguccuugggcuuuugccucuuaaguauaaaauaguguuccuagacaacaaaauuuggacugaaguuuucaguaaauguacugaaugugcuguggcaugagaguuaaauauguuuauaaauugcuugcuuugcuauuuuaguugauuuuguauuuuuuugggaagaaaacucuagcgguuagauaaugggauaaaagaugaaaaagaugguuggaguaaaaggaaaaaugauguucgggaggaaagaggaauguuuagagaaaaauuucuagagaauaaggcagauaaagaguugauaguaugugccuguaguccuaguuacuugggagcugaggcuggaggaucacuugagcccaagaauuugucgcugcagugagcugugauugcuccacuguaccccagccugggcgacagaaugggacccugccucuaaaaauauuaauaauuggcugggugugguggcucaugccuguaaucccagcacuuugggaggucgagguggguggaucacuugaggccaggaguuugagacuagccuggccaacauggcaaaauccugugucuaaaaaaaaaaaaaagaaaauuagcuggguguggugugcaugcuugugaucccagcuacucgggaggcugaggcgcucgaaccugagaagcagagguugcagugagccacuacacuguagccugggccacagagugagacuccgucucaaaaaaaaaaaaaaaaguuaauaauaauaaugguugauaggauccagagaguucuagcuagggaaaccugagucuagguuuccuugccucugaaggauuuaaugacaacugauuuccgaaggaagucuacugaaauauucaaauggaagcagucguaauucacauuuauuugugauuuucacaguauuuugauauacaguuucauuuaauuuuggcucuaaacuuaugauguauguagaaugggcaauuuguugauaauuuuacagaagauauugugauaugguccaguagaauucauguuuuacuggguuauuuuguuuaugcuuuuuuaaggaaauauaguuuacauuuuuacauucccauagacuauccauuuugaacuuaguucauuguccaugauauuuauguauaauguugguuuugauauuuuuguauaugugaaaagucgauacgacuuuagagcagcucuaagaaauaugcaaagauacuuccaccagccuuauugaugagcucuuggguuuaugauuugaagaauacuauuguguuuccuaaacccuuauggacuuuuugauaaaauaggaauggugaagccucaaccuccugcccucucacgguauuuuuucuuucuuucuuucuuuuucuugauaugaggauuuacuuuuaaggcggugacauuuacagaagauaauuucuuaaaaaagguuuuuguuuagagacugggucucucucuguuaccuagacuggagugcaguggugcgauuguagcucacuguaaccuugaacuccuggacucaagugauccucccaucucagccuccugaguagcugggaccacugguguguuccaccacacccaguuaauaauuuuaaacuuuuuauagagaugagaucuugcuuugcugccuaagcuggucuggaauuacaggcaugagucaaugugcccagcuaagaacauaaugugguuauuagcagaaaaaaguauuuugccaauguagaaccuagguuuuauuuuuuugacuacaaauuagaauuguugauuaaguauaaaaaucugauaacagaauauucucuucaaauaugcuucacuaggaacaacccuccaauaguaaaugcuauguuuucuuauuuucagugucuuagaauuauauaaucgaaggagguaagaaaagggccuuguuauuauauauaucucuucccccauuagaauucauuuacaacauuuuuggagaaacuauuuugucacaucaguuuugucacauuuaaauuguaucagauuuuaaaauaauauuugcacuauauaagucaucacaucaauugagaauguuuuauguugauaaauacguagauaaaaaauacguggaaugcaacaaugaaugugcauaauuuauucuuucuuaaagucuaguucuuuuguuccucaagguuuguguuugggaugcagaacuacgggaacuucgagcugaauguuuuauaaaagaaggagaaccuaggaaagcuauaagugacuuaaaagcugcgucaaaguugaagaaugauaauacugaagcguuuuauaaaauaagcacacuguacuaccaacuaggagaccacgaacugucccucaggucaguucuagugacacacaugucugaucuuuuuuaauuguuggcaguaagauuaccucaucuuguuuuaacauuuuaauauuaaauuaauaagaugaugguaguuaaggcuguuuuuauauuguauauccauuuauauauuuuguguuauucccaaguuacuuuaauuccacauaguuuguuuucaugaagcugcuuauuaaacaggaaggcucuuauauuuauagaaacaaaauggaauguuuacuauauaaugcuaguaagucauuuuaauuugaauuaacaaauguaugcaugguacaaugccacguauaaauguauauaguaaauuauaagucucaguaugguuuuuguuuaaucguugcaaacaaaaaauacuuuuauugugauuucuguggaaaacuacucauugauuguuuugacauggaguauuuuccuuuuuuaaauacaugaacagugaaguucgggaaugucuuaaacuugaccaggaucauaaaagguguuuugcacacuauaaacaaguaaagaaacuuaauaagcugauugagucagcugaagagcucaucagagauggcaggugagaauaugguuguuccaacuguccagccauuccuuaugugcggggcugugggcacaagugaacuacagaacugcucuuuuacuucucagccauugagggugggguauucuagauagcccugggccuuagcaaaacuaccagaauuggacauuuuuggaauagggaagaauauaaauaauaguaacuguguaguauccuuaccagcagaauuacuuguacuauaccaaauauuuauuaucuccuauaucaggcugagcuauguacugagggugcagacuuaaacuugacaauaguuuuuguucuuaagaaguuuauagcauugcgugggagacaaauauaugaauugauuauuaaaagacaauaugauaccaaagugauagaauguacauaggauaauuggaguaccaaagaggaguauuuacuccaaaccaggaugguaaaggcaaggaguaaaagaggagcuuuuuuuuuuagagaaggugauagauauuuaaauccuaauccuaaagaauaaguaaaaguggacagaaguaagaggcugugucugugugaguguuguuuguaggggguuuauaggcugggcaggaggacugaaaagaguagagggcacugcagacaaaacugccuaauagaaaauaggcuccaauuccucuacuuuuaguagcuuuguaaguugccaucaugagaaugcuucacucgguuucccccaacaucuugcagacuauaacgccuugcaaaacuauaguacauugucacaaucaggauauugacgugggugcagucaagauacagaauaauuccaucccaacaaggacaccucauguugcccuuauagccacaccuacuucccucuuguuccuaucccuuccuuagcuuguggcaaccacuaaucuauucacuuguagaauucugucauuuuaagaauguuacauaaauagaaucauacaauguauaaacuuuugggauuggcuuuuuuuuuuuuugagacaaucucacuauguugcccaccuguucacagauacagucauaguacacucaagugauccuucugccucagccuucugaguagcugggacuucagaugcaugcuaccacagcuggcaggaugggcuuuuuucccccucauucgaauugucuggagauuuauccauauuguaucaauaauuccuccuuguuuacuguugaguaguuuccaugguauggauuuacugcaguuuguuuaaccauuuauccauugaaggaccugagguugggaguuugagaccagccugaccaacacggagaaacccugucucuacuaaaaauacaaaauuagccgggcgugguggcgcaugccuguaaucccagcuacugcggaggcugaggugggagaaucgcuugaacccgggaaguugagguugcggugagccgagauugugccauuacacuccagccugggcaacaagagcgaaacuccgucucuaaaaaaaauguuuucuguuugcaagucuguccuuuucagguccucuggcuagacagagcagacuucugcagguuuuuguuauugucguucuguaccuguuggcguuucugcauugcuggaaucuucagcuccaagucugggauauaugaaacaaaaaaaaagaacccagggaacgucuuaccauguuuuccucagguccugagucacuagcuagucugucucuuuuccuccuuugaaaguuuucuauuuuaaaaaauauacauauaaucucuaggguuuuuuaguugugcuuagcuggagcacuugggacaaauacaucuauuccacuuucccagaagcuggcuuuuuuguuuucuucuuuaaguuccaggauguaugugcagaauguggagguuuguuacauagguaaacgugugccauggugguuugcugcaccuaucaacccauuacuuagguauuaagccccacaugcauuagcuauuuguccugaugcucucccuccccuugcugccugccccacacaggccuccgugugugauguuccccucccuguguccauguguucucauuguucagcucccacuuaugagugagaauaugcagugcuuuguuuucuguuccugcguuaguuugcugaggaugauagagaagcuggcuuuuauuuuaaauguuuuaguuaagccuguguuuuaauacauuggcauauuuacauaugaagauuguagcacuuugggaauagugugccaccauggcauagaaacauauuuuuuacuuuacuauuguugagggaaauaacugaguauauaacaggauuaguacuuuuuacugguuuaaagaaaaugcugaaauagcuuuuauucuuagaaagcuuauacaguugggaauuuaaucagguaccuuuugugugaacuacguuguacuuuguuguaaauacugacauuaauuauauaaaauggcacguaauggguuccauuauuuucauggaaguguuuacugaccaagaaauaaaacuugaucucuguauuguucaaggugcucaguguaagucagacuucaacaggguguuuuacucagguuuggaauucugagcaauguuucuguaaggaaauucuucugguuugauugguacuuauacucacagguaugcuuuguucuguccaucugcaucuccuauggucauauguuuuuauuuccuaacucuuaauuauggaguguaccuucuaugggacucuagauuaauaagggaaaagccgaaucugaagccaugggcucauccaauuggauugauuaagcaacacauggugaagaggggaggagccuuucuacagcucuggaaaucaaaugucaucauuucuuaucaugauuugcucauuucuuagauacacagaugcuaccagcaaauaugaaucugucaugaaaacagagccaagcauugcugaauauacaguucguucaaaggagaggauuugccacugcuuuucuaagguaacaguugacuuguucccagaaaugugaaaacucaacauguggaauaccaaccauaaauccuugucucacauuuccuuuuaggacgagaagccuguugaagcuauuaggguuuguucugaaguuuuacagauggaaccugacaaugugaaugcccugaaagaucgagcagaggccuauuugauagaggaaauguaugaugaagguaaaucuuuaaggauuugauuugcaguaccgaaguguugauuaggaaauuaucacauuuuaagcuuccuuuuccuuaaaacaaauuuaccagaguaccuggaaauguugacaauuuuagaaaaauggcagagaacuugaaaauuacucuuccauaguggaaccugaaagguauaccaugugaggaaagaguucugccauugaaaccaguucaguacaauagaaaaauaaauauuuuagcuuuuuuuguagaaaggaaaaaaaauaacaaaauagaaaauuuaaauuguagcucucauguuauccggaaguaaucacuguucauuuugcauuuaucuuuuccagcuuuuaucuaugcacauauauuacucuauauuuuaugcacauauacauauucucucucucucucucucucucucucucuauauauauauauauauauacucgguguguauaaaacauaaauacagaaagcauacauacaugucauauaucccuaauauaaaaugauccucugugaccccaagcuguuuaguaacauaggacagcugcuacccuauuuuguucaagccaaaugaaauaacaagagauuccugccagauguugugagguccuuggauaaaagcaguguccuguuuuuggaagauaacuacggcguauacaguaauauacaguuuuugaaaaauagaauccauauauauauauauauauauauauauauauauauauauacacacacacacauauauauauacauauauauauacacauauauauauauacauauauaauacauguauauauauacauauauauauauaguuuugugccuuuuuucaugugacacuauguuaugaacauuuaaaugauacagguuuuuaaaaaaauaaaugagccuuauaagcccuuauugcaaauauuuuguuucaaauucagguaaagcauuuuaaaucaaaaacaguaauuuucucuuacaguuaaaugaaggguucgaaugguaaaauuugguuugugauacucuuuuuaaggcaaaacuggucaaucucuuuuucccugcuuuccucaauuagaaaagaaucuugcuccuaagcaaguucccaguuuccagggaaugaugacaaccuggucacuacuauuugugggacaucuugugggggauucagaccuugaggucucugaaugaggcuugaaaugaaugcagucaaaaugacacuuuaauauuuauaagcaugcuucaauaaggcauguaguccacauagaaaaucccuuuagcauacucguuuucuuuccuuuugagcuaccgugucuacucggugagaugguuuuacucuaggauuugcauuccaguuagcuuuuggaacucuuuaucaaagauacuuuugucaucuguauguaaacccuuagcucucacugcgaaauuagagaagcuacagaagaauauaaagagcuuagcuguuaaaaaaaaaaaaaaaggcuaaaucuuguagaaugcuaaguguaauuugaaagaugcauuuggaacuugaauguuaaacugacuugcuuuuuggggaaaccugauggcuuaauucuggaagaaaaagaugcuuagugcuaauuuaauauaauugaucuguuuuuuuuuuuuuuuuuuuuuggaaauggagucuuggucuguuacccaggcuggagugcaguggcacaaucuuggcucacugcaaccuccaccucccaauugcaaccaauucuucugccucagccuccugaguagcugggauuacaggugugcaccaccacgccuggcucauuuuuguacuucuaguagugaugggguuucaccauguuggccaggcugguccugaacuccugaccucaggugaucugccugccuuggccucccaaagugcuaggaucaauuggcccugcccaauugauaugucuuugaagucuguuguuuccuggaaaaaauucuuuucuauaggaauuuauuaaagagagagagagaauaguugccagcugucuacauuugcaaaagaaagaaagaaaggaaaagagccuguauaacugaaacugauagguauuaccugacuuguuuggacuggaaucagagguuuaguauaaaugauguaaauaaauaauaaucuuacuuagcuaaauaacaguaugucuucaguugaaaucuugaguuagaaauaugcuuuccauauucuucugcuuccugguuuuaccuuucuuagauaagcaauuuaaagugauggcagguacauaauaaagaaugaauagguuuagguuagugaauaauggaacauggacauuuauuaauuuggggcuuaugauagaauuaucaggaaacaggggauuccacucaauagaaagcaaguaaaguaagacuguuauuugaggaugccucugagaucuugaaaaaucaagggaaacucuucagaucgcuacaugucucuguuuuaauagcuuuugagaggaaaaaacugacauugaagcaguacuaaaauauuggcaaaguuucuuugaauauagggguaacucagguguccuuaugaaaugaucaguuauauuugcuagaacuuaagcugugugagggcagagaccuguggcuguuauauuaacugaugcaguccuggugcuugugcuggcacucaucuuugcugaaugaaugaagguaauuuauuuauuauacaaaagucauaguggagaguauggaauuuagaauuaguccugccuuugagucuggcuuugugcaguuauucuauuuuuuuuuuuuuugagauggagucuugcucuauagcccaggcuggagugcaguggcaugaucucgguucacugcaacuuccgccuuccgggucccgguucaagcaauucuccugccucagccuccugaguagcugggauuacaggaacugugccaccaugccuggcuaauuuuuguguuuuuaauagagacaggguuucaccauguuggccaggcuggucuugaacuccugaccucgugaucugccugccuuggccucccaaagugcugguauuacaggcaugagccaccacgccuggccaguuauuccauuuuuuauuuuuaauugugguaaaagauacaguauaaaauuuaccaucuuaaccauuuuuacauguauaauuuaguagaguuaaauaugcucacauugcugugaaaaagaucuucagaacuuuuucaucgugcaaaucugaucucuguaucccuuaaacagccgcuccuuuuuaccucucccucggccccugggaaccaccauucuacuuucugucacuaugaauuugacuaugcuagauccucacauaaugggaaucauauacuguuugucuuauugugcuuggcauguuucacuuagcauaguauccuccagguucauccauguuguagcaugugacaggauuucuuuuucuuuuaaggcugaauaguauuccauuguauggauaucccacauuuuguuuauuaauucauccacugaugaacguuuguguuguuucugccuuuuggcuauuggaguaguguagccauggauaugggugugcaaauaucucugagaucccgcuuucaauucuuuuggauaucuaccuagaagugggauugcaaaaucauuaugcuaguucuuuuuuaauuuuuugaggaaccuccacacugguuuuugucaugguuacaccauuuuacaauuuuaccagcaguguauuaaagauucugauucuuccacauccucgucaacaguuuuuuggguuuuuuuuuuuuuuuugagacagagucuugcucugucgcccaggcugaagugcaguggugcaauaugggcucacugcaaccuccaucuccuggguucagcugauucuccugccucagccuccuuaguagcugggauugcaugugugcaccaccacaccuggcuuuuuuuuuucuuuuuuuuuuccguauuuuuaguagagauaggguuucaccauguuggccaggcuggucuugaacuccugaccucaugcgauccacccgccucagccucccaaagugaugggauuacaggcgugagcuacacugcucagcuggucaacauuuuagauuuucuguuuuuucaauaguagccaucuuaaugggcuugaggugguaccugguuuugguuuugauuuauauuucccuaaugauuagugauguugagcaucuuuucauaugccauuuguauauuuucuuuggaguaugccauuuauuuuuugcuauaugguuucaaucaagucauuuaauuuacuuuuuacucuacuuaucuguaaaauaggaauaagaauaguacuuaucuccuagaauugugguggcuauuaaauaagaugaugcucagaaaaugcucagcaacaucuaaauccgugguuuccacuguacucauuuucagguuguuuggaacuugcauugacuuuucuguauaaacaauauugugugggauaucuagcuagcuucuuggacuaaccugugacugcugcaugaacuccauuugacacagcuguuauugaaguguuacuaguaauaucaauaauucugugaauagggccaaguagauugcuuucucuggaugaaggcuggccugggcaaaauugugaaagagguaaaguuuaucuuuugauucccuaggguguuauccuguuugcagauucuugugcccucuugcuuauccugggacuccacccuguuauacuaccuaggcccacccuaucccgcagaaguauucuguguucaaaauuuauaccggccaggcacgguggcucaugccuguaaucccagcacuuugggaggccgagguggguggaucaccugaggucaggaguucgagaccagccuggucaacauggugaaacccugucucuacuaaaaaugcaaaaauuagccaggcauggugguaugcaucuguaaucccagcuacuccggaggcugaggcaggagaaucacuugaacucaggaagcagaacuugcagugagccgagaucacgccauugcauuccagccugggcaacaugagcaaaacucagucuccaaaaaauuaucuauaucuauaucuauaucuauaucuauaucuauaucuauaucuaaucuauaucuauaucuauauaucccaccucugcaucagcagucucagccaccaacacagcugcguuuuaguaagaguggucaaauuuaagauauuuguugaaaacacugauugguuucuauuccuuaugagauaaacauuuuuaacccaaaggagucugaauaguggaacuucaggcaagugcuugugccaucaggucaggcagccuaugagggagguacuggggcaacaggccugccuccugggcaugaaagagaccauucccucuagcagaucagauuucucauggcugaugcuuuuuuucaagguuguuaaccagggguuccuggcuucuguuuauguggaggacaagggguagagauuggucuuuguuggaagaugcugauuguauuuaagauccuaacuaaaugugacuuuauaaguuggaggcugcuuauauauugccauucuuuauacaacaucauaauaaccauggacacauguaaucagaaucuauaaagcagaugcuucugaaacuuccaccucuugaaauaagugcaucuaccuuagcucagcuaauuaguuggaagcaggugguuagaauaaauggcuaguccuuugcaaagacagucagugggauauggcauguagauugaugaaguucuuuggcuguacauuuccugaacuguaaagucaugcuugcaguuuuuauucacacucgggccucucagccacagcugcagacuucucauuucuuuugaaaagugugugguuacaaggaaaacuacauagcuaccugcugguuugggauuagcacauuugcugaccauaucagcuggguaaaacauuguacucccucuggugccaacucugugaacccaugagcguaauauguaggugaggaaguaggaaacaguuacaauagucaagcaguauuauucagaaaaagauacaaggcagauuuccaaauuaugaaaagcuuaaaguguuggaaguaaaaagugcuaaggaaaaaggaucaagaaggucacugcaggugcauagcugggacagacgcuuagaaagcuguggagggguccuuugccucucccagcagugacaagacacauuugauuuagugcagaggguagguuugaauagagaaagacagucauagauacauguucauuuuggcuuuuuguuaauugacaagacuguaauuuccuaugacuaaugagugugaucucaaguaaugaagaggcuucuuuaagaaaggaaaaaaaaaaacaagauuuuucaucaucuuaaauagaaacagacuaaguauaugaacgaaggccuauauuuguaucugccuacucuagugcuuugaauagaguuggugauauuucuuaaguguugauaaaguacagcacaauauuuaaaaucucauaauucaacagaacugcaauuauuuucuuuguauuuuacuguuagcacuuuuaucucuuuuccccuauaaaaauguuaacagugccucauauguaauagaugcuaaaaauaaagucaacaaaacagauguauagagcauguuagcguaucagauucaguuagugugcaggacaaauuacguccccuguauauagaauuaaacauacuaucucucuucauuguuuaaaucggccuaaaauauaauggcuagacuugcccucagauuugauguuagaaugugaucuaguguaggaaguaguuaccucagugggagaagcugacuuuaaauuguucagcccucuuuacugagcucacagcucucguacacuucugggcucauaacgaggcuguauccuaaguguucuuagauauaagaucuuucccuuuguugucuuaaggaugaauaugcauaaaacguaguaguaggaaauuuuuuauuuucauuguuuauauuaugacagucucacagcagguaaacccuccccccaacauuuuauuaugagaaauuucaaauaaagagaaaaguugaaagaauuucacaaugaacacccaaguccucaccauacagauacugaaguuaacaguuuacuaugccuuaucacauuuaucugucucuagcccuccauuuauccaucaguucaucuuuuuaugaugcauuuaaaaaaagguauuugguuuacuuuucccccagauacuucaacuuguauaucauuaacuugaauuuguuuacugucuuacauuuuuucuuucuuuagggauaauuuuagauacgguaaaaugcacaagucuuagggauaccauuccuaaggucugauacccaugcgacauguuaaagcaagaaaucauuaaugacucuuguuaaagacaguaagucagacuuuauucaagggggacuauggugacagguagaggggccacugcaguggggucuuguacuggggagagagauuggguuugacucugacuccagcaaggacaaauggggauuuauaaccaaggagcagaguugggggucagugggugggauucuugcuaguuaaggucaacagacuauguguugaaggcaggccagggucauauggagaguggagggugaggagugugacagauauugguggggagggguuucccuaaacugauuuagcaggauucuugcucaagcuggauuccacaggaacagagagggaagccuagggucuggaucuagucagaaagaagacucagaggagcugaccaaauuucuggucaaaggagacaaucuuuguuuaacccaacuccugucaagauauagaacauuuuauuauccucuugucucuuaccaaucaguucccaucccacccccccacaggcaacucuguucugauuuucuccaucauggauuagcuuggccaauucuagaucuucauauaaauacagccauguauaguauguucucucuuguauaaagcuucauuccuucagcauguuuuugagauuuauuuauguuauuacauguuuucgcaguuuauuccuuuuuauugaugaagagaaguuggcagacuuuuccuauaaagagccaaauaguaaauagagacccugcgcaccauguggucucuguugcaacuacucagcucugccauugcagugcaaaugugaccauagauaauacgcaaaugaauaggcauggcuguguuccaauaaaacuuuauuuugaaaaacagguggugggcugguagcacuguuaucacuuuuccacuauaaaaaagcagaaaagcauucaguguuucgccaauaauccuauccuugaugaaggauauuucauuucaugcauauaucacacuuuaucuacugucauauuaccagacacuucagcugacuuuuuuaguuauuaaaaagagcugcuaugaacauuauucuaacgggcuuuuuuuuagacauauguuuuuguuuaucugcaagcagaauugcugucauaguguacggugcuugcucaguuuuaaaagaaacugccagacucuuucuaagguaauauauaauuuauacagcuacaauaaaguaugagaguucuaguugcucugcauccuugcaaacauuuuguguucucauucuuuuuaguuuuauccauuuugguguguguuaguaucuauugugguuuuaauguuuguuuccuugaugacuaagguuguugaauacuuuucauguguuguuucuguguuuaaauaucuuacuuugugaaguaagcauucugcacaugcuuacccacuuaaaaauauuugcuguuucuuuuuguuacagaguugaacuuauuuauauauuuauguuuuccccuuuauuccauuaaugugguaaauuaaacugacauuucuaaaguuaaaucaaccuuuaauuauugggauaaacucuucuuggacaggaauuuagauauugcuggauuugauuugcuaacauuuuaagaagugugcaccuauguucaugagggauaauugcucuguaacuuuuuuugguaaugucuuugucagaguucaguguuaaggauguacuggacucaaacaguucaaaauugucccuccucuauuuucugaaagagucauauaagauuggugucaucucuucuuuaaaguuugagagaauucaccaguaaaaccaucuuggucuuggaaguugguuuuugauuuuuuuuuuuuuuuuugguaggaugguuuuugacaaauuuaguuuuuuuuuuuuuuuucauuuuguuuuugcuuuuuuugagacaaggucuugcugugucacccaggcuggaauguaguggcacaauuaugacucacugcagccucgaccucccaggcuaagugauccuccuaccucagccucccaaguagcugggacuacaggugcaugccaccacaccuggcuaguuuuuguauuuuuuguagagaugauguuuugccaugcugcccaggcuagucucaaacuccugggaucaagugaucugcccaccuaggccucccaaagugcugggacuacaggcguuaagucacugcaccuggccuuauuuaguuuuauucaguauaaggcuauuaauauuuucuguuucaucuguguuaguuuuuguaaguuacaucuuuuaaggaauguuucuauuucuugacauugcugaauuuguuggcaugaaguucauaauauuaucuuauuauuuaaugucuauaaggucuguaagauuauuccugcuuuguuucuaauauuaauaauuuguauuuucuuuuuuuccuguugaucauuguagacaaaguuuggucaauuuuguuggucuuuuuuuuuuuuuuuuuuuuuuuugagacagaaucuugcucugucgccaggcuggaguacaguggagcgaucuuagcucacugcaaccucuaccuccuggguucaagugauuccacugccucagccuccugaguagcugggacuacaggugugcaccaccacacccagcuaauauuuuguauuuuaguagagacgggguuucaccauguuggccaggauggucucgaucuccugaccucgugauccacccgccuuggccucccaaagugcugggauuacaggcgugagccacggugccuggccuuguuggucuuuuuaaggaaccaacuucgggauuuguuaaugguuucuauggcuuuucuuuauuacuuuauugauuucugcucuuuaguuccuuagacuuacuuugguuguaccuugugcuuuugcuagaacagucauugauuuuaggccuuucuuucuuuuuaaauauaagcauuuaaaguugcaccuuucacauuuuguuuuacuuucauuauaacuuggcuugaaguguauucuaauuucccuucugacuucuuugaugcauggauuauguauagguguucuaauuuucaaauaguugaugguuucuuagguacuuuauuauuuauuuugaauuuaauuccauuguggucagagaacauacuaggugugauuuccuuccuuuuaaauuuauuuaggcuuguuuugugguccagcaugguaucuaccuugaugaauauucuauguacacuugaaaauaagguguauucugcaauuguuggguguaauauuuguuaguuuuuccaucagguauaaggugagaguuguuaagaucuuugauaaucuguuguggaaauugugaacuuuccugucugucuuuaauauugucaauauuuccuucaagcauuuggaagcucugcuauuagcagccuacauauuuaugacugucaaguguucuccugaugaauuuuuacuuuuauucuuacucaguguuccuguugaucacuggcaauacucuuuuucuugaaguuuuauaugauauuaauagaaucaccucugccuucuugaucuuauuguuugcauggugugucugucuucauucauuuacuuugagugucuuugugccuuuauaaguaugucucuuauagacaucauguaguuggaacuugcuuuguuucugucaauuuuuauaauuauaaucuguguuugaaguguuuacuugaucaauauuacugugauuauugauaugguuguauguaggucugccauuuuacuauuguuuucuuuuuguccuuuuguuuuugaauuuuuuguuccucucuuucuguugucauuuagauuauuugaauauuucuaguauccccucuggggugcagugguuauucacaggugugauuauauugcauuguagucuuaaaccccuggccucaagcaguccuccugccucagccucccaaguagcugggacuguaggugcauguccugcacuugacuguaacgacguuuuaaauaaauuucuaauauuaguuuaauaguuucuaauuauuaguuaccacuauaauugaaauuaaaauaugucuuccucuagcucuugauuuaucaauuuuaggcaguaucccuugucugccugcuacagaagaggaagaacugaguagaccucacuaguuccuuuuguucuuucucaccuucaguuuuaguugaguauuugaucuuuugcuuauauuuacagcuuuaauguaauauaaauaaguuuuaauauacccaaguuucuuucuuacccugucaccuuuagauagcaucucgauuguauacuacugauaauaaggaaauuaguauauuuccaucuuaccuuucagcuacauuuuaaguauguguuaguauacuuuuauaauguuuguaguauguagauuauuuccuguaacuauaauuguguauaguaaggaaaugaaagccauuuaguagauuaauguauuguauagcugcaggaucaagucauguguuugaauccuuagagaaggagaugcaaucauuucaccaaccagggucagauacauggagucucuuguucacagauggccacacuuuuaguaugcuucucauuuggagcaggauuuuuuggaaagcgucaccccgaguuagaguuacugucucucugccagaagaaaccuaugccucugucuuacuaagaacaucuugagauuuuuaaugacaguuuguaugaaugagauccgcucucugugaagauacucuuuuuauauauauauauauacuuuuuuuuucuuuucacucugaagauauucuuuagcccuauaacuccuggcugugccuggccugcugcacaucuuuugccccagaacuccuuucacugccuuucuggguuuuucugucuucuuuuuaaaaauuuaauauaaugucuucaucuuucuuggauucuuuuuuuauuuugcuuaaagugcauccucaaaaagugauaugaaugcgucugaugcuggaagggaguauugcagcuucucagaaauucagaggaaaaaugaauuuuaacacagacuuuuauguauaguaaacuauuaauuaggguaaggauucagugcaauuguuuagaaguuuucuuuuuucaguguucuggagacacuggaaucaccugugguguaaaaguuuggaacaaucucuggaaagacugcugcuuuacugggagguggcuuagugacagcuuucucugugaaaauguuuugugugggcuuuccuuuuugagccaaugaaauucuuuuaaauagguuaguuuagcacauuugcauugaucgauaugacagauguuuggucaacauucuaucauucuguuuugcugaaaucuuuuugcgauuuggccuguauuuuguauacgcuccugauauuuaggaaaguuuguauuuuuguacuuuuaaaaauaguuuuauuaacacuauuuuggcaacauccauuaguuuccuacugugagggaaaauuuaguguacuuccuccucuuccucacuguucuuccaccucuuaauaauuuguugaggaaauuuuuuaggauuugccuuuguaauauuacucaauuuaucaguggcugauguuuucugauugcuucagcugauguaggugggaaugaaugaacuuacucccucaucauccuuccccuuucuuuucccauguuucgucagcuguaucccuucugcaccaucagggcacacgcucugcucugucgcuguuaguccccugcuuuguguuagucuugguucuacgugaaauucagugucuacugguuuuccuuuggccaugguuucuucagccaucacuuggugaguucaucuuauaguaguuuccucagggagguccuaagagaauuuucccugcuuucuucuauguucaauacagauuguacuuguaccuuuuauaucugaaugauagcguggcuggauaauaaaguccuucccucaccccugugccauguaucucguaguuauuguucuguucuuuucugggacuaauguuauggaaaaccuggggccagguuuuuuguuuuuggccuggccguccaaagagcccuuaucuucaagucugaauuaugcuaggauaugucuucuuguugcccauucucagccaggcugcccuggcacccagugcaccuuuucagucuagauccaucuuucacuucaggaacauuuucuuaaucuguuuuggucucuucuauuuguuucuuuuucagcuuaguuuucugcauacagguuauacaugaauuguauuuccuuugccuugucaucauuagcuauaauuuuuucucagccuuuuaaaaaaguauuuuauauaauuuaguuaagucaaaauucacaagagacaaaguaggacauuaaauuauaauaaaaagguucauucauugagaaucuaugaauauaucugacaucaguuuucccaaacacauaaagcaaauauugacagaauugaagcaaaaaauagacagcaauauaauaaugguaggauacuucaguaucccacuuucaguaaugaauaauaaagcaagauagaauauuaagaagggaacaaaaaacuugaaugcacuauaaaacaauuacaccuaacaaauguauucagacagcagaguacacauucuuuucaauagcucaugaaacauuuuccuagauagaccacgugugacaccacaagucuuaacaaauuuuuuuaaauugaaauuuuauagacuaugauuuauggcccaaauggaauaaaacuagaagucaguaacagaaggaaaauugaaaaauucacaaaauaugaaaauuaaacaugcucuugagcaugcuuuugcucaaggguuggaagacauaauauugugaagauggccaugcugcccagagugagccacacaugcagcacaccuuucaauucccaauuuuacuuuucugaaaauagaaaaaaacccacaaaauuacaugaaaccucaagggaccaugaaaagucugacaaucuuaaaagaugaaaaauauuggagacauuacacuuaauaauguccaaacaccaaacaaagcuacgguaaccaaagcccuuugguacugguauaaaggcugaacaccaaagcagugaagcagaaugcagcacagacagcaacucuggcaacaugcucaggugaguuauuugcacgccauuuauugaagcauuauccacaaaagccaauaggcgaaagcaauuuaaacuucccuuaccaaaugaauggauacauauaaauuggaauacaaaaaaaauggaauauuacucagcuuuuaaaaagcaggagguuuucuaauaucuaccauaagacaaauuuugaagacauuuugcuaaauuuaauaacccagccacacacagaaaaauacuguaugaaucuacuuacauggaauaucuaaaguaguuaacacccuuaaaaagagaaaauagaaugauguuuguacaguaaaaacauugaauugaaaaacaccaaaaugugugcccuuuaugaaugugcagucauaguugagaauuguagcuauuuagaauuauuuuuuaguaauacacuguguuuauucaguauuuuuuugugaaauuuuguucugccaauuuauauuccugugucauguuuuaugguagguuaugucacauuguguuuuuaguuuuuauuuauguauuauaauuuuguaugccaauauuugacucuguaaacauuaagacaguguuuggacagaagucagauaugaaucagccauacaucuagagccaauauaauuauuucuguguuuguuugccuguauaaauauuaccccuauuuuaugauuuguauauuuccuuuuuuugguuguuuuauuuuuaauuguaaaaaauacauaacggaauuuauaaucuuugauauuuucuucuuucuuuuuuuuuuuuuuuuuuuuuuugagacggagucucacucugucgcccaggcuggagugcaguggcaugauuucagcucaaugcaagcuccgccucccggguucacccauucuccugccucagccuccugaguagcugggacuacaggcgcccgccaccauacccggcuaauuuuuucuauuuuuuaguagagacgggguuucaccguguuagccaggauggucucgaucuccugaccucgugaucugcccacugcggccucccaaagugcugggauuacaggcaugagccaucgcgcccggccuaauauuuucaauuauauaguuaagaauauugacauuguuagcaacauagcucuagaacauuuuuauuuuugugaaaguaauaugcaauacacaugaaucucaggcuuuuaaaacucucuauuuccauuuccuuuuguuagauccuucauuuuuaucuucucccuuguccucuuucuuguuuugucuucaugucuaugauaguuuugauuuguucuuauuuuucuugaguccugauugcucacauuuuuaccuccucgucaucuggucucuuuccugaguucugauucugccuugugauuacucuuaauggaagugauuggauuaaguuacauaauuugucuaugaugcuugcccagaauuuccucugguuuuguuuuucugauggcuauucagaaaauaguaugcuuuggcuauguuuuucugaugaacauucauuagauaaguuuuacauguucuuuuccugauuuuuaaaauaucuuugaagugauauugugccaguuaaaaaaaaauuauuacucaucauaaaaugaguuggaguucacugcccuagcuauuuguggggcuaguccucuggaugucaguuuuguuuuuuuguuuucugcauguaaggcgugcuggggccagggcagccuucuguaguuaacagucgcaguacucucugcuucacuguuuccacagacauucugcuucccgcuaaaaugauuuugcuguauagcccugcccucucuacuucucugcaccaaaccauggccaggaggucaucugccaccagccccacuugccccuguaccccauuccuuugcuacaccaaagggguguguguuuugcacuucaggaugagcauagaguugcuguucucugggaucugccgcacaggcuguuucacuguucccucucacuguauucucuucuuuaccucugucuugccccaguaagcccucugcuuuaucuccacuaugugugcucuagauuuccugguuccugcaauaugcaagggauacagguugucacuucaggguaagcgcauacucauagaagguguauuuugucagcauuuucugugaucuuuuaccauuuggcuuucucacuauuugcuucccccuucgucuuagguucauggcugauauuagcaccugucagcagcccuuguacaguuucuuuguauuguuuugcugaaaauggaauuuggagcugcacccugucuguuuaccuuguuucuuuugugugauauguuucuuuugugugauaggcagcaggagaauguugguguuccaugggacauguuuauauuggaggucugauauacuauauucuuucaaaggauuucuuugcauugagaguagacuuuuaggggaauaggguggaagcugggaacaccuguuaggaaacuguuuuaaugauucaggugaaugguggcccgcgucacagugcuaacuauggaaaugcugagaagugguuaaacuguggcuauauugugaaggaaagcugauuuggaacuugcuaaugaauugguagggugagagagggagucgcuuguagcugugugcaccugucuuucaaaugcuggucugugcuggggagcucagggcaggcuguaaguaaauaggaccuguucacuggagaacguccccaguggcacuugcccagcugccccagugagcccugcuucacucauuuuacugaucgggggucaguaaaaugaucuauuuaacuuuggucugggugggaccgcuuuuuguuuguuccagguuuguuguagagguuugcguguccuacaggggcccuccacaggcacaccuuucacucugcuuauaguagggauuaaugcugcagccaguggcuccauauacaggggccagagccugcccagccaucccauagucaucucacggacuauccugacaguugccuuauagcuacuucagcuugccaaagugaggguccucggccaaagauaauggcuuccagaucugcuagggccucuuauagugugugcuugcauugugguucucucuacuuagguuuauuacuaaugugcuccugcuuccuaucuuccagaaauuuaucaaaguugcuggucugcuguugucuucagugcuacuaugauuauauuacuuuucgucacuucgguggcaaggaggguaggcaaacgugugugcuuacgucucccauccuaagcuggugauuugcauugcuccucaagaaugugaagggaauauagaagaaaaguaauuugggauaagauuuuuuagauucagaaguuagaaaaugaauuggcuaauacgcaacaugguauucuuuaucuagggcugauauaugucuggcuuauucuauuuuucauagcuguucaguaauggugggauaaacauuggauguguguguguguuuuuuuuuuuuuacuuuaaguucugggauacaugugcagaauguacagguuuguuacauagguauacacaugcuauggugauuugcugcacccaucaacccaucaucuacauuagguauuucuccuaaugcuaucccucccccagcccccuaccuccccacgggcccuggugugugauguuccccucccuguguccacauguucccauuguucaguucccacuuaugagugagaacaugcaguguuugguuuucuguuccuguguuaguuugcugagaacaaugguuuccagcuucauccauguuccugugaaggacuugaacucaccuuuuuuauggcugcauaguauuccaugguguauauguggcacauuuucuuuauccagucuaucauugauagacauuuggguugguuccaagucuuugcuauugugaacagugcugcaauaaacauaccugugcaugugucuuuauaguagaaugauuuauaauccuuuggguauguacccaguaaugggauugcugggucaaaugguauuucugguuguagauccuugaggaaucaccacacugucuucuacaaugguugaacuaauuuacucucccaccaacaguguaaaagccuuccuauuucucuacauccucuccagcaucuguuguuuccugacuguuuaaugaucgccauucuaacuggugucagauaguaccucauugugguuuugauuugcauuucucuaaugaccagugaugaugagcuuuuuuucauaugucuguuggcugcauacaugucuucuuuugagaagugucuguucauauccuucgcccacuuuuugauaggguuguuuucuuguaaauuuguuuaaguucccuguggauucuggauguuagcccuuugucagauggauagaucgcaaaaauuuucucccauucauggcaacaaaauucucccguguagguugccuguucacucugaugauaguuucuuuugcuguggagaagcucuuuaguuuaauuagaucccauuugucaauuuuggcguuuguugccauugcuuuugauguuucaugaagucuuugcccaugccuguguccugaaugguauugccuagguuuucuucuaggguuuuuaugguuuuaugucuuacguuuaagucuuuaguccaccucgaguuaauuuuuguauaagguguaaggaagggguccaguuucaguuuuccacauauggcuagccaguuuuccaacaccauuuauuaaauagggaauccuuuccccauugcuuguuuuuugucuauuggguguuuuguuuuguuuuguuuuuuuagaugcucucuuagaguguggagucugagaaaguauaacuuaaaauggucugucuaguuauaucugugggaagucuuacaucauccauacuuagguuucuaauuaguuuucugcaauugugugaauauaggaaacaaccuauaauuuuacauuuuugucuuauguugggaaaaauguguucaccuuaaauuuuaauacaaauacgauacaaaagacugcuuuggggagauaacucugaaauguaagaaugaaaacauguuuuaaauauagagucugcacaaguagcaaaaucauguauauugaaacaucuuccuauuguauuccuucaaggucuguuuccuuacuaagcuauguguuguguuauggguguucauuguaaaguuaaaccuuacuacuguuuaugaugguuuuguuuuuauacuaaacugggagaaguuuuuuaugucccuguggguugggcuauaguaacauuuaauguaaugaugcacugaugcgagaauucacuuuaggauaaaagauugaaggguccccuuccccagugccacagggccaaaggugguggugguucguuucuguacguaguguguagccugucaaaaucuguuagucuuguuguaggacucuuuccuuaguucagcuaaagacaggggguccuugucacacggccacgaaaaaugaggcucacagacaauuugaagagggcaggacuuauugggugaaaaggaaaagagggaaacaggacucucuacaaggccagagucccagcuagugugcuucccaccuugcagauugaaucccagguuccauccaggaagaggagggaggggccaggcuucuucccgaggcuccaccccagugcacacuccucccagcgugcaggccaguuggaguuuuucugggaaccccuuugcauuuggcugucucagucuuaggccaauaucuuucucauuuuaaucuguccaaggugccuuacauucccuccauguuuagcuguugcgaagaugaguguucacaugucuuuuauccuagugaaaugcauuuucauaaaaacaagaauuuuaucccagcaaucuauuauuggaauuaucuaugcagggagaauauugagaaaaauuugagugggggcuucccuagacuauccccagauuuggugaucugguaagaagacacacaggacucagcauauaguuguacucagggcuuucauuccagugaaaaagcaaagucagcacagggaaaaggugcaagggugaaaaucuggaggaaaccaggcagaagauuccaggacuucucucccugugacgucauaaagaacaagcuuaauuuuuccaguaaugagaaauucuacaaugugugaaauguugucuaccagggaagcucguuauagacacugcacccagaguuuuuuuggggaacuagucacuagacacguucugucuggccugcaccaaaaucccagacucccagaaggaaagauguuuaccauaaacuguauuuuucauacaaacaguucaggcaugagucauucuuaccauggaauguugggaacacuccugaaaucuggcuucccaaacgucagcaguaagccaaccuugucagcaaacuuuucuaaggauaguugucucaggacugcuguguugacucucuucugcauauuagauacccagaugccuuguauuuucuaaguauuuaaaauacugcugggcgugguggugcgugccuguagucccagcuacuucaugggccugaggcaggaggauggcuugugccugggaggucgaggaugcagucagccaaagugacagagacccugucucuuaaaauuuuuaaaaaaaaauacuguguaauaaaauaaaagauguaauguggauagucagcagacuuccuauacugggacuauauguauuuuguauuuugauugacacuuagguuuguaauaguguuaaagccuguggguuacugagucauucggauuguggacaguuccuucuguucccuuucuuucuacaaauuuuuuuuuucuagcuucccauuggccaaacccaccuccugaucccuuucuaaaugucuaauucuucuggacuguugucaauccauagcugaccaggccgauuuucuuuaucacugucuuucuuuccuguguaacaaccacuuagucuuaauggugguaagauugcucuggauaaagugcugauauuaacauauuuacccagaggguauggggagauaaugcgggagggugggcaaguaaacagcaguacauuuuguugaaugagaauaauaaacuaccuaaacucaguuuucauuauuaugccuuuuaaaccuuuuuuuuuuuuuuuuuuuuuuuugagacggaaucucacucugucacccaggcuggagugcaguggugcgaugucggccacugcaaaccuccgccucccaaguucaagcgguuuuccugccucagccucccgaguagcugggacuacaggcgugcaccaccaugcccggcuaauuuuuguguuuuuuuuuuuaguagagacgggguuucauuguguuggccaggcugguuuugaacuccugacccucaugauccgcccaccucgaccucccaaagugaugggaucacaggcaugagccccugugcccggccucuuaaauauucuugaucaaaguuacuaacgggguaucacuuaagguuuuuggcaauaauggccaaagagugaagggguugggggaugacgacuuuagcaucaauuuuacaggauaagaaaaggcaauaaauuauaauuugccuuaacaauauuaucuuaaacauauuuugacagcuauucaggauuaugaaacugcucaggaacacaaugaaaaugaucagcagauucgagaaggucuagagaaagcacaaagauuauugaaacagucgcagaaacgagauuauuauaaaaucuugggaguaaaaaggugaauuauuaauuuaaaauuuacuuugcuauuuuuaaucaacucuguuucaaagcuaaucauugcucuuuuuccucucugauucauuuucuuuacuuauguaauuucagucauauggauuaaaccuuaacagucuuuaacauuagaaagcuacuuugaguauuuuauaggcaaguuucuuugauagagaccaauaaugcaacaacagaauuaguaguuggcaacaaagaugacacuguagcaugaauggguccuaagccuagauuuuuuaagaaggguaaagggguaggagugagauuccuuuugguggggauggaggaggagacggaaugaguaaagaaaaagccuucucuaggccuaaaaauaaaguagugcuuucagaauuaagucugaaauuaagaucuaccuuauauaaaaguacauacuaaguaaaugauacaccucccagugccugugggugaauucugaaauuaaguaaaugauauaccucccagugguucgcugaguaaaccaucaauuuuucaaaauuuggaaucuuugugcuuacuauuaaguaagcuaaugcagaagcauaauugaaaguggcauucagagucaaauauuuuuuaauaccaagaauugaauuaugguaacuuggaaauucagaaaguuaaaaaauucauugauguaccuuuuuuaaaaaagggaaaguucuaaagaucaggagugcuuuauucucaguaaucuuagugagcgaguauccaaggaagccugaugucagcuuuaaugaucauccagaacuguguaugcagaucuuuggccugugauaccauuggaacuauuuuauaaaaccaguuuuguuaauugccaguaggaucuuaaucagcucuucugauuuuuaugauaguauguuagacacuuuuccacuaaugauuauuuauuuuaccaccccucagaaaugccaaaaagcaagaaauuauuaaagcauaccgaaaauuagcacugcaguggcacccagauaacuuccagaaugaagaagaaaagaaaaaagcugagaaaaaguucauugauauagcagcugcuaaagaaguccucucugauccagguauuauuagcuuuuauuccuuugacucauccuagaggugguguuagaagcgaggguggaacaugugguggguucuccacguggggcuguauaggcagugacggguccugagcccaguuccagagguccaguuuuaugccugcccucauucagcccucuuauguugggcacccuccuguugcaggguacaguggaaagacuaucaaauguggaaucagagggccugaauuugaaucuuuuuucuacucaaagaaguuaucagaacuuuuuggucucaguuuuuucaacacugagcauaagaggaucucucagguucccucuaaccucaaaggucaaugaugaauuuucuccaccaagcuuacaggagcuugaugaggaaaccagcuugccaggcuggauuacauggagugggagaagaacagcugucuggccuagggccugcuuugccccauauguguucaccaggaaucuugcccugaaucauaggaucauuagauucacaggcuuauauguguuuuuuuuuuuuuuaauuuuuauuuuuuguagaaaugggaucucacuguguugcccaggcuggucuuuaacuccugggcuaaagugaucuucccaaaguucugagauuacaggugugagccucugcaccuggccacauguguucuuuugccauacaguaauauggccuggaaauuucguuaagagggagacaggcuaagcauugagguaauacugaacaaugcuuugcugcugccagagaauuucauguuaagcuuauacugcuuuuuuguggccuuccaugucagugggaacagcagcugugaucugagcuaaacaaacaaaagagaggaaaguuuuauguuugucaaaucuuuuuugaguacuuacuuaugcaguggaauugaaaguaaaugauccuuuguuuucaaguaauuuauaauccaguaaaggagacagaaauguacuugcaguggaauugaaaguaaaugauccuucguuuucaaguaauuuauaauccaguaaaggagacagaaauguacuucccuuaucaaguaguguuggauacauacuguccuguuacuuagcaaauacugaguggcuacaaccugccuuaagcaguucaauccucuuaguuugugcagugcacaggugugauaguguaucagacugggagucaggaucuucuuaugugagagggacuuugugcuacguuuuaagguaccagggagccaaccaaggggaugggugucccugcacagaggcaugcacugaggaaagagcugcagguccuuuuucuuaccuccuguucuucuguucaggaugaacuaucuuuucuuuuaaagacuuuaaaguuuuuuacuaugcauauaucaagacgugucauauuuaggaauauguuuaguagaaucacaugauguaugccaaucugaaacuuaauuuucacuugaaauaaaucuuggcuauaguuuuuucucauugaaaaaugguuaccucauucuuugagauguaugcagaccacuccacugaauuuuuaaguaauuacauaaugugaauauagcugaauucacuuccccuuccauucacagcauccuuucucuggggccauuaucacccccaccccuacggagaguucacuacuguucuaagugcuaacacccuagauuaauuuugccugugagauaucaaagauauggggccugagucuaacugcauuagcuuuuauaaaacaaagcugaguuucagaucaccuacaauacccgcuuaguuauuaacacucagcauaagaacccucaguuuuacugguggguuuccuccuccuaaauauguggcuucagauuaaccucccagaaugaaguaaacuggcuuuucucuaaguaucuuugaaccccuaaaggacaaguuacugugagagagcaaagcgagacuugggauuauuuuuauauuugcauuuuuuucugcauucucuauuuuccauuuauuaaaaaaccuagcuauaugcuaagucuuuuuauuuuuuuuuuguaaguucagggguacaugugcagguuuguuacauagguaaauguguguuauggggguuuguuguacagauuauuucaucacccagguauuaagucuagaacccauuaguuauuauuccugauccucucccuccucccacccuucacccuccaauaggccccaguguguguuguuccccuuuaugcauccaugaguucucaucauuuagcucccacuugugagaauaugugguauuugguuuucuguuccugcauuaguuugcuaaggauaguggccuccagcuccauccaugccccugcaagaggacaugaucucauucuuuuuuauggcugcauaguauuccaugguguagauguaccacauuuucuuuauccagucuaucauugaugggcauuuagguugauuccaugucuuuucuauugugaauagagcugcaauaaacugauaugugcaugugucuuuauaauggaacaauuuauauucuuuuggguguauacccaguaaugagauugcugaguugaaugguauuucuuucuuuaaggaauugccacacugucuuccacaauggcugaaugaauuuacacugccaccaauaguguauaagcguuccuuuuucaccacaaccuuggcagcaucuauuuuuuuuacuuuuuaauaauagccauuuuuuauuugcaauaaugaucuaauuauuugcucuagugaucagugauguugagcuuuuuuucauaugauuguuggccgcauauaugucuucuuuugagaagugucuguucauguccuuugcccacuuuuuaaugggguuguuuucuuguacauuuaaguucuuuguagaccuuugucaguugcauaguuugcaaaaauuuucucccauucuguagguugucuguuuacucuguugauaguuucuuuugcuguguagaagcucuuuaguuuaauuagaucucauuugucaauuuuugcuuuuguugcaauuucaugauggaaacaccaaaagcaaucuuugcucauaccuauguccugaauaguauuugccuagguugucuuccaggguuuuucuaaugacucugaggacaugagcucuuucuuccuaucccugcaauauuccucuuuauugccuucucccaugucucugcauugaucucucucuguucggggcucagaggccccgcugugggggcaccaauugcaugggagggaaaggugaaccuccuggaguuguauguuauggaggccccgcuccccucaugucugaggagccuuagugcuagaaugcucauuagaugcuugaugaggucauugccuuacagacuuuauuuuggggauuaggguggugagcuggcuguuucauuagaauuguagacucuuggaaguuucucuugaauuauuuuuuuccaaauaauuucauuggguaguuaucaagcuuggguggcuucuucuggagugagauuuaggggccugaaucucaauaaauaccuauuaucaacccugaaccucacccuccuuguggcaaauuucucuagucuguuucuucagggugggaaugggagagccuggauuugaaugucaggcacaacucuugauaaccgaaaaguaaguagcuccucaagcccacccacccuccucugcccaaagaaaacauucccccugccccuauaccuuagauauuaucugguucuuaauuuucugauuucuuucuagaaaugagaaagaaguuugacgacggagaagauccuuuggaugcagagagccagcaaggaggcggcggcaacccuuuccacagaagcuggaacucauggcaaggguucaaucccuucagcucaggcggaccauuuagauuuaaauuccacuucaauuaaaccaacuguuuuucugcucuucuuaauuuuuuuaaagauuaaaaacaaagaaaucuuguuccgggacccuaaugaaaaaaaauuucaaaucuuuucaguuuguccaugaccaaagaguugcuuuaauaggaaaaaaucuguucuuaucccugucagauuuaugguuaauggguuugcaacggcaaggaggcaaggaaugguucuauuucugacagagcagccugcaucugcuuuaugcugucuggagggaaguggucugaggcaggcucacccguggaagugcucacguauucuguauuauuuuucuacacuggagcugagauucuucucuucacagccuugcagaguaagucagugccuacaaguguaagaaggagcuguaaucuucaugaggaugguuauacuucaguauucuuaaagagaacaugaacauuuuugagcuguauguucuuagggacaacugugcuucgauguggucagucucgucacuugugaguagcugugaaaucuuuagugugcauguguuugcaccucuguggucugucaacguggcugucacugaaggagcaagagaccaucuuuuaggaacccugccaccaaauaauaauauauccaggcuuagacuuuggauuaauguuaaauguacauuuuuuugguucaguaccugaagaagaauacugaaacuugaaucuauaaauuccuauggacccuuuuaauauuaaacacaacaaauuaaaaguuguuauagguaaaauaaguucagauaaaauaguggugguauuuaaaauaauauugcugaagugcagauugaaauacuuuuuaaacaacugaaguucugaguuuuuauagggaauuucauguaacaagacugguuuagaaacguaaaguugcgcagucaacauaaauaaauacagaaugccauguucuccacuucuaaguaaagacagugggcagcuucuguuucuccuucuaucaaggcuucacccuaucuuaaaggucuguggugccucccacgugggaccugucugcugguauguguuaaacagcagaccggcccuucuaccagaucuugaugccucugauuuucuccugccuacaagaaaauacaggcaagguuagucaggucuggcuauauuuccacuguuguuucauuuaauaagauggcaucuccucuugagauauguucuucuuaccuuuuaagaagauacuauuuaagaagugaacuauucagucuuuguauacugaaugcuuuuucccuaaaaaauguuaaucaagaauauugaauauuuauggcacucuugaugcugcauuugaaagcugaaggaauuacuuuagauagauaggaauugcuaccuuuauucuggaaagguuuuguuucugccucaaagcauuuugaaguguuuuaaccauuaaagggucuaauuuuuuuuucuuaaugaaaucaagcauuuuaauucacugugggaggcauccugaccacggacauccauaacagcaaagcacaaaucguuuucgucuguagucauauccugaaacauagguggacaaauuuuuaacugagagacaaaaaucacauaguugaauugagcagaacacuuaagugcuuucugcaucuauuuaggagucuauuucuuaccaauaaacuugacaacgcauuuggaaaacuagugaacaccuuacagcuuucauuuugcuuuaauguuucaauucaagccgguguaaaaauaauuuccaaggcauuucuguuuauucuuuaguaaucucacuacuggcuaugucagcaauaucuuuuucaaucugguuccuuuuguauaugaugucacugugaccucuuugaaauauagugauggcuuuuaccuacuuugaaaagaauuuucacauagagucagaaaaaaaaggaaauaucaaaucacuugccuuuccacuuggagagcacgacaguugccaacaacaaggggucaagggccgcacaggagaugugugggggccuggccaccucccaccugcugcccagaggcuuguuugcauuuucauuuuuucuccacuuguaacaaccauaguuucagcuccuaaauucuuaucauggauuuacuuagucaucuuaacugaccugcaguuacuugccuguuuucagugaagagagagaagcagcucuggugccacaugccagugccauggagggaaaugaauucucugcaaucuguuguuucgcugauucaugaagaaaguaacaacuguugaguuucagccuugauggcugucggcaguuuucugguguccacccaaacggagagacagucacuccugcuuacccuaaugugugacugagaagcagccuggguguguaaagagauagucauucccccugccugucucacuguaggguagcauuauccacuguaaaaccauacuacuuucauuuucccuuggggacuacaggugccagguaaccuuuuuuuuuuuuuuuuuuuuuuuuugagacagaaucuugcucuguugcccaggcuggagugcagggacaccucccggguucaagcaguucuccugccucagccuccaaguagcugggacuauaggcacgcaccaccaugccuggcuaauuuuuguauuuuuaguagaaaugggguuucacuguguuagccaggauggucuugaucuccugaccuugugaucugcccgccuuggccuuccaaaguguugggauuacaggcgugagccacugcgccuggccaucagguaaccuuuauggcucuuucaggaaaagugaaaucagagaggcguacccuagccacagcuguuguauucugcucuucuuuccuuuuuggugagcuucauggguggaguuaucaguggucuguacuuuguggauauuuugcccagcaggaaguauuagacacaucagucuagaagcauugugaaaagguuccaaaacgggagacaaaauuuaauucauuccucaguucugaaaguuugugcuuucuuaccaugaauagaugaaaacuugaaaaaaaucuugacaguuuacuaaugugaaucagauguaacguacuacuaauucuacaaugccuuucucuuuagucaguauuaaaaaucuuuuuuaaaguauugguaugaaaacaaauuuuuguugcccugauaauggaauuuuaaaacuacccacaguuuaagagaaaacauaacuugguaaaaaagguagccaauaaaaccacaauuugaaauugauaccauuuucuacucacaauggaugaugaaaaauuucaccuuuaaaugggucagaaguugucuuugacauuuaccaugaaaaaacuacauaaaauggcucccuggugagguuacagacacggcccuggugaugggcguugcaaaguuuucacugagcacacagcaaugguaucaccuagagaaguucacgcaacuuuguugaauguaguugacuuuuccaaauuuauaaaggaaggaagaaggcaaauguuaauuugccaacaacgaauauccuuuuucuaaaucagaucauuccuuuuuuguuaguggcaguuuauccuguaauuucaaaugacguuaagaggugggauuauuuggggguuuuuuuuguuuguuuacagaugaucucauuugcugaaugauugauuuaagaguaaaauuagccacugcguggcuuuguguauaguaaccgguuuuguugcacuugucuguggcugaaacacuuaccugcaguggaaagccgagcaaggaggagguaaacauuggagauguuugugaaaauauuacucuugcugugagguuuuaguuuguuuugaaugagaaaagacuaaguaacuuaauccaucucaauguaguguuuuaauaaaaaaggaaccuaauauuugaaaugggucucagacaugucuacaaauauggguacuauuuuuaugcccguguauuuucacauuuaauaaaaauauuuauggucauaucaguau

SEQ ID NO: 192524 - RNA, 126942 nt, Homo sapiens
ucggcgcucgcgggcucggcgggcugugcgcgcccacuccggcuccagcggccagcgcgcgcgggcccaggccgcccggcuccagcccagcaguagcggcagcagcggcggcggcggcagugcgcgcgaggcccugcgcccccagcagcuccucccuggcgccgugcauggagacgcggcccgccacccgccgcugagcccccgccgcccggccgggacccgccagggcugggguggccucgggcuccggccggccccgccgcccgagggcugcgcgcggcccgcgggccucgccgccccgcgcggaucgucgcggcccggccgucccgucccaggaaguggccguccugagcgccauggcucacuccccggugcagucgggccugcccggcaugcagguaggcgggcgcgggccgcggggccgggaugcgcgaccggggcggaagcagcaacuuggcgguauccacacggcgucccccuacgcucagccggccggggucgcgccggagccuggcuccccgcgcgcccggcucggccggggguccgaguccgagucccugggcgucccugccggcuccggcggccgaggucuccggcgugugcgugcaggagccguaggaaccgcggccuggguccggaugugggggugcgggcgccuaguccuccgcgcuccccucgccccaacacucuuccggagcugcaggcccuggguggcccuguccccgggagaagugagguggagugaugcccuuggaggcccccgccgggucccggggcccugcgugguggccggguuggcggagggccccaggacgcgucccccaggcucgucccccacccccgggcaggcgggcgggagaccugggcagggcggggacggggagcgcgccuggacucguccgggcccgagcggaguaggcaggguggaguggaggaagguaaccgcgaguuccacuugcaguggcuuugcccggagcccccgugcaccugcggaccgggggaaagugcgaguugcaaaccuucuggaaggaggaaucccucggacagccgcgcaccagggucccgggcccggccccgggacccuggacuuucacuuugagacuugguugcauuuacaggaauucuucgcccaguaaaccucucuuucgguacuuggugacaccuuggccuaccagugacuuuuuggggagugggagaggaguugaauuucaaauuuacauguauaaguuaaagguuuuuuguuguuguuguuuucguugucguugcuuuuagcccuuugaaaaacaaagcuaccguccuuggcuaacucuuguaaacuuuguaggcgcagaaaugguggcaaaaugcuuaggauggaaaucuuaggaugcaguuaggauaugucaugaaaguuugcucugccaguuuagcugagugaacguuaaguguuugaagaaaaccaaaagcauccaaguagauuacugguugauuuacagguaccaacaggcuccuucccugugucuugagggcugagaagcacagagcccagaccugggacugccucuggggucugcucgccucuuccagugagaucaucccucucccuucuuuuuuugaaaccguaaaaagaaaacuggauuucacuguucagguuugaauucuggaaaaauaggaacucaaaguuaccacuuuaauggcagcuagaauuuuaguccaaguguguguguguguauauguguguguguguguguguguguauauauaagcaguauauauauguguguauauauguuuaagcaguaaauaaauauacauuuaagcagcaacaguuaaguuauuaucuuaagagugacugggaagaugcuugaagaauauucuuuugucgacucucauuuaaggagcguugaauuuagcaugcauucaaaaccuaaacuucugcugacugcuggguaacaaucagaugugguuucuugguauuuucuaaagccgcuuugguaugaauuuagagguguguaggucagagugaacugggugaaaaaaguaauuucuuacuagucgagcaagaaaggacucuuguaaugauuuaaaaaaaaaguuuuaucaauauuuccuuuagguugauauuuauaccguguucaucagguuggaaucuagcacaaaugccucacuuacuagguuaauuggccuuuguggauagcgaaucaguuugaaaagguacuaaagccccuuuggcuggugccgugaagucaguaucagaugguuaccaggugauaucuaguaucucaccuuuucauuuuuauccucacuuuuuuuuuugagugggucagaauucuuaaaccuugggaaaagaagauacauuuccuuaauaacuuugccucucaacuauuauguaucuguuagguuguguuacaugggaacuguuuuuauuuuguuuucucaguaugaaagaucuuaaguguuucucaguggaaaagaugaucagauuuucagcuguuacaguuuuacaguuuuagagguagguaaguuggcuucugccagucauuccuguaccuaaguacaucuacagacuguaugguaacaguguaucauuuggggaagaacauucuuuucuccucccccaccccacaaaagaaaaacaacagcacauuuauuuucuacuucaaauuagcaguugcuacugcccugggaggcuucccuaagaguuguugcugaagauucaauuaaaaacacaccugcuuucgacuguugucugcuaaaugggaggagagaaguccguaucucuucuauggcuugcucugauaggccucauagcccucccuuuuucuugucuccugaccagggcuuauaaggaguuggcuuagaaagacagcagagucuguaaucucagcaguuugagaggccgaagugggcggaucaugaggucaggagaucgagaccauccuggcuaacauggugaaacccuguuucuacuaaaaauccaaaaaauuagcugggcgugguggcacacgccuguaaucccagcuacucgggaggcugaggcaggagaaucacuugaacccgggaggcggagguugcguugagcugagauugugccguugcaccccagccugggcgacagaggcagacuccgucucaaaaaaaaaaauaaaauaaaaaaauaaagcagagugaauucagguggccuaggcaaggaugcuugaaaaauaacaaccauguuaguauaaacaccauuuuucaauguuuugcaaaucauuuuuaugccucuugauucuuaccgguaccguuugagauguagaugauauuauaccauuuuguagauguggagaccaaggaagacuuaacugaccaaggugagaucauauauuauguggcaaauuugugauuggaaacuacuacuccuccuacucccacucaucaugcaguguuacuguuuuaugguuacuuuugcaaacauuaaaguuuaucucauugcuaguuagauuggcuaaagaaauuagaaauaggaggcugauuuuuuaauuuauucaaucagcaacccuuauugaacuuucaugugccagguccuaggggagggguugaaagugguagaucugaaugagguuaccauuuaaaguaaauguuuaaugaaaguugcugaagccuuugcuuuuuuucucuuaaaccccaguuuuauauuucaguaggggaaaaaaauagacaucagaaacugaaugaauauagugacgaauaaacauaaagaaaucaggcugaucuguggcuauaaguacuccgucuuucauugagcauuuguuguuucacucaauugagauuaaaagaaaagcuucagauggaggcaggaacaccaaucggcuuugaguuugcagaaaugugauuuaaaaaugagauuuugguuugcacauuucuguuacaaaauuuuaucagucacuuuucaacuuuucugaaccgugacccauguaagaaauauauuuuacaucaggaucaaaaacaaguuucaggagaccguacuaauccuuacuacggguugaguaucccucauccaaaaugcuugggaccacaaguguuucgaauuuuggaauauuugcauuauaugcuuguugaacauccgaaaucagaagugcucccaaugagcauuuccuuugagugucauguuggcgcugaaaaguuucauauuuuggagcauuuuggaucagggaugcucagccugugcuugugaugugcuguugugguauauuuaaaaaaggagcugguugcaacacuagauugauuucacagcccacugauuccugacccacaguuugaaaaauacugaauuauauacgucacauguauugcauauugcagggccugguuaauuuaccauguuuugaaguuguaaguuuaacauaguuucauauuugaaaauacagauaauuuagaggaauagcuuaaaaaccugaaguuugucuuguuaacaucauccugucccccucguuccccuucuguuuuucuugcugcuuggauaaauagaccuuugcugagaaugccccuugcaucaggauagugagacuggugucuaauggccagucugggaacauggggagcuuuucucaagugcucugcuccacccuagggaagccugugcacucugggagucugggaaaugaaggcaaacacaggacagcugcauuuaauuguggcuuaagugcucuuguacuuuuuuuucuuguuagugucacauuuccacggguucuuuuccguuccuuccuugggaggugccugcccaguuacccuguuaccaucugcacccugggggaagguuggugugucacuggguguggacagucaggacauccgagacguggguucggagagcaccuuggggacuugcugaacuguggagugugcucuggugacugacagcauuggacugcacaggggagccugcagaguauagugcccggagucguuggaggcagaguucagagccucaguccauccuguccucaagaggucggcugccugcuuuggggcaugugcucuaagaagguugcagugacugaggacacagugagcaaaggcacaugguuggaaagcggugacacagcuucuggugggcuagaucuagaucgguccuggagcugaagaggcaguggggugccugugggccugggggaggccuugcaucuguagacagccggaaguauggcacauuuuugagcagaugaucuccuguucuuuggggcuccugcuuucucagguguggggagugcugggugccccuuuagaaggcauugcagcacuucagggaagaggaagcccagggaugcgaguggggagcccaggugucaguaggacagccuaaguggauuuuuuuagcauucacucagcuucguggcuugaacucucagugaacauuuuauaguaucucauuacuccucuugcuuuaugauccuuuuugcugaucagugcuaaagaguaauaaguacucaguuacuguuaguuacuguuuuguuaguuaguugccuauguaagugucaaaaaaacaaaaaaccuauuuugaauacuccguguuccaaaauguaacaaugguaagaauuuguuuugcuugaaaguguucuuuuuugagggggaggauggucacaagguuuuuuuaaauuagaaaaacccaaacuuuuggaggaguccagucucagaucugggaguauucuugauagcaugucacauaaaagcaagugaccuucaaguaggaauuggucagaugagauuuucuagcuugcuaacugugcugagcaguuaugggcagguggcggcuggcaucauugcuuucccacccucuuucugacuuugaugcucuucuuggagcuacggucugaugcguagagcugagcugccuaauguggugcagguugaguuucauuuucaguucaguauuuuuccaggacccuggugcaagaugcagggugagcaguuacugaagggaggagccugucgauggucacugcuacuuucugcugugcuugugcgguuacacacacucuaaagccgcaguccaggcguccgauggucuccugagaaacgggccccuuagcucuuuauuugggcgauuacucccgaugauucagagcugcccuuguggaagcuccuuaccugcaggaaguggaccacacccaagccaccuuucugugccuuuuaaugccuuagcucagcugauuaucauuaauggaaucuuguggguggugugagugcaggaaauagaaguugcacucuauuauccaugucucaucgcguagaaucagccacugucgucggaguaguuuguagcagucauuucccauaauucauguuuuugcaguggaaauuauaaaaaauauaagugccaaaugcuuugggaaaaauaaccugccuccugagggugacuauggaguuucuuaauccuaaauggcucccugguuugcaagguuuaaauuaggggaaauaaacugagauaugccuuugcuugguacaaacugugaaacaucccaaauuggugguuaccagucacuuuaugcgcacccagggaacaacauuguugacucuagagaccuuccauuguguuucuugaggguucuucgucagcaaaagaaaccuuuucuguucugcgcucuguugguaucugaauacauugugggaacauuucaaguuuuaaauuaaugcuuaccaaguacguagcugggguuuaucuuccuauuauuuuaagucucuuccuguuuuuuaagagaauuuuaggccguaagguuugaaagaacuguuacagguccacauccuuuguuuuauuuguaauuacuuaggauuuuguuuaguuucuauuuagaaaugucuaauggguaguuuuguaagguugguugggaaagauagcagcugcuuccaccucccgccauuucuuauuccccgagggcagccccuuugaucucuccugguugauuuuuguuuuuguuacuccuuaguuuaugaggaacauuaaaaaauugaccgggggcgguggcucacgccuguaaucccagcacguugggaggcugaggcagguggaucacuugaagucaggaguucaagaccagccuggccaacauggugaaacucugucucuacuaaaaauacaaaaaaaacagcugggcgugguggugggcgcauguauucccagcuacuugggaggcugaggcaggagaauucuuugaaccugggaggcggagguugcagugagcugagauggugccacugcacuccagccuaggugacagagugaaacuccaucucaaaaaaaaaaaaaaaaauuucugccuguguuuuuuuuuuuuuccugguuucaggcauugucuauagacuuuggacccugcggaugaggauuuacuucucuuccgcuugccucuuuuccucacaugggcuccccgcucucccccagcagagagauguuguaaugucagugaggucagaaugcgguguguacauuaauggacugcagacggaucugcagcccagccauuauuacucaaccauaguuacugaucagauuucuuuucuuuugguaaugcuucucauucaucccagcacucuguaguuguugcaaccuugucuuaggaaguucggguggcaccugugccuuucgucaccugcguaucuucuaugcuucuugugccacccccauccucuggucuuccuuugcucucauccucuggguuccuucugcugcucucuuguguugaauaucuguuuuguuuuuuuuuguuuuuuuuuuuuugucucugcugucauuuucuuucuugguuuaugccaugauguugguugggcauauagugcgccauuuucugugaauaggcagcgugggagacaggcuuuucaaaaauuuuuuuucuucucccucaguugauauuuuagcaugguguaaaauugcaggguggacauucauuuccuccagaauuuuaaagguguuucuccacuguguuuuagcuuccaguguugcuguugaagauggaggcccugccagcaccggcuucugugugugcaggcugugcuguucuuccuggaccuaaugggaucugaacuuuuuccuugaguucugaaguuucacaaugauguggcuuggaguggggcuguuuucguuucucgugacagauacuugguuaggccuuuucugugaagcgacucagaucuuuucauugacuuuuuucuuugauuccccuccccccuuccauuuucuguguucuuucuuucugaaacuuuauuacuuggauggugaaccuucugcaucggcccucaaauauucuuuuaucuuuuuuguuuuucgagauggagucucgcucugucacccaggcuggagugcaauggcgugaucuucauucacugcaacaucugcccccccagguuccagugauucuccugccucagccucccgaguagcugggauuacaggcgcccaccaccaugccuggcuaauuuuuguauuuuuuaguagagaugagguuucaccauguggagcaggcaggucucgaacuccugaccucaggugauccacaugccucggccucccaaaguggugggauuacaggugugagccaccauccccggccuucauuccccauuuuuaaguaugcugccucugcuuccggcugugucugcugcagccugguccauauauccucaauuuuuccuuccuuugcagauaauauauuuucaucauuuccuugacuuugggagccuggcugugagauguggggcaagcugucuggcugucuacccacuucuguggcugacuuugaggcucugccugguucacucauucccccggcagagggacuggugccgucaguuccugagagccggggguccagcacugugaguuaaguuaguucucugcuggcccggcgcgauggcucaugccuguaaucucagcacuuugggaggccgaagcggguggaucauuugaggucaggauuucgagaccagccugaccaacauggugaaaccccuucucuaccaaaaacacaaaaauuagccaggcgugaugauacacgccuguaaucccagcuacuuggcaggcugaggcagaauugcuugaacccaggagacggaaguugcagggagccgagaucgcgccauugcacuccagccugggcgacagagcgagacugugccuccaaaaaaaaaaaaaguucucuguuuucugcaccuccgguuuagcguugucuuccucuacuccccacccccccccuuuuuuuuuuuaaaccacuaccuacuuuccagcuucugagauuucauugcaguugucuucucucuguuucagguauguggugguuuuuagauuuaugauuuuagugggauuucaggauugacccaauuagaugcugcugucugugugaccccucuaccuccaaguugcuauucuucaguuuauaggugaauaaagacagggccaggcaggugaggaaauuccaagagcuaggacugacugcugggccagggcggcgggcaagaacucggagccuccguucucuucaucaugagauugugccucuuauuuucucccuguaaauaaacagcaguauacaugucugcuuauuuuuccaucucucuacuggucgguggccuccaccuccccaacuugaacugagaaccugcucuucuugcuucucucauuuuuuuggucccaagauccuguggacacagaacgauguccgggagccucauaggaucucucuggagaaacgcuugcuuaaguuuaugaugcuuugggguuccaacccccugguccagaauugaguaugugcuucuuggcagggcggagguggcaucagucuggucguauguuccgugguggucggugcaggacuggggcacacgugugccacagaugccgaauagcccgucagagggccuggguguuauguggcugucccaguggccauguguuagcagauugcauguugcagagucaguggugucugcgcgcugggggcacugcacagcgcuggccauaaauccauagcauguuaauggauggaggacuugaagggugcguaucuaaacagcgaaagcucuucuuugggguauggccuucaagugauuucuugcuuaaggacagaguacuuucuuggguagaauuuuacagcaacgaaccauugaguagaaaugaaaaacagucuggaacuugggacugagccuuagcccgcaguuauuuuagguauaguuucgucgaacuuuggaagcguguucaauguggugacuucaaaguuauuaaacugccacuugaacuccagaugaagaaagguauugcuugaggagcguuccugugguaugugugauggaugcaguuuccugguaccaaauauuucuugagagguaauucacacagaaaaagcugguagcacaaagccucacuucuucagcaguucugcagcagagcuuucuucucccaccugcuucccuguugcuugcuguggguagguggaaggacugagccuguggcauggcuggauuuaugucagucuagaaaauaaacaucuuuggaauuuguugcccuucaugggaagccuugucggaaggggacugcuuugauugaguuuucuucagugagggccaggccucuuggugaacccucagggucucugcugagggaauggcugucagacuaauuuuacagaugagaaaaccgaggcuuaugaaaccugcccaaggccucggcuagaaaacagcaucacuggggcggaagcccugacugggaggccagcauguguguucuuuuccuuccucccgacugccugcucccuggcgugucagauucccugcaccacauccccaacacagcucugcccuccugaccgucacauugucccuccagccuccaugaaacagcugaguucagggcugugaacagaggguguuuugggcguuuuuauuuccuuguuuuuaaccuuuaaagaagaguguguucauguuucauuguuauucauuuuuuuugaggaaaagaaaaaucuccauuucauugagggcagguccuucccccauagccuggcgugcuucuggcuggcagcgugccuggcacagcaaggugggcagcuggcgguguggguccuugugguccugugccggaggggcugggccuucuugguggcgguugucugcgugagaggagguagcugaccuuggcugccacccccaugccuaccgccuggugcuggagcagagggagcccugggccuucagcccaccgggcuggcacugcgcugucugugcacuccuccugaucgggaaacuuguuccuggauuauuuuuaacuggcuuccuggaauuuaggauuguggguguggggggcggugacuuggacuuucagauguuuuccuuguuccuuuaucuccauucucuguagugagcucugagccccaccuccuuagggugggcauggagcugcugacuggcuccuguucauugccuuucagguguugcccagacuguguuguuuuggauggugaagaaauaacugaaaaaguacccucuaaucgaauauaauuuuuuuuuuuuuuuuuugagauggagucucauucucgugcccagacuggagugcaauggcacgaucucggcucacugcaaccucugccucccggguucaagcaauucuccugccucagccucccaaguagcugggauuacaggcacccgcgaccacaccaggcuaauuuuuguauuuuuaguagagacaagguuuuguuugcccuguuggccaggcuggucucaagcuccugaccucaagugauccucucgccuucgccuuccagagugcugggguuacaggugugagccaccgcgcccagcccucuaauagaauauaaggccacucagugucaccuggagggguugguaaaaugcagacuacaggcucugcccugcugcccuggaguuucugauucugggcgucucggagggaguuuguguucugagcaaguguccugguguauugccgccucgaggaugacacuuugagaaccacugcgcuggagaaucaaaaaagaauccugaauccucauugcuccccacucuagugaagcacacaguagccuugcccauuugaaaagcagagcaagcuacaaucagugcuugcagccuauggcuuguauuuccaaagacugacuuuggaaccgcugaccuaacuuugggaauugaauaggccuguaauuauaagacucauuagagccuuugcgauuuuagcauguauuuauaaaccuguugggggcagaggauguguguuccaugucuuuuugaccuuggaaccuuauuuuuauuuuuagaaaugggaaucucgcuauguugccaaggcuggacuugaacucuuggccucaagcaguccuccugcuucugccucuuaaguagcugagauuacaggcuuaugcuacugcgugccacuuggaaccuuauuucauaaggagugcaucucucaagaucuagggugcaguagucuuuuuggaaaaccccgaacuagaacaaaugcucugaaccugauaauucucaaauuugucaggauaacuuuucuuaacugugguauugccugcugcuccugacuuccugaucagauguagacgccagccuaaaacucagggccuuuuuuaguacccagcuuccuccucucugcucuucagcuccucugcccugggugggcucagcucccugugcuccuccaaagcucagugccuguuccugggccuuugaaccuaccccuccccaugcucagccacugcaggauucucagacucaguaccgcuugccuuccucugccuagggagcccucguaaggggaagcccccgagcaagcucuguaucaucuguccagcuccucuuagcuccaggugcugggaugccgcaggggagagaagggcauacccgccgguguuuuucccacugaugaaaugaccgucuuugguuagaauugauuuucuuuucucgguagcuguuguauuuaacacuuaacuaaauguaauacuauacauauauuucagaaugggaaaaaguauuucauaucaguagaguuuucaauguuugggauguuggcuuuuauguauaguugauuugacuuuugauucagaagugaucucuauuucucuguuaucucucccccccauuuauuuuaauaaugucgucuguuauuaggguguacuggauuuaguuacacuuugauuuuaccaggcuuucuuauuugaggguuuugggguuguuggcuuugcuuuugguuuuaagugcauuguaguuuuucugaggcuuguuacaauucauuacaugaggaauuggaaacuuuuuuuuuuuuuuuugagacggagucucgcuccuucacccaggcuggagugcaguggcgcgaucucagcucacuacaagcuccgccucccagguucaugccauucuccugccucagccucccgaguagcugggacuauaggcacccgccaccacgcccggcuaauuuuuuuuuuauuuuuaguagagaugggguuucaccauguuagccaggauggucucgaucuccugaccucgugauccgcccaccucagccucccaaaauguugggauuacaggcgugagccaccacgcccagccuggaaauguguuuuauacggcauuuuaaaauacaaggguaaacagcacauuauacagacuuaggggauugaccacaucaggaagaggaguuacagagauuugcgcucuuuuuucccuuuguuaucgaagaaucugaagucuuucuaaaacaacuugugucauucagaaugccuuccccugcuuugucuucugcaagaaaagacgagcuucugugaagugaaacuacuugcauuuccuggccucggucccccaacugccuguguuuaucucugaagaauaaaggcagaggaugcgauugaagugugccaucuaauagcaucgguauucuggguacacacucccaaaauugaccuggggccaucggugcuagccuuggauguugugggaugggauuucauuucccuggaggcauaaagugaucacauaguuuaaacaacuucaguugaaaacuaguucuccaaguggcaucccugguuccuuccucugggaugcauuacuguguauguuguggagcaaaucguuucuugggaggccugagaaggcuugagaagcuucccaacccccaaauauacagacguuucugugcaugcagguacguucauauaaaauauguuauuuucuauuuuuaauuuuuuuuaccuuuuuuuuuuuuuuuuuuuaagagagggagucucacucuguugcccagacuggaguguaguggugugaucuuggcucacugcaacuucugccuccuggguucaugugguucuccugccucagccucccgaguagcugggacugcaggcgcccgccaccacguccggcuaauuuuuuuguauuuuuaguagagacgggguuucaccgcgcuagccaggauggucuggaucucuugaccucgugaucugcccaccuuggccucccaaagugcugggacuacaggcgugagccacugcacccagccuggaacccuuuuaaagugauaaacaccucaguacuuuuuacauggccuguugcauagaugauuucuuaauauuagcuauagcaaucaaaugagaguguuuuugaaauuccccgaaaauaauucuucuugaguuugucauuuuaugucagaguaguaguaauuccguuccuuucugcuggaggacuugugauaguaagggccuuuggaaaccagcagaacagccaguugcuuaucggcuguggugugcgagucccguuuccuacccuggccccguuaugcguacauggucuauaaaagaaucaugugaagugggggguugaggauuguacagaaaugggaaccuucacccagaaaaauaucuucacuccaucuccguuaaaguauuuuuaaagcaaaagcaucuagaaucccaguacuugaguauguaguucuuccuauuuuauuugccaguugucugcguacacacauuuccuuaaguaauugcagucauaauguagguacacguugauauuguuccucauucagcauugugucauaaauaucaucccacauuuccauaugguuuucaugaugauuguuuuacugucuuaacugacuucugugccuccuuuaauacaaggcgugucacaucuuuuuuuuuuuuuuuuuuuuuuuuugagacggagucucacucuguugacccaggcuggagugcaauggugggaucucggcucacugcaaccuccaccucccggguucaagcgauucccaugccucagccucuggagcagcugggauuacaggcacgugccaccacaccuagcuaauuuuuguauuuuuaguagagaugggguuucagcauguuggccgggcugguugguccugaacucuugaccucaggugaucugccugccucccccaaagugcuaggauuaguggcaagagccacugcacccgaccagcccugccccaucuuuaggacagaggaguaccagccagagauacauacuuguuuggcucuggccaaacaaguuagaaagaauaaccuugcugcuuucuuucuuucuuucuuuuugagacagucucacucuguugcccuagcuggaguacagugacgugaucuucgcucauugcaaccucugccucccggcuucaagugauucucgcgccucagccuccccaguagcuaggauuacaggugugugccucacgaccggcuaaugcuuguauuuuugguagagagggaguuucaccguguuggccaggcuggucuugaacuccugaccucaagugaucugccugccucagccucccaaaguguugggauuacaggcaugagccaccgugcccgaccuccuugcugcuuucuuuugccuuuggagaaagaaaaaaugacucuccuccucucaucccuggcagugcuguuggaaagcaguguguuauuuaaugaguuuuauguaguuaauugcuuugccuagguugcuaagugagaauacccacacggugguguuacacuuacacuccugcugggcaccuuaccccuugcccaguuguauucgaaacaaggaucacugccugcagacugggguccacacauauacuccuugagagugugagcauucacucaagacagcagaaccacuguccuggcugugucuaggcucuggcuaacuuugaaguggcugugggagccugaggaggacaaacaguuagaauucugccugacugaauuaugguuuuuuuuuuuuuucuuuuuuuugagacggagucuugcccugucucccaggcuggagugcaguggaguggagugcaguggcgugaucucggcucacugcaaccucugucuccuggguucaagcaguuuucgugccucagccuccugaguggcugggacuacaggcaugugccaccaugcccaccuaauuuuuuuguauuuuuacuagagacgggguuucaccauguugguuaggcuggucucgaacuccugaccucaaaugauccacccacgucggcuuuccaaagugcugggauuacaggugugagccaccgcgccuggccagaauuauguuuuugauugucuuuuagaugaaucuuuuauaaauauaugguaaauagucugguuuaaaauagcucuuauaucuuguguuucuuuucagccuguugauuuaguuaaaagucucagaugagaaggagauuugcaggauaagugccaauauuaugacuuaaaauuacugcucugaaugaacauucaccccaaaauaggaccagucugcuuuucagcauaaucauacuguaugcauuuugaguggcagggcaguagucauugaaauaauacauuccuuguauaaaguuuucaucccguacaaggugcauaagugggucaggggcaauauugagccauagcguugagcagcguugaguggaugcuuggcugugcccagugacccacgaggacuggagcgucgaggggaggugucugccuguuggcacugagacugugaguagcugcacaucauuucaggguuugcugucaaccggcuucagaucaguuuagaucucaccuccagaggaguuggaaaaacugcugguuuucggagacuuuuggauuuugaaaguuuggauaagggaccuggaccuuuacuacuacacuucuauuauuacuguuuuuuuaagagaugggaguucacuauguugcccagucuggacuugaacuccugggucaagugaucucuccugccucagccucgaguggcugcaaaagcagggacuacaggugcaugccacagugccuggcuuuuuuuuuuuuccuuucagugauaugagauaugagaaguuagugcuccugaauuuugcuggaacucauuugcuuuuucucuuuguucagauuuucaaauuuuuguuuugguaugauugguugucuuuagugauuuaacuuuugugagaaauggaaacuauuuggauagaaguacacuuuaagaaaaagagggaguguugucaggcuuuguuguaaagaucuuugcuauuuuacgaaaaaugguacguaaguguagacuuuguggccauuuaaucgcaugacaaaaacuaggaagggauuguaugaguccauuuucauacugcuaugaagaaauacccgagacuggguauuuauaaagaaaaagauuuaauggacucauaguuccacaugguuggggaggccucacagucauggcggaaggcaaaagaagagcaaagucacgucucacaugucggcaggcaagagagcgugugcaggggaacugcccuuuauaaaaccaucagaucuugugagacuuagugucaugcgaagaggaugggaaaaacccuccugugauucgguuaccucccacugggucccucccacaaugcauagggauuaugggagcuacaauucaggaugagguuuggguggggacacagccaaaccauaucagggauauauuaauacacuuuuuucuuuuuuuuugagacggaguucgcucuuguugcccaggcuggagugcaauggugcaaccuccaccuccugaguucaagagauuguucugcccucagccuccugaauagcugggauuauaggcaugugccuccaugccuggcuaauuuuguauuuuuuuuuuuuuuuuuuuuuuuuuuuuuuaguagagacaggguuucuccacguuggucaggcuggucucgaacccccaaccucaggugauccgccugccucagccuccuaaagugcugggauuacaggcgugagccaccgugcccagccuagggauauauuaauauuuuuauuguaauuuacuucuguggucaccauuguuugaugcaaaaagaagcacaguuuuucaauuguaagaaauaaaguuuaaaauauguggacuguucccaaauacauucccgauuucacuuguaacuuuguugguuagucgccugcauauuuucguauagaaaggaguuuggaaauagcaguuaaguugugaggcuaggcuagaaaagccuuuuacuccaaagucuauguaaacuauaaucuuaagaguuaaguuccugguucugaaggcaggaagcuaguuggcauaagagaguuggaggaggaggaggaguuuucuuuauguuucugggugcagguuucugaguuaguuuagguuggucuuuggggcugugccaggccuggcugugcccugcaguacccccuucuccauuguagugcccuccugguguuguaccgcucugguguuuacugcauuccucuuugcugcacccccucuaguggguucaguaguucccaugaaaacaggauuccuccugucaaaauugcucagcuggaugcugggaaaguauuccuaauaguucauaaaaccgguaggccuucuuaauuaugggaagaaagauguguguugaucugaauagauaucuaauaggugguauaucagccaauguguaaggcauaggagaugguguuuagaguugaagagggaucugucauacgucuggugcagugcuggcauugggauuagaugacuaacagcuccgucuucaaggagcuuauggcccaguagcagaggcacaugugucgcauacauuucaaugggaaaaaaugcauuuauggaaguauaaggcucagaaguagcgcagaggaggggguaauuaaguaucuagaccuagccggcugaagauuaauaaaggaaacaauggcugagcucuguucuagaagaauuucuuuuaaaggcagagggcauccagacagauuagaauguucaaaagcauggugucuuuaaauggcacagaguguuuggaaaaauacaaggaauccaauucugccggacuuaaggggaaaggaaagagaacaagacacauauguugaagaagguaguccaggaccagaucauaucagguccuaaaauaagugcucccagacuaccuugucauuaucacccaugggaccaugcugagugguuugggcuuuagccuauuaggugaugugacauuucugggaaauuugaauuggcagaaugagacccauuuugggcguugacaguuuggugguuagacuggaaaggaaggaggcuggucccccagcuaggucucauugcgguuucccagguaaaagcugaugccagaucgaacugugccaccaguggguggggaggaggagggauuugagggagggagcugugggggugagcggggcaggcuucagugaugauggugauggagggagggaggugcccuggggcgaaugaacgcacccacgcacccaaguccuuggggcugaugacuagcauggaagaugaagauccuauguagauaaggaauucuguuucagaugaguggauugugggcagaggaaaugaacaggcaguuagaaauaugggucuggagcugguggaagaguucaggcuagagacugagucuggugacugauuaauuaggucauuugugcuagcaacaugggacggcuguuaucacuauacagagggugauugaagagggaguagccuguguuucagaucccagacuucaucacacuuggcuacuccaccuagcuuuaccugcuaggcaaagcagguucugcucugaaugugagccccagaguguccacacggcagcagcauuggcucagguggauggauggggugcgaggugcuguggguggcugaucaccagugggaacagugugucagcuggucguaagucaagaguagcuuguaauuucuuagacgacaggaguuccuuuuaacaaauuuauuagacaaaucaugugucugagcuccacauaccuaauauauacaucauuuugacccugcaucucuuguccaguuuagugguggucacuuccgaaguggguccuaaaguaguuuuccagugaguugcauagcagaauuuaaggcuguuuaaacagccucagucuugguugcaccugcaaaaaucggguagaagccucuaggugaguuaaacccagcagacuuucauuuuaacccaggugggugauucugggcuuccaguggugcugcuuuuaccaucccugguuugauguggcccaggguggcuggcaugacccuggcugguguuguuacucaccauuggggcacauacucauuguguuacagugauuuuuuuguuguuguuguuuuucaguuguaggcaaaagaacaacaaccucaacuaguuuaagcaaaaagaagaaggggagauucaucugcucacagcacugaaagggcugcagugggcuugacuuccaguacaguggaacgugagggcuuacuucuuaggcaggugugccccagccgaugauaaaggcggcugcccgcagcacccagccuuaaugaugugauccugggggacaaagagcaccucuuuuucaguagcucuagcacaaguucuuaggcaaugcugagcguccuagcauaguccuuaacccuggacugaucccuguggcaagaggaguggggcucuggccaauccaugcccccugccagcccuguuggggaauccaggccaugcgacugacaauuccccggggaaggaggagaagucaggaaagauagaguucuuccugaaguggguccugaguaugggaccgaauuucuuauccgggcauuucgucagguauaugcugauaaaagaccuuaucuagagaaaggaagacauuuacauaagacagggaggcugguagcccgcacgguggcucacgccuguaaucccagcacuuugagaggccgaggcggguggaucacaaggucaggagauugagaccauccuggcuaacauggugaaaccccaucuuuacuaaaaauacaaaaaaaauuaaccgggugugguggcgggcaccuguagucccagcuacucgggaggcugaggcaggagaauggcgugaacccaggaggcggagcuugcagugagcggagauugcgccacugcacuccagucugggugacugagcaagacuccaucucaaaaaaaaaaaaaaaaagacagggaggcugauauguguaggacguuuuuaauugguuaaaaccaaucaggaguuuucuguugagagugagguuuuuauuuauuuauauauuuuuuuuauugagacggagucucacucugucgcccaggcuggagugcaguggugcgaucucggcucacugcaagcuccgccucccggguucaugccguucugcugccucagccucccgaguagcugggacuacaggcgcccgccaccaugccuggcuaauuuuuuguuuuuaguagagaugggguuucaccguauuagccaggauggucucagucuccugaccucgugaucugccugccucggccucccaaagagcugggauuacaggcgugagccacugugccuggccgagagugaguuuaaacaugguuauccaacaauaggguugugugugcugccuggaaggcagggcauauugugccaguuauacaugaggggaaaagggauggcaugagcucagcguucacucuguaaagagcaggucaugauuauagucagcuaugaugguggcuagguuauaagauacacacuagaccaaucaaguguaauaagaaaagauaaaagcaguguuaggauauuuugggugaucauguucuuaaacuauuuuuucuuucuuuuuuuuuuuuuuuuuuuugaguuggagucucgcucugccucccaggcuggagugcaguagcacuaucucagcucacugcaaccuccaucucccugguucaagugauucucgugccucagccuccugaguagcugagauuacaggugugugccaccaugccuggcuaauuuuugcauuuuuaguacagacuggguuucaccauguuggucaagcuagucucgaacuccugaccucaggugaucugccugccuuggccucccaaagugcugggauuauaggugugagccaccgcgccuggccuaacaauuuucuuuaauauuugaaugacuuaagcauucuaaaaaugccagguuuuuaguuuguuuuuuauuuuuguagagguggagucuuaccuugcucaggcuggucuucaccuuuuggccucaagcaaucuucccaccuuggcucccagagugcucagauaacaaggaugagccacuggcagcuggccuaaaaugccagguuuaauggggaaagggauuuuggaguuuuaucuaggugauuugcuuuuaguugauuuaaucugugagaggugcaguguuuuagauaaccuggaggucuggaaugaccaugaguacaacuuggcagguuacauuggagcgccuguguuguugcuguuuuagucagagguaauuuuaguaauuaaagugaaauguccuguuuuaaaggaaguucuguucuguaaagagcaguagguauuaaaugucuuugggaaguauggacucuuugggggguuuccuggaauaaugaggacguuuguuguuauuuuuucacagccuuguauuucaguuuuuuucuuuaaagggaguaaguugcauauggggggcuuaaaugcuuuauugacaagaaaaaaaacugcaccaggaccaauucaucaucaucaucagcuuccucccccuucuuuccuuccuuuuuuuuuuuuuuugagacugagucuugcuccaucgcccaucacccaggcuggagugcaguggcgugaucucggcucacugcagccuccaccuccuggguucaagcaguucuccugccucagccucuggaguagcugagauaacaggcaccugccaccacaccuggcuaauuuuuguauuuuuaguagaggugagguuuuaccauguuggccagguuggucucgaauuccugaccucagacgauccccccacuuuggccuccuaaagugcugggauuacaggugugagccacugcgccaagccuccuguuccuccuuuuucuugcuuuuuuucagccugagcaacucucuuuguacuucaucgggcauuccuucagcccagccugcagcaggauccuucucaugcugcgccuccuuuuccuaggcuacugggcaucugcagcaguguugucucucccaucccucccagucucugugcagcaucacccacggauaggccgggauguuuucuuugaauuuugggugaugcucagaacagaacuggaaaaaggccaaaggaggccucuugggugccuggaauccuugagcuacuuuuucguuccuugguggagggauguagguuucauuucucuuccugacaggccuggcccgccuugucugcgucuucaccuuuccuuucucuuuggcggauguggccuuccaccucugccagcaccucugagaaaacucggaggagcucccgaagccucugggcacugcugcuugugcuccccaccggcagguuugcacacuaacgcaugugaugacauuggccccucggcuucuggggaccuccuucacccuuuccucagcaaggcccagaguugcugagugcccguccggcucucacgcaccccacagggacucuggagcuuagccuaccgugguggcugucauuauuuuuuaaauaaauuuuuuuuuagagcaguuuuggagcacaacaaaauugaguguaaggugcagagauuucccauccccuuggcucccacacccacggggucuccccuggugucagcauccugugccagagugguacguuugucacagcugaugagccugcguugacauguugucaucaccugaauccaucgcugacgguggagcucacucuuggugguguauguucaguggguuuugacaaacguauagugacaugcauccaccacuggagcguccuacaggauaguuccacugccuggaaaucagugaggguauccugaaaacguguccuuuuggcccuacucaagugguuuucugcagaugccaucuuccccuuguuggcgucuucgguuucugacuagaccgaaggcaguuucucuggaguggcagauccuggguccccguggcuggucugccacucagaaagcugccugcccuugggguucucaaggcgcccucgguagccacccuggaccuccacaaggucagauucuaaugggcaguucucauagcucuuuuuggugcucugcuccccaauucacuucgaggccagguuuaaaagcugagugcauguccuucucuaaggaggaccuccugcuuuguuuucucugccucaaauuucccuuagucuuuucccagcuggguugaguggaagaagaccuccgccggcuuagcugcagaugguuugccucucugcugucccguagccacuuguguccccagcuggccuguccccaccuugcugaccacaccuucucccauguuucugaucaauuugguacccagcguccagggucugcgucccuucccaucauccuuguuccuguggguggucguuguagggaggggaaaauaccccauagugccucucccuacugauguaaagauuccuuuuaauaaaaaucaagcuauuauaaaguuuaauuuauucaaaauauagaaucaauacaugacuaauuguuuaaaaauuagacaauacagaagcaugauuuuauuccccagggguaacuaauguggagaggaaggauucugugguucccuuaacugcaaaggauuguucacuaucguacauuuagagcugaagagaaggcuugcgaaggccauuugacuuuuuuuuccuuccuuaucgcagcagguccaucagcaaugucacgaaccucuaaccaagaccccucaagcaauccaauuucugcagcacuuaagugcuuuucauacuccugaugagacaugaugcucauuucucaacaaagauuuauugaaugucugcuauguuuaaugcaccaugguggagccuggggaagaugccuacgccauaccugcuguccuuaaugaacucacaggccagcuucgggcagacauuccagcaagcauuggaguccaggcuaauaguaaccagagagagguacaaacugggugaaagaaaggaacccuuccuggaggagucagcauuugagcaguuccugaaggugcugguggguagagggcauuccaggcaggugggucucuucacagaguggacugcaguuuggguugccugacaaagaugagaaggguuagguuuuuccuuccucccuccugcaugaaauaaugggaaagaagccgugauagaaagauuuaguuuggaguaggauaaaggugcuaagaaaaaaaaaaaaagagaaaguaugacggggguuccaagucuccuuaauggauuagauaacucagaauagccuugaagaaggcuugguggccucguagcuuauuucugauuuugcuugagggacagaaaacaaggagaaaugggaaacguagauaagucuugauuuuuuuuuuuuuuugagacagagucucacucugucgcccaggcuagagugcaguggcaagaucucggcucacugcaagcuccgccucccggguucacgccauucuccugccucagccucccgaguagcugggacuacaggcgcccgccaccaugcccggcuaauuuuuuguauuuuuaguaaagacgggguuucaccauguuagccaggauggucucgaucuccugaccuugugauccacccaccucggccucccaaagugcugggauuacaggcgugagccaccacgcccggccaaguguugauuuuuauaggcuggucacaauauauaugcauguauuuuuuuuuuuaaguugaacuuaaucuucaacuuaauucagaaguugauuaaggaacuuaauucagaaauugauucagaagguuuucuuuuugcuuuuauuguuaaagcauugaauugaaaacacuggaagcaguaagcuguauaaaugauuucauuuuauuuugcauacuuagaauugggcaucuggaacuaaacaagagaguuuaugcaaaauuacaugcaaaugaguauuuuuuuaccuuugagcccagagcuuuaggcuucuacccugcugggaaaaggaugcugugucccugagcuuucaugggaccaccaguauaaguauuagaaaggacaacuggacuugagugauaaauacugaugguuugucuuuagagagagaagacaaaacuacaagaaagaggccauuccuuuuuguuguuguuguuuuuggagagagggucucgcuuccucacccaggcuggagugcaguggugugaucauggcucacuguagccucuaccucccaggcgcaggcgauccuccugccucaccuucgaaguagcagggacuacaggugugcaccaccaugcccaacuauuuuuuguagggacagguucccccuauguugcucaggcuggucucaaacuccugggcucacgcgaucuuccccccuugaccucccaaagugcugggauuaugggcaugagccacugugcuuggccuguuccuauguaaaaugaaaaagaagaaacaagaaagcuuuuacugcuucuagagaauucccucaguuguaaaugacuaacaguguuaaugacguuucaugaacuaggaugaaaaucuuuguggaguauugaauugagucaucaaagggaagccugcaguguuacaacccuagccacuauaaauaaaguguauuaaugagcuaguaguaugcugcagacgacccaccuguggaagugagauucuuguggaaaagucaagaucauugaagagaugugagaccaccuaacugugagguuacaccaggcauagucaggaggcaaggaaauagguagcuacuguggucugaaugcuuauggcucuccacagucauguugugaaucuuagugcaauuguguuucgagguggggccuuuaggaggugauuaggugauuagcugaugaggguucugccuucaugaauggaauuagugccugucucaggcuguucuucuguugcuauaaagcaauuuauaaaggaaagagguuuaguuggcuuaugguucugcaggcuguacaggaagcaugguacaggcuucucuuuggcugcuggggaggccucagggagcuuugacucauggccgaaggugaagugggaacaggcagucacauggcgagagugggagcaguggagagagauggaaggugccacacacuuuuaaacaaccagaucuugcuggaacucacuauuaugaggacagcaccaagccgcgagggauccacccccaugauccaaacaccucccagcaggccccaccuccaacacuggggauugcauuucaucaugcaguuugaaggggaccuccaaccauaucagugcccucacaaaagagguccgagggagcuucuuugucccuucugcuaugugaggacagagcuaggaggugccauccaugaggaauggcacucaguacacaccgaaucugccagugccuugaccuuggacuucccaaccuccagaacuguaagcaaugaaucgauguuguuuauaaaaguugcacagucugagcugacuaagacagaaguauuuaggcuaauggaggaaguugcacaagcauuguuggugguuagcugcauauguuucagauggucagaagaaaaaaauucucuucacugaaauuguguuucacagcauguguuaucuacauggucucaggauagugucuccauuggggcuuguauuagcaacagccuaauugcaggaggccucaugaccauuguccuaccccggggcacugaucggggucuucucuauuuguuauuacuaaagggcauaccuugggagagccacauguguauugaaggucauaugguagaucuagucauuuacucuauuuuuuuuuuuuuuuuuuuuuuuuugagacagagucucacucugucgccugggcuggagugcagugguaugaucuugggucacugcaaccuccaccucucaaguucaagugauucuccugccucagccucccgaguagcugggauuacaggugccugccaccaugccuggcuaauuuuuguaauuuuaguagagacaaaguuucgccauguuggccaggguggucucgaacuccugaccucagguaauccacccaccucagccucccacagugcugggauuacaggugugagccaccgugcccagccauuuguucuauuuucauguagaaagaugugacacgagggagaauaauagugaaguguacgcaucaucagcugugugauuugaggguaaacccuugagaugagacaguuucuugucacuugaugauuuauuuuccuaucucagccuuuaguuggaauuuacugggugugccugucacuugugauucagcugcuucuuuauguagcauuggcaguuguggcuuagaaaggacaacacagcugaggcugcaggucacaccauaaugggaacaggggagcacuuacuauguccaguuuuaaaaaaaacuuuguuuuugccccaggaaaauaaaaaauugucuuauuuuagccccaggagaauaagaaaacaucuuauuuuuagccccaggaacuauaauauguaugcauuuuucuguauuuuuuacaggugaguaaacuaaggccuagagaggcaaauaacuuguaagagguggagguggauuugaagccacaugcaccuggccguagacuccacguucuucucuucauguggugucagcuccuccaguagauuugcugcuggagcgggaaguuagagucucucugaguucuuaagggagagaggggagggcuugguggcccagcugcauaaauagccucaucuaccaugaggguuuagcaguaguuugcucuguguggauaagaacuacagugugggaucaguuuacuggagaugagaaggugaaugaggcugugauauugaaguauaggaaaggugcuugcacaucauguauuuucucaguuugcuccuuuggucacaaagaguugguaauaaggcgaaguuuacuaaauugauggcugaauacaacugggagccuugcagagaaaaccauuucacagcuauugauuuuacucuuaaucuugccuccccagcccauggcgugucauuacaggaauccuggacaagaggugucucaguacaaauacuggaaaaccagcugacugcaaacaaccuauugacuuuuuaucauaguuggucauuaauuuuguuuuaaagaaauagggucucauucugucgcuuaggcuggagugcagcgaugugguaauggcuaacuauagccucgaacuggugggcucaagcaguccucacgccacagccucccgaguagcugggacuauaggcgugugccaccgugcccggcucauuguuuaaauuuuugguggagauggggucucauuauguuucccagacuggucucuaacuccuggccucaaacgauucucccaccuuggccucccaaagugcuuagguugacaggugugagccacugggccuggccacaauuuuaauauaaauuuuaacauaaaaguuaccccuuaaaacaauuagauagcugggcgcgguggcucacgccuguaaucccagcacuuugggaggccgaggcggguggaucacgaggucaggagaucgagaccauccuggcuaacauggugaaacccugucucuacuaaaaauacaaaaaaauuagcugagugugguggcacaugccuguaaucccagcuacucgggaggcugaggcaggagaauugcuugaaccugggaagcggagguugcggugagccgagauggugccauugcacuccauccugggcaacaagagugaaacuccaucucaaaaacaaacaaacaaacaaaaaaaaacaacaauuagauauggaaggaagggggaacacagauguucagggccucagagauucaggugugaguaacuggaguccacaugacaaacacaaggaguucauguguucuggccuuuuuuuaguugagaaagucaauuuucuuggcucuuccugagccuguugcuugguucuugacaucucauuggaaacugaaaaugggaauuugacuuuccgugauaggggcugccccaccugcguuuguaggguugaagcucaggccuguugugggcgauguuuggaggauaagcuggccugcuuaucucuggguugguugacugcgagaccagguggaaggacacgcagcccaucugguggugagugaggccacuuguggccaggggacugaaggaagucccuguucaccauauucuuggcaaaaucuggucuccuucuggcauagauucagcuuuugacaggucuggggauuucauuuuuuuuuuaaagcaaaauuauaaaaaaggcuuuuaaagugauuuacucguguguguuuuuguaagaguugguagauagaaggcuuuugaaaguaagggcuuucucagauggaccaggccauuugagaucugccugaacugcucaccagaucaucugggauagcacugccuuugggauaaggugccaugcugugugcuaguggcccuuucacagcugucucuugugaacagggguugggggacaguggggguggcacuaggcaucagguggaccccagcacccugcccagccuuugccgcagcggucaucugugcauugucuuuuaaacugaacaauuucauguaucagaaguuaauccuguacucuuagccuucaucagugaaacccagaaugacaaggacuuuaagacugguguugaauuauauucagaucuuaagcaauuccugugaucucccaauuucuuuaaacuuucauguuuuuuuuagcuucagaagaagaguuuuaagguaacauuuuuuucuugaaugauuucucuuuuuuuguauuuucauuuugucgguuuucccuauggaaagaauuguuuaaaagucaugcaguaauuacaguguuugguguaauauaauucaggauguuucaucuaauauagaaagacauuugccgcuuuuagcuucuuuauuauuauccauauugauuuaggguaauggauuugaguugucuaaucacugacugagcagccaggaauaaacuuaaaaucuucuuccugaagccaagucuggcacuuuuuuuuuuuuuuuuuuugagauggaguuuugcucugucacccaggcuggagugcaguggcguaaucucggcucacugcaagcucugccucccggguucacgccauucuccugccucagccucccgaguagcuggaacuacaggcgcccgccaccaagccuggcuaauuuuuuguauuuuuaguggagacgggguuucaccgugaucuggaucuccugaccucgugauccacccgccucggccucccaaagugccgggauuacaggcaugagccacugcgcccggccuagucuggcacuuuuugaucugcacguguguacguuaaaaauugagauguugcccugcuuuucccgaaauaugccugugugaaauaggcucauugcuaacaacugggacagugcagaaaaacagagagaacauacuguuaacaucucaguguaccucauuccacauguuuucuuugaaugugugcaggaguacgccugucccucaaccaaaagggcaccaauuccugucauuaauuuuacauugaugucuaccuagguaguuugcagcuuuaaaaacauuuuuggaaaacuuuggacauaugaaucuuuucacuugucuauuucccuaggauaaacuaacuggaagugggguuuuugccuuuugcuuauuuucauuuucagguauggaacaucuuuucugaucacuuuuccaucuuuuuagcgcuuccauucuucagaugauaugcuuuuuugucauuguuuucuacuuuuugcugcuuuuaaugugauguuuauuuugauaaugauuuuuauuaccuucaucucuagcuguguuaaugcuuuuuggagacuuaaaaggugcuccgaauugucuguaauuucuuugagaguugagaguauuuuucugaaauguuuccccucucccuugggaauucggaaauauuuuccuuuugcuuguuuucuuuuucaccacugucuuuccuuguagaggcgucuccgcaugccucgguguggauucuuuggcuuaggaggggaccugccauguacccuggccucaggucggcuuggaggguggggagcauugccuccuggggcgggcggcucuguccucuccucuccggccugcccugccuucugccggcuggcugugccucugccugcucuacccggcgggaugagauacuccaggggggcugcgccacucccaguagggcccuugcuucccagaugcagggucagggcccaguugccuggggcccacagugcaaagcuggccucucuuccaggaaaccuuccugguuagggaaguggagaugcccucgugggccaggccugcuggggacuucugugucugcaguugggccacgggaacguaccugccaccucaguuucagagccuccugccccugugcuggccuaagguccugcuguguucucaguugucgccucagccuggggcagaggucauugugcccggcagguagucuuugucaucuguggguucaggugagaguaguuccuaguuuuauugcagauggacuuuucuucucacucuccuuccuuuauuaacuucagcgugggccacagcagccuaacguaaaugcaccuuucauuuaauggcuuuuacuagaagccucuucauagcuauuuuuaaaccugagguccacuaacaugacuccaaauuagagccaggauacucacacuugccaauuuacauugugugcuguucuuaugaagccuaggaucaaaaaagacccagaaguaaaaucaaguuucuuuuguauagcaugugguuuaugcgugugggugaccgagucugccggauacugagucguggauggcagcuucuggcggugauccguucaauagaagccauugaugaccggcaccgcaucugcaggcuucacccucggggcggcuggcagcuccucucuugcagucgagggguguccugcguccuaccauaguucagcaccauccuugggggccacuugggaguagagggcuuccgggccccagugcggggucuccuguugcugccuccccucucucuguauucucugucucucugcagcgaucagacccgcgucuucggguccgcgcccacccuggccucaccugcugcuucucagcugcuguugauggagaccagcuguuugaccuuucguagugugugccuuuauuacgcaccagaauguucugagagcaggacugaggccccacucugagaggugcaguuugggcagaccgggaauuuggggcagcuguguuugugcuuggagaccuuuuuugcuuggugcuucuggagggucgagguuucucaaaucugagugccgaaucaaaguugaguuguacugagagagccgcaguuaaguaaauguaugcagacuuccugucagguccagccgcgggagcacauugguugaauuauucauuugguuugcccuucaaguguuuaguucucuuuuuuuggggaaaaaaacaacucuguggggacacuuggauagagaggauuuucccgaagcuguaaacuuuggaggauggcaugacuggucuccucccagccggagcggagcugcggccucuccccccucccuuggccuuugcuggcaccuguaagcccccggaggcuucagucuuugggccuuccagguccacgcuagcuggcugcuguuuucugcuacaggaagugguggaucugagacuugguacuccgucccaucgucuccacaaauacacccguuccugucaggccgcguguucugguguuguuuggaaaugagggggucuagauuucaacugaccucuuacggacauacaggguaagcguugguacuuggacguguagauggagaaaguagaguaaaagacaaacgcauagaaaguagauugcaccaucagccuuucuagggcugugggcugcuuugcuucccgucacuuucacuccaggaacaagggacuaauauggaaaggaaccuaggaaccgggaaacccgagcauuuauuaggcucagcuguaugauuuuuaauguguguuucuuuaucugaagugcaugaacuaccuuguaggcuguuucuugggucuaggaagccauuuauauuuauaugcugguuuccugaaaaacacagagugcucugugaguaugagggguuacuguguugucacuugaguugacccuggaguuugaggcuggcccuguucugguuaccaucaguaaaaggcagagcugggaggaaguuggaaccuaccaauuggccguuuuuuuuguuguuguuguuguuguuugugcauaggaugaauguauuguuuuugucaguccuuuuuaccuuaacagacgagagaguuggcuggaauggucccuacucagcaauauuuauuuagguuugcacaccuuccaaaacguugcuuauuuaagucccauuuacaaugcuuuaaaauggcugacauaucagucagcgcuagggucgguggagugugaugucaagaaaguauuaaaucaugagagcugauuaccauguccagaaaauaacgcagucuuguaaauaaccuuugucuucaggucgggauaagaaaugaguuauaaacggcccaugguuaaaguccuaguggacccuuggagaacagcggguggagauggaacgagcuuugacucacuuguguucuguguccuuugaucugugccaaggaagagauugcuuugaaaugcacgauuuuauuuucucaacuaaauauuguagcagcaguaauggaguagugaguggaaaaguauugcucacucuauuccacauuucccggaauuuaugugauacacccugcuaacccccgggcuucaguaauaccagugcgugcuguuuagaugugcagauaaaauacacuuccucaugguaaaaggguaaagugucauggaugagggcacaggcuguugagacaaacugguucaaaucuuuccuacaguucaucucaccuuuguguucugguuuccuuaucuuugaagagauggggauuacaugauuuaauucuguagggacagcaucugguacauuuauuacauuggcagcuucuaagucaaaaauaagaaauaucucuugaaagaauuuaaaaguuuauuguaaauuagguuauaauuuuccugaacccucccacuuucuggcucugaugcugacaucauggucucuuugcucacaaccucaaaaguuuucauaauacugccauuaggaaaacacuguuuccuuugaacaucugaacaaacugcccuucauaguuggucgggaugcagcugaaaguguuggguccugauuuugaucagcuugaagcuguucccagaccaaacugagggucaggcugcuauuucucgggcccaauaaugagaugcagaugaacuggagaggaagagcguuuuuauuuccugcagccgguuacagggagaaggccuggaaauuauccccggaccaacucaaaauuacaaaguuuuccagagcuuauauaccuucuaagcuauauauucuuguauguaagugugcagcuaaagacauuagugagcaacuucucuuagucuauaacuaaggucugaguccugaagaccuuccucuggagccucaguagauuuacuuaaucuaaaugcguccaggugcugggguagauaacccuuauuuugucuccugcuaaaucacagagguuuggggaguuccuucagaugcccaauaaccuugucuguggaggccuggggagcuucuucagacuccuaguaaaacuuauuuaaucuuaaauggguccuguuaagaauucuuugguuauuuugucaugcuuuaaggcccaggaaaggccuaggcaaaacucuuggugggcuuuuguuauauuccagcuuuguauaagggcaauggcuuuuuuuuuuuuuuuuuuuugcuuuuaauauuuagcuuaaccacucaguacugaaacaguuguuauagaggccugugugagagagacuuggccugccaccaagcuucauggacacguugucagcuuuguggccugcacuggucauugguuuuggggaucaguuagguggaggaguagacaggaaugugaaguuuagguaaaucaugaaacugugaacaauacuuagcuuuuuuugguuuuguuuucaaaaguccuucauccacugggcauuucagcucucacuugugccaggcauuuuacuagaugcuggggcaagaugaacugaaggaagucuuugcccuuaaggaucucacagucauuugugagagacagaagucuaaagguauguaauguguaguuuuucuuugaaacagcuuuauugauacauauuuuacauaccauaaaauucauuucagguguaaaaugcagugaguuuuaguaauuuuacugaauggugcagcuagcaucaaucagagcagaacauuucauccccaguaagauuccucaucgucauucacaggugaucucuguucccacccuagccuuggacaauucugcaucuacuuuguagcucuauaaauuugccuuuucuggacauuucauguaagucgaucacacaguauguguuccuuugugacuggcugcuuuugcuuagcaugacguucuuggggcucgcaacgcagcuugugucuguuguucauuccuuuugcagcagaaucguauucuguuguuuggaugggccaccuguuuguugucuguuuacucuccagcugguggacauuuaggccguuugcacuggcgguuacugugaaucaugucgcugugaacaucugugugugugucugcguggacuuguguguccuguucucuugggaauggaguugcuggguuagaggguagguuuuuuguuuccccuuggagacucucugguuuccacauaugguaguuuuaugcuuaaccuuuugagaaauugccaaauggcuuucugaaguggccacgucauuuugcucccuccagccguuuguaauguucccauuucuccuauguguaauuuuaauacaaagcaguaaaaaguugccauuauggaccuaguaaauucugagguaacauaagagagaaauaaugaugcagccgucauuacugugcugguaauguaaguuuccuuuuuuuuuuguuuuuaaauggagcuuugcagagaucaagucgagagaagaacacugggccagccugacuccaaagccuacucucuuaagcacuuugcuuugcugacuugugauguuuuaaaaucuagcauuauuuucaaaugcugugagagcacugaagauaaaggauuugauucuuuuuuucaggcauccaaggaugguucaucaucaagaaucauuuuaauauaggaaggggacgacagauuauggugccaauagauguacuccuacuuccauugcaacauuaauauuguuauauaaauauggcaaaauggagaaaagcagccgaaucacaaaaagaguugcauuauaguauuugcucucuuggaggauguuaguauuguagcaggcugaacccacccauggaagaggugugugcuucagggcggcacagcuggagugagccgaauggaaauggaaaauuguguacaaagugcgcagcaggcugagccuuugauggaaacagcgggugcucugcuguguacagcuggaugucaggucuggggagugacugugugugagucuuggcugucgcccuuuccuuucugugucccccuccccaccagcccugacuccugugucuccuucgaaugccuuccagaaauugugacagguggcgagggcagaacaaaguauuaucuuuucugugguuuucucaguaauuaugaaauuuucaccuguuugggccucaccgaggagcaagaaagaagggacaccagggccugagugugggaaggaggcaguggcagugaugaaccuaggaggucaggcggcaggugggcugcucuggaagcucccuccaggagguaggguuuagcacaaggcaugguuuuguaggcaggugugugcaugcaugugugugaauguguauguguguaccagaauagaggacuaggagaaagaaguggcaagagacugggcagagaaugaauaagaugagcucacaaacuccccuuggagcagaagaucaguugaaggugcaguaagcuacugcuugaggaagggauuaaaaauaggcaccaagccgcgguggcucaugccuguaaucccagcacuuugggaggccaaggcgggaggaucaccugaggucaggaguuugagaccggcuugaccaacauggugaaaccccaucucuacuaaaaauacagaaauuagcugugugugguggugggcaccuguaaccccagcuaccagggaagcugaggcaggagaauugcuugaaccugggaggcggagguuucagugaucgagaucaugccaccguacucaagccuggucaacagagcgagacuccaucucaaaaaaaaaaaaaaaaaaaaagcaagcaccaaagcagugauugaccuagccgauggagaauacccuuuccuucacuaaaaccugaagcuuagcaugguucuugggaaggaaguucuggaagugaugaggauuuguugacaucccuguggauuagugacauugaugggcaccagaaagcaggugucuguugugacagaaaaccaggguggaagcuacaagugacaucuacaagguaggcccugcccacucugaccuccagcugcaccccgagcggagcagcuggggcaucauggaagugguugggccaugcagcggagcccugagccccucagcagguucaucccacagcccuguguuguggguacucuuguuauccccaucuauagaagaggcagcugaggcacagggcguuuaagugacuuugucagucacuuaaaucgaaucccucaucagagcuggggauucgauucaggcagccuggcuccaggagcugagcccucagccccugcacuacacugagggggcagcagaaaggaacccaggugaagacuauaaagaucgccaccuccucuugcuucugucucacauucuguacuuacgggugcacgucuccaccugcuugcugcuuccugggcuguuggcaugcaccuggguggagcuggggccccuguccugcuguggguagugaggccggcacccuggccagugcguggcccgguccuuagucuggaaggucugucugccucucgugccacagcuggcggcuggggccucagcuccucagcugcacucgccucacuuguuuauucagcugaugggguugaggucucccgugugccgggcacugugcuguugugaaugagcccgcugcuguucaaagcagacaucacagcggccauaggguaacgccauccagggggaaggccccacuccagaugagguguguguguuugugagaggccccacgaagacagguguccuuagccaucccagcagccucacccaggaggacugccugaugggagcccucugagggccacugucuagagagguggcacugcacagguagccugcuccuucagagguaggucuugagggggucacaguguaggcugaagaacgcuggcuugaggacucaaggagcugaaggccaccauccuggcucucucccugggugagugacuuacuugccaagccuccccuucucaucuuuggaggcggcugcuucaagggguuugggggagguaaggagaugagccgggaggggcgggcuccggccagugucgggggcacacaagggccugcuucccccucccuuucacugggcgacuggaggacaggcggaggaguguggcugggcggcuggaggacaggcggaggaguguggcagccggacagcuggaggacaggcggaggagugugguggcuggcaggguauguguuucugguucuguugagugaugcuuggaagaucguucugagaggucagggcagcucccgggaccccagagcacugggcuccugcaggggacuaggaggccggcuuuuaucagcucaugagcuuuuaaaaauggagagaagggcaggugugguggcucaucccuauaaucccagcacuuugggaggucggggugagaggaucauuugagcccuggaguuagagaccauccugggcaacauagaccccgucucuacaaaaaguaaaauaacagucagccaggcaugguggcacacaucuguagucucagcuacuugggaggcugaggugagaggaucacuugaacccaggaguuugaggcugcaaugagccaugauugugccacugcacuccugucugggugacagggagagaucccuucucuuggaagagaaaaaaaaaaaaagauagaagaagaauaugcaacagagacaauuuaguccccaaagccuaaggcauuuguuuucuggccccuacugaaguguguuggccuggagcuugcaggguuucugugagauguaggauuuggcucacagauuguaucuugauugcucacguucccucuugcccuugcugccccaccuagggagaaaagaacacucagugacauuuuuccccccggugggcaggauacguguguuccuauuugugacaaaucaaccuugucuaugaccuucgcaccuccauuccaggaauuuccccuucgaggccucuaaaagcuaaaagauuuucagguaaaggaaaugcguuauuaauugaaaucugcauacaccaaaacgauuuggucuggcuucuagaauagucaguuuccugauacucaucauugcuuccaucaguucuuguaaaauacaggaaggugaguucaccuguagggaaugggaagugguaucacauuuuacuccuggcauucuagugugaugacaggaugagccuugccacuuaggugccucuggagucaggcacccugugaagcuugcagcucaugagcacuuugcaguccagagaaugacccaugauccuuaaaccccgcuuccgagcugugggggaucuuguguaagaucugugcccgaauugucucagcuguguaaugaggacaguguucucuuucucauggggugguugugaggucuagaaaccguauuugugaacgcugcccagcacaaggccuucccgugggaggagcuucagcagugggagcugccacuguuuguuacuguuuauuuguacacuggguauguuuuccauggcuuuuguuugcauuuugauuuuaauaaaggaggugccaguuucacuuuccaaggaacuauauacuuuauuuggaaugcauugcguguguguguguguguguguguguguguguguguguguauacacacauauauauauauauauauauuuuuuuuuuguuuguuuguuuguuuguuuguuugagacagaguuucgcucuuguugcccaggcuggagugcaauggcgugaucuuggcucacugcagccuccgucucccagauucaagugauucuccugccucagccucccagguaguugggauuacagacacgugccaccacgcccagcuaauuuuguauuuuuaguaaauacacgcuggucaggcuggucuugaacuccugaccucaggugauccgccugccccagccucucaaaauguugggauuacaggcgugagccaccacgccuggcccguugcauauuuuuuaucaaauucuugccugaugaaacuccugguuaugcugucagggccuguuuguugggacugcccaguggguucuccuugccugcugcccaaacagcugauuuaucaagacaggggaauugcaauagacaaagaguuuaauucacauagugcuggcuauacaggagaccagaguuuuauuguuacucaaaucagccucucugaaaauuuggagauugggauuuuuaaggauaauuugguggguagggguucaggaaguggggaaugcugauugguugggucggagauggaaucauaggagauugaaguggguuuuuugcuguuuucgguuccugggugggaucccagaacugguugagccagauuaccggucuggguggcacuagcuggugcaucagaacacugggucugcaaaauauuccaagcacugaucuuaguuuuuacaacagugaucuuauccccaggagcaguuuugggagguucagaaucuuguagccuccggccugcgugaccccuaaaccauaauuucuaaucuuguagcuaauuuguuagccuuacaaagguaguauaguccccaggcaagaaggggguuuguuuugggaaagggcuauuaccauuuuuguuucaaaguuaaacuauaaacuaaguuccucccgaaguuaguucagcccaugcccaggaaugaaaaggacagcuuggaggguagaagcaagauggagucgguuaggucagaucucuuucacugucaucauuuucucacuguuagaauuuuugcagaggcaguuucauugucaucucaaaccgcaggccucgucuuugagccagggagccuucuguugaagaaaaguaccccacacaaccacugagagauccuggggcagggcugagguucccugguggggacuccgggggugcuggagcuuugugaccaugggccuugccuccucggcugccucugcuaugaagccucaugcgguuggaggaggauguggaugagaugaccaagcggggugcccgcuagcaccaggugguggguaggcgucggcagacuaggagagccucagagccuuuguuuaacuugugcugagaaggagugugacuccaggagaguuggguggagagccucaccuuggcacacacuaugcuguguccagacuggaccccauggugucugagcauuauucucucuagggucaccuuccccugcacugugaccuugcggagcuucaaacagugguuuccuaagguaacagagcagguggugguguggugcgugugcguguguguguguguguuggguacugaggccacaggcgauaaacugaucuaggugguauaguaguguuuuucucauuuuuaauacuuuucaaaaaucgaauuuauauuuuucuuuuuuauuuuuagagauggggguucucauuuugucacccaggcuggagugcaguggcucaaucauaacucauugcagccucaaacuccugggcucaagugauucucccaccucagccuuccaaguagcugggauuacaggcuugagucacgaagcccugcuauauuuuuaacuuagcuagagcauuucuaucuuaaguauuuuuuuauagauaguagaugcuagcacuaggguuuuccuuaauuaaaauauuaaguauuccuuaaucuuuaggagauuuaggaaauauuaaggaauuuaggaaaacugagauagucucgcucugucacccaggcuggagugcaguggugcaauuucagcucacugcaaccuccaccucccagguucaagugauucucaugcuuuagucuccugaguagcugguagccuggcuaauuuuuauauuuuuuguagagaugggguuucaccauguuggcuagguuagucuugaacuccuggccucaagugauccacccaccucagccucccaaagugcugggauuauaggcgugagccaccacacccggccugaaaacuaauugauuguguagaccuagacuuugcaauucauagaauuuaauuucucuuugugccaauuuucuguuuugucaaauacuguaggauauuuauucagcuuguccucuagaugaugugauuauuguagggauaaaauaaaguguauacuaugggagaaaugaguuuacuaaaccagauggugggggcauuuguaacgcauuaauacagcucagguagauaaacugaguagugccacuuacagaaguaaauuaucuguucauggacacagacuaggaagaacuuacauuguaguaauuaguagauuuauuguaauguguagaaaagcauguuacuguauaaaaaugauuuguuaucaguaggcuagaaauaacacuuuucuucgaaagaauauuugaggacuagaaaaaucugucaauucuuugagcuucuuggagccauuugcuaaagauagguauuugauaaauacugauuuuuauuuuggagaccuuagauuaaccaacuaguucaccguacacgaagcacccuuuggggcucaccuccagagagguuagaauggguaugggaugugugugugggaugggugugugguggguaugggaugugugugugugggauggguguguggugggugugggaugggaugugugugggauggguguguggugggugugggaugggucuuugguggaugugggaugggcaugcaccaucaauuacuagucacugaagucaucuggcaaggugguggggagggguugcccucuccuucucucauggagaagagaggugggagagguaaaagaugaaaaaggugaggugccgggaggugccuccuccccugcacugaugugauuuuuucccagguguagaaaggugagugugacccaggauaaaaagaguuuuccaggcaucacuacuggcauugugacuucugcagagccuggggcaaucuccuagacuagaccggugguccucaaccuuggccgcgugugagaguuucugguuagcuuaacuaagcugaugggggguggggcccuuccccaaagauucugguuuaaucgguccaggcugaagcugggacaucgagcuguuuagggagcuacccacaugcagcccagguugagaaucccuagccacaugcagcagggagggucggcccugggagggugcugaccucaggaucacagagcaaauaguucccacgagcgucuuucuccugaugcacuguccugcgucuaugcaguuccagcucaccucuaacagagcagaggccauuguggggacgauaggcaucguuggguaguuagugaugucuagccaaaaacccauuaauaccaucugcaccuucaaagggugaaggucgagugagggggagaacagggauucaaauuuguuccuuggcuucaagaggagcccugauguccugagucagcacugguaugaaggcuaguccugaccuuaaacuucuuauuaagucaaaaucaggagcuugauguuucuccgguucuguucauaucaaaaggugucuaggguuggcugguguguggagccccaggaucugacugggggagucccuaaggugugaugcuguccugauaguggaaaugcccugggcgcuucccagggcaauggaggaggccagggauaugcagucccagauuggguuucgaccaugacagguuuuugaugacaacuucuggcgggaaaacugcccacaaaagagcacuugguuuuuauuuggucuuuuucauuugguuuauaaacuuuccauuggccuuuucuguacauaucccugcauguguagauauuuuauaaaaaggacagcuugauuuucagauuuugggagggcguauuggaaagacugauaaagagugagcuuuaaacuuauuagaaugaaagaagaccuuuauggaugaauaggcuugcuuuagacaaauuguucacuauuccuuccagcacagaaugccucuucacauuuaauggccaguuuaauuagaugacauggcuuuccaggguauuuuauuuguuugcagucagcuuuaggauuucuuacuuaggggaagaauaaucuguauuaaaaaauaggagauuggccuaaaguucagccauacuaaaaaucuacucucauuuuuacucuuuggagacccugucgcauuguguuguaccucguauauucucaguuaagaguuauggccagcgaguuagugauuuccaaaaaugucuccaaaauugagugcuguuuuaaagauggcuucccauguucuucagugugcuugcugaagauucuaugccaacucuggugaaggugguggcaguucaccacguugccggcagguuugaucccggaacagaccugugagcucauuguccauuugacugagaagcuaagaacuugcuggaggucuugcagcagcgcaccacagcuuuucauuccagggcuuuggguucuucuuuugugcccuuguguuguauguugcugucagagcuccggagacagugauggaccugcucaguguuuggagucggauggccauagguuccuguucaggcucugugccugaagacaagucacauaaucgucagaaaauggagcucgugccuccuccguagagggcacccgggcaugacaguagcuuugcuuauggugucauucugcccagaccacauccaagaccauauccaagagaagagugucauuaccucugacugcagcugucaccuaaucugugacacugagaaggccaggagcucuggcaaucuaguuccuuuauggggguaaaaacggagcugccuuaaguauuccagguguuuuacaagacauucucuuagauucaauuaaguuucuccucagaaauuguuaggaguucucuuuacacaaacuuucuggaaguauuuguguguguuucugucugggggccacagacagaaacugucaugucugguccucuugacagcucugugugugugugugcguguguguguguauaucuguguguguuugcacccacauacagggccagugccuuuugccuucuuucuuugccgucauuuuuccugcaauuggccuuuugucuaacaucggcuuccuucuccagcagugccaguggaguagagccuucuuuccugggcccugcagguagacccuuucuauuuuaagagguuuaaugguuaccuuuauaaggcaauuuuaaagguccguggauuucugcaaauucugguagccaugaucuugccucuguaguucccagcaucauuucuuagaccuaggagccuuuuaaguuggguagagucauugcauuugauggcugaaugcucguucuggaagccucguguuaggaccccaaccacacccaucccuggaccuacaggggccucuggaccccccuguuuggugguuuguuugucuuuuccucaccccagccucagcaaccaaggaucuauucuccaccagucaaauuuugucaccuugagaauuuucuauaaagggacucauacuguauaugaccuuuggcgcuuguagacaguauuaagaaguuggaugacaagaggguaagugaggggauuagaaaggagcuuugggguuuagauucacaagcugagugugaccucagugugaagggcagugggucguccccaguuguuuuaagcagugaaggaaaccgugagcuuuuaggaagaucaacucugacagcaggucacaggcaggucuugaaguggaucaguuggaggcugcugcugugggggagggagggccaggcagugaccuggaaggggcuggauggagagacgcuucggaagaaccaugacgcgguuugcauguuggggugagagaggaaugggggugcagagguuuccagcuuuagaaaugguagguagcaacacuguuaacgaugaaacacgugguggggggccuggggagagggagacggcggguauggaagggugagcuggaaugguagccaccagcaugggucugugggugguagcgccagacaggccaacagguagguuuccaccugcgugcccaguuggccaaaucgguggugacuggcuggggugaguagauucugaggcucgguucagcucuaggagaguguuugugauucauuagagaugcuugccaaggccagaguggugagaguccgugccugcagccaacuccccuucccugcuccaggcucagcuuccuuccagcauccucccgcccgcuccaguagggauaguggugugagaaguaccggguauuagagcacgucacccucaguuucuuuuuguuuucauggaaaagcguagagaagcuugguuucaaccagaguaguugagugugguuugacugugcaagugguacauuuggagcugaguaacacugaaaguugauugguaaugccacaugcauuuuucauugccagaaaugaucaaaagaagaugaugacagcuauucagguuuaaaaauauaaaauacuucagucaucauagaacaauuuuaaagaauucuuucaagggauuauggaauauaauaaaguguuguguuguauuguggaauggcccugcuucugagcugcagaagggcagagcuucggaauugucuuuguaacucuuggguggguaauaggauacuucgcacuuggguuuucuccucaaaggagccggaacccuggaggccuggcuggaguugcugguuuugccccccaccuagacugggcugaggggaccauguuuugugagaugagagggagcaggaaaacacccaccuucuggcguucucauugagcgcagaaucagucuguaaaucagaagauaccuccaucugucuuucucauucauuuagguuuucgccuugcaagguagguguggucaugacauuggccaggcaaacccccaggucauggccguucuguguagucugugaagggagcccgagacugaugggcccgggucuguccuggaccucccgcccugggccaaccugcauauccucaugaaugagaguccgguggcccagugggaacccaggggucagccugauggagacggcucucuccagcuuugcggaggccugauuauuagccuagggagcuguggcugaggagaccaucgcccccagagcucuccuuuugcuuucugccguugagucaggcccagagagguacaggagcuggcggggcugcaagacgccagcaugaacuggggcugcagucacagcaggggacauuuguuccaauaaagcaggugaugacugucccuccccuuguuuugggauuuucgacggugugccucugaaccccucuggucucccguggccgcuggcucugcgucuguggcuggguggugcuggugaggcagugcugggccccccaccucccuuguggcucacccgguccuggucccguguccucugcauccaggagccuccccgcucagguuugccugcggggccugugugcccuccccagucguucaaggcacaggggcacauggagguggguucagagaagaguggggaagggggugccgguggcccgugggagaguugcccaggugugggcacagccucugugucagggcucccucggaugcucuugacucugaucuggccuuugaggucuuaacuuucguccucacugguggcccgcggagcaugauucccggcaccuugccccuuugcaggccacauguucccaccgcucuaauugggguggggucuuggccacuggaaucagaugucaucuccaucucugggcuuuuuagaugaaguggagggagaagggcagacuuuuuuuugguauagcugaggucucacuuuguugccuaggcuggucccaaacuccuuaucucaagugaucugugggccucccaaggugcugggauuacaggugugagccaccacgcccagcucugcugugugcacacauacaugggcccucugauuuuucaguuauucucaguggcuggccauucccugugaagagugauaggcccacaucuacacaaaauggaaauaaacuccaaaaggaugccgaugagaauuacaaaacaaauuucuacuuccgaguguguaucgauauaugucacugccucuucucagggaaucugacacauacacagagugaccauaugggcguguuauccucacauggggucgguaucagcaggccgauuuccaccuggcaagcgucucaugaaaacgcgccuguggacagugguccugcauaucugaauaacguguucuacacccgcacuacugggaugggccaugaagcugaugagcaaauuccaggaagccauuugugguccuuuccaaucacguuucccaagucuuggccaggagcugacaagcggucacucacucacuccuccccacagcagaaaugcacaacccaaguuucuugaaaaacagaauaaaauuuaaaaagaaguaaaggcuaccuaauuaagcagcagaagacaguuaaauaaacuugaaugcagccauguaauggaauauuugcuuuuuuguuucuaaugacauggucccaagccuaguacagugaggagacaggagcuugcuggcuagguucaaaccccuccaccgcccucugccagcucugggaccaagggcaagauacucaauaucucuucugcucaguuugcucaucuguaaaaugagguagacagaaguacuuuccucuuagcuuugucaugagaaugugcugagacaguucauguaaagcuccugacccagagccuggaacaaguacacccucaauaaauccacuccuauuaggcuggcuacacgcugugugcacugcagggggaaaaugccugagucauauugggacacugagacaacaauuuugcauccacgaaaaaaauuauacauacagcuugacaaaggacaaagcaucuguucacagaaagaagacugagagaaaacaggacaaaaauuguuuaaaaaccagaaaaagcaaagacggaccuguuucgaaagccccuuucaccccagcauacugccaaugcuccucccuccaccgcacuccagccaccaucccucacccgcucagcuuuccagcugaccaacccugacuuacccaaccaaagccuguccuucaggucgggcgggcgugguggcucuuaaccccgaggucccccagaaggggaaguugggcuguuaaaauucuuggggggauuuuagggaauuggaaaguugugaguagagaaaucaguauucgagugccuucuauucagacccugcaugggaugugucagacaccuccacaggugcuggauccucacucucaguugcccuuaaugcagagauagauacuauuauuuaucauugucuuuuuaucccugaacccuuuccucagaggagcaagccccagggcucaucagugugaggcggcuuguggggcucgaggcucggugagcucgggaaggggaagucacucccuugugcuucccuuggucauagagaagccgauccuccugccuauaccgggguggcgagcccggcuccacuguagggacaaggcaucuaauugauauuuuugagugcugaguccagggccuggggagggggugcugugugcaggcugcucccauccccgcccccauccccuagucuucuugcccuaggggaggugacuuuggaggggaauguuggggagcggggguuguccauguguccugaccucccacugcuucagaaaaggcggagcccuugggcguccugauucuccugccuugcccuggcuuaggcuuugcuuccuuucaggcacgggcugugggguugaggggccccaggccuuuccaaucugaggccauagccggugcuuaguucagcccaaacccuucuaaaaaggaaauuaucaagaaggcuggcagaauugugccuuuuuugccaaggaaaucuacuuuccucggugagcaaauucuggcagcagaaucucaagguucuuauuugaaagagggccucuuuggcauugauuuuucuucuggccaugggggacacaguaugguaaugaacccgugcaagaauugccaaagggcagggcugcccgcgcagggaacccugcuuuauugagugccccauugccccggccucagcagauggcugccuucuugccagggguaauuuuuagccuggccuacagcugcugacacagaggccagggguucugaaagucgccgugcuugagcagauugagacaaugcagugacccuuuauuguacaggugccguacgccuggaaacgucuuuugggacaauaguaaaagagugaaaauugcuguuuucuaagccgucuugguccaggcaaaaggaaaacaggcagguuacuaaaacauuccagaaucuggaacaucugucuaccccugacaccccauagacacuuuucucccgcagugguuucuguugaauucuauuaucuguuguuguauaagaaaccaagaaaccgcuauaucacuuagcaaccuaaaacaauaacgauuuagcauuucucaccauuccuuggggugaaugggugguuuuuccacccgccuggcugaggugcauucguguggcuguggccagcuggagagugucuggggccuggguucagcagaggcagcgaggaaggcugcgugucucgccccaggucuagcaguuggcugcauguuuauccggugccgugcucucuuccacguggccucuccagugucuagaacaggccucuccacaugcugcugauggaggccuuccaggaggcagagcgaacacugcggggucccuugaggcuugaccuuggagaggguacaccagcacaggaaccacaggccaggugguucaaggugugggcugcucuuaugggagcagcaggcaaagucucgggggguggggguguagacacaagggauggguuauuagugccauuauuguaacaauccacaggguugccuuccgguccccaggguucaugccccucacacaugcaagagaugcucuuccauccagcaucuccucacuucccuccuggcacagcgucugacucaagggucugcgugcccugccugcuuuggggcuggguguggacgggcugccagcucuugauucagagagccucagcucaacaagaauugugggacaggaagaguggggcggccacagagacuccucuucaaagagggcagggauggaggcaucucacaacagaugggcugcagcaguucugaccuagagucaagcaugggccgucggggccuccgcuggggcagugcccagcuucuagcaucaguuucuguauuaguugccuauuguugaguagcaagccaaccaaaaccgaguggccaaaacagcaggcucacgauuucucgugauucuguggauugagcaguuuugcuggccuuuucugggcucucugcagucagcuaauggcaugguugaggccagguggcccaggaugacuugaggcacauccugggagcucagcuggcgucgaggaagugggcggaugucauugucuuucugaccacaccauuuucgauugccagcucuccacugccucauggucacgucccucuggagggagcucugcaaguccucuuggggccuugcuuagauuauguucaucagaacacagagcaagacuagcccagguucaagggccagggcggcagccacugucucuugcugggaggagugcccaagucacauucauagggguguggacccagagaggugggauuuaugggugguuauuuuuguaacagucucccacaggguccucaacaaugugguaaggguuuggauaaauucuugucgccuguuuuuaaaauuaagucucagaaaggaaaggccacucuuaguaugggagcgggacaguuuacuggagggggugaugaguugaccuaacaugaugguguuuuaguggcauguuggggcugcuuggccuccugucccagccugugccgaguggugguucuccagguguggucccuggaccagcagcaucucccucaccccgggauuccaauucuugggcccacccccgguugacugaaucagaaauucuucguaggauggggcucuguggccuaacaagccuuccaggggagugugaggcucacccaggucugagaaucacugcucccgggaaugacagugcuaaccggcucuccugaccucaggaaggcaggcuguuagcaccccucucgcccuugucagcaggaagggcuuuccccuucccuccaggacccccugucuguguguaggauaggcuuugaggugucugaccuggguccuguucgagccagggugagucugggguuuucuuauugcucaggggauguuuacugaccacagucccaugccacuuaucauaccugggcacagggguguagaggugcgugagacacagccccugacucuucagcuugcagcugagcaaaggagacagcgcagagcagagggcuacugugggaggacaguccagcaggggaaguggcaaauuccgugcacacauguugagcuagagaugucuggguagaaagagagaaugcuugggaagcagcuggucugggggguuccuguucagaaggaaggccugagcuagcgcuuugaaagcugucauguacgugagucuuuaacacagccuuuccuucaagguggcaauugaucagaauccauugggguguuuuaaaaacauggauuauucaccuccucuucugaacucccauauauuucugcaagaaugucagauguccuaggugguucuguucgggcagguuugggaaacaagggccccagacccugaaacuaccgggcaccccuggggagaaggaguagaggcccaggcugggaccuagaguaagggccagccaagguggagucugcgugaagauccuucuggaacuagagggacuggaagaagccagcgggaguggggcuguggaugcuaaaggacuggaaaguuacccagaggagggggagggcgugguugacaaggcucagacacgacauugcagcacuggugaccggauccagagcggagccaggcugcagugguggggaggaccgggcagguccagaugacuuugaagggacuccagaggaaggagagaguggaggaggagggcuuuggguuagggagagugcuuucguuuguuuuaaaugggagaaacuggagcauguugccaagggcagagagccagcagagaggggugaauggaagaaggagcgagaaggggguuacugacgaagccuuauccuggaggagagaaggauggacuccagagcccagcuuuggggacuggccuugaauaaaaggagggccacucuaccucauccuggagggagcacgguaagggagagggcaugaaagcagcgaggauaguagcugcugaaaacgggguauguuucauuauagcuaaaaaaggaugcgcugcuucccccgcauccccgaaagcugcucauccuagcagcuuguguuagaggagguggaggugcagguucaaggccgcguguagggggagucaggugggagguacccacccgggcauucuguggcauucccaaaagugacuggugauacucagccugggguauugauaagcuugaaaauaggaagaggaggauguuguagggcugcucacgagcuccaaaaacagucuucacuugaaaaaauuauccugggcuuugauugugggucauugacuaucuugguaaacccaggagucuuggacuguguuuuuuaaaaccuguaaacacacagccaggcuuccuccuaaguaugaccgucauaagacauuugaaauguagugccgugacugaaaacaauugagcaauuguucaggaaaaaaauuaaaugccucucgauuaaucacccaauugauauguuuagugcaguacuuuaaguggaaguuggauagauagguugauuuuuaacacaguggauguuuguguagcguuuuaggagccaagggggaucauggcuaaaacuguaguccuuguaaucccuggccgcucguuagaccucggauuacgcuggccaugaccuuccggugugggcugagcacucagugucuggccucuggccuguccugcucucuugguaaccccaggacgcauuucccguuggguauauguccaccacgcaagccuugguucauuuuguacuaagaugguugguggguuuugugagcuuuugcauuguuugaugugcagccucaaacaaacauggggcaggggcucugcgccccugugugcaggaggucacuguggcuaucugcucgugugucauuguggcgauaugugcguuguugccaugguggacacgcuguagcacuguaaggccugcaaaccagaaaugggcugacuggcuuucaacaguucucuuggagagcagcugcucggaacucagugugucucaccuuggagagcuguggcuggguggccccugaugggcccugaggcucacgucacucaugaggcaccgccguugcugcaguguugugugugugacccaccucacaugcaccacucuggauacccucuucugugucaucuuucuucuccucauucucuuucuuuaccuccuuuucaggccucccucuccucccugugcuuguuccuuuuccuaguaguucagcuucuucaaaggacucauagauuuggaggguuggccuggcguucuguuccuucuauggaccauuucugagggaagaugugucugcagcaguggugucucuuagaguccuuccuugcucugugggguuccaggcuagugcuugucaccggggugccauuggcauuuugagcugggcaguuauuuguggggagauaugcagcgucccugucuugccuugcuaaacaucgggauugcuucucaguuuccugacaaacaggcccuguggaugacagguuacugcccccuuugagaacucagcuguucacacgacucuguacuguguagcuguuaggaugagagcuugagcucugacagcuagccuucuuagaaauguauacuauauauguauguguaacuaaucaggugguuaagagcuuuuagaggcuauuuccaggguacagcauguaugugacaaaacaggcugcuuauuguuuucuggaaucugguuagauuguuauuguuuuggugaaggcaguacuauucaugaagaugcauaguuacgguauacguuuuuuuuucuguucugugauauagcugguuaacauuuuaguaaaaauucauuugaauucaggaacuuuuggggauuggguauggagaaaagugaauuuuugcuuagacaaaagugauuuuucgauaagucuguguauccuaacauuccaauaagugcuuagauuuuaauuuacccucauuauacaaaaguuggcauuuuuuccauguuuucuaaucuagcugggugauuguucuuauuguacgcuugcugccuuucauagucugaugcgcauguguaggugagaccuaggaaucuuauguccugaaccugcagagcuguggucaccaccagccugaugcuggacacagaaaauagaugagucccuggaagacaguguggucuauaacauuacacauaaaauugacaaaggaguuguggugcuaugagggacuaaaguuucccuuuucucuuccuucucucuacagaaccuaaaggcagacccagaagagcuuuuuacaaaacuagagaaaauugggaagggcuccuuuggagagguguucaaaggcauugacaaucggacucagaaagugguugccauaaagaucauugaucuggaagaagcugaagaugagauagaggacauucaacaagaaaucacagugcugagucagugugacaguccauauguaaccaaauauuauggauccuaucugaagguaaggcuuaaaauaacgugcuucuccguucugcagcacuuggcugaggugccagcagggaaugggaaggacucugauaggacaaagcacagcagguuucagagcaaggagagauguuuugaccuucgugaucaaaagaaccuggcuuugauaguuccaucaucucaaaugucuccuauagaaauauuuguggugaaaguguuugauguucuaauucucuuuugaauaaggaagaguauuucuggugggacuuugucauuaaaacuguuucuuauuaaguuauuauaacaguuauucaccuaauuuuaggacugcuuaugauuaguauuaaaaacucauaccaacuuaagaauguuaaucuuuugauauucucacuuaccagcugugguuuaauuuaaugcuguuaaaaacugcugaugagaauugauaauguugguuaguuagcuagcuuaucuacgcuugacuuuuaagaaugcuaggcaaauugguaauuacuuaaauaaaacgguaguuauaauaauaugacacaaaaauuguccugcacugccacucuguucuuuaagugggaaagaauaguauuaaaaauguuuuucugauccugcauggaaccauuuuaccauuuuagacaucguagaacaauccuguuacaacacuaagaaggcuuaugaccguucuuguguuucaaguuccucaaaauauaccuguuucacugaacuuaaaaauguuguaaccuuuaaaaugggguuuuagaaaucauaagaauugguggggaaaaaaacgcucugaaauaauuauuguggaauacagaacuaugaagaaagaaaugaugauuuuccaggggaggcagcgauaaaccuggauaauuugggccaggccucuuccuccccuggccuuacccucuaaagucucuaaguuacaacuuguaagcugcucugaugugagaagggagcguguagguuuugcuuuuguagaaauacaguaagguguaagucagaggauggacauuuugagaaccauugauuaacuaaaauggauauuuaaaggaaaucaaaauugagcagugaucccuuuuuuaucccuuguguaaaggacagcagugugucauaggucaaauguagcauuuugaaauggaaagagugaguuuuggagucaggugucacaggacuugaaucuugucauuuacuuugauguguggccuugagugaguuuucauuauuuuuuauaacuucuccacuuucucauuugcaaaauggaaaauuaugguauauaucauauguuacaaagauuaaauggaauuaaguaugugaaaguacuugacauguaguagguacuuaaugcguauuuuccuuccuugguagcauuuauucauaccucaucucuuaaauuacccugcaaugaauaugcaaugaagguaguuugcaguuaagguauccauugaggucaaaccaaggaaaccaggguuaaagaauggaggaagaaugccaacaagaagagcaaauguugcuguguggugcacccaguuugggucuugacacagcaaaaacgaaagcacuacacaugugacuuccgugggggaaugccagcaucuugauguuaaauuucuuuuuuuuaaugagauggagucgugcuguguaacccagacuggaguguaguggggcgaucucaguucacugcccccuccgccucccggguucaagcgauuuuccugccucagccuccugaguagcugggauuacagucgcucaccaaccaccgugcccggcuaauuuuuguauuuuuaguagagaugggguuucaccauguuguccaggcuggucucgaacuucugaccucaggugauccaccugccucagccugccaaagugcugggauuauaggcaugagccacugugccuggccucgauguuaaauuucgauugaaaacaaacagcuaaagaaacucaguuuggauucuguccacuguacugcguacuauucccugugaaauuacuucagcaguaguguucuaguaaauucagaguuggauuucgugugguuugcugauguuguauuuuaauaugaauuauuaugaugguuuuggcaaaggaaguguggaggauccugacaaauauuuggugauuuauaccagcuaauauuuaacuauggaaauuaaggaucagugguucaaaacaucuuguucaaccucagcuccuuagcacgaucuuuacugcaugcuggaaugggcugcuuuauuguggccaaauauagcggccacaguacauaucugcauguaucuagagauuccauccaaacagguccuguucuugccugagcugcuaaugcuagaacguuagguuucagaucagccuaaccuugaucuaagguugccccgguauuuuguuuaguuauuguaacgucaacugccguaguaaacuccuuaaauguguaacgacucauacauguuagaaauguaucucuuccucacugguugcccugauccgugggcuguuuuccuucagacacugauucaggaaccugaguuccuuuuaucuuauuguuccuucaucuugacaaguggcugugcucagcugccauaagucagcguugggggagaaauggaggcucacgugugggaaguuuuuaugugcccaggccuggacguagggcacauuguuucuguucauguucuccuggucagaacucagccacaugacccacaccugacccaggagaggcuaagaaaugucauugaauagugugcuucgugggaagaggacacaggcugugugcacaguaggcuggccuuuucaaagucacuucaucucuguaggaaguggaauagcucagggaguggucuucaggugcugauggccuccaggcagguugaaaaguguugauacuuuauccagugcgcucucuguauuuuacuaagcagauuguccuuuagggaguaucugccacaagaaugccuggaagaacguggccauuguggaaaguuggcccggauuuuaaagccaugugaaggacaauugucuuauuuggcuacauacaucaugaacugcucuucuaaaacaauaauuaacuauuauaauugagcaggagaagaauccagaccuguaauucugucugcccauucuuguguaauggagugucaugaaauucuuuggcccagaaggggacccuccugagucagaggccauucuuccaucaucuugguagguuuagaaagugugguccuaaugucaaggaggauacagauuaaauggauuuguaagacaaaugggucuuuggcacagagcuggaaauagugcucuaugugguuuucacugucauuuuaaaacacucccuguagcguucagagcuacuguucuuaguucuuuaagggugauuggagagagggccuuaggauuucacccuguguuaagggacuuuuauauagcaggccaggacaaagaagagauuaccagaaauggguuucuucauuguugggguagcuagcauucacaggucucauaauuauguuuugguucauucuuuuagucuagaaaaaaggauuuaaaacaauagagaaguggucuaaauauucugaauguuacuaaggaucuggugagugguguuaauuuugacaguagcagugaugaagucacaaaauugcuuuguagcauuuuuuuuccccuaaagauugaaaacaagggcuagaauuuagggaggagaaggaacaauacaacagugaauccccccacccccccaauauuuauggaucugaggccuggaaaggucuugaggaugaucacagaccauggaaaaaacuucacccguuguaguuucaguguuuacuuuuugggaaauuaaaccagcuaggauacuuaaccagaauccuccaugucccagccauuauaccccuggaguuuucugccacugagguaccauccacgaagucaaaaugaaacugccugugugugggguuggguaggggauaugggguagugugcaggaggggagagagaauuuuuugguuuuguauuuuaauuaggcagugaagacauauaauuguaacgagaacaggaugguguaguacgggaugcugaccuguuuuuucucugugcaccauuugcaaaugugcauucccuucagcacuuacaaaucuuuuuuuuuuuuuuuucaggggguuuguuuugaggagcuugcuauucuaucagaguguccauauugagauucacuuuuaguuauagccaagauuuuagucucagauucuaguacagguacucaacuggucgcuguuugggcugcugauuuucuugaggaaacgcagauauacuuccaugauuacuauaaagaugagaucauguauguaaagugcuggcauguaguagauuuuuaguaaaugaugauuuucccuuauuaaaaaaauuuuaaguuaucugcgccaaacagacucaaaauucacaagucuuaaaauagauuguuagcaugcuaaaaauaagguuuaucauuuucuuuuaugauaaauuauuuauuccucucaaacaucaagccaguuuaaccaaagcaaaucaggugcgaggucuuaaaagcugugcuuuucaaauuucuuccuugccauaguaguuuuuguuguagugucauuauuaaagaaacaugcccuguugucucauugcggauucagaucccugacuuacaaguuuucaucaguuccuaaaaacuuuucugaguaguuugacccaucagauucaccagaagacuaauaugggaaagucccuuggugaguuuuagaaaacuaaguacucuaugaaaguacagguuauucugggaaaggauugauuguggguaguuacagguucauaaucucacuucacagucaucuuuccaaguuauauucuugggacuucuauuguuuuuucugugguccccaaaggggaaauaguuucugaugaaacagaaaaaccagucauuuuauccuuggggaaaagaguaaaaaauacugauagaaguggccagcgucuccaugaacgaggcugcugugcaggucaguguccaucugcagucuuggaugcuucucccccgcauaacuaauaacuggccuauugacuuucagaugcacccuaguuuggacaauagaaaauaaucagccuacuuacuaugccuaucugcagaaaaacaccgugauucucagccuugcccauauuguaugauaacuucacauugcagagaagaaauaccagucuagcuacaugaugaugaauguauccuguuaggacaccugugaauuuuaucuuuacucacaccuuucuuuaagcuaguucauagcaaaucaugcucuuguauuggcccuuggcuucaggcauacuuaggaauucagauggguuauuauguuaguuucugaaagcauuuuaguucagauauaugcuuggugugggugaacucuccuaugccucagaaauucucaucaaagcacacagugucuuucucauucaugucuuugcuccuucaaaggcagagucccagccgcgcuuucauugagauggugaaaaugagauacuauuuuaguacauauggagagaugauuugcaguuuauuugaauuagauaacaaaugaaauugaaagggcccagaagaaaguugagacuccaccauauggagaaacucuugugcagucugaagggcuucugugaucuuaacagagaagagaaccgagccaccuagaucuggcacuguguaccucucuguuccuccugccacugccccauauggaccuuuccucacugaaggcacaggugacagugucugcagauguuucggcugccacuacuuggggguguggguggaggccagggaugcuuaucacguccacaggauggcuccacacagggacucacccagcccgaauguccacagugccacuguugaaaaacugcugcguggaaugaaccuuuugucccagaaaauagguuuaaguaaugguguuucuagggcugacauuugggacucuuggaauaucccaaagggcauuuuggauggagggucucggagcccauggcugugcccaccaugauguccguggcaggacccagugcaggcuuugccagcaucaugagaagggcguguccauacucggggcaguguguccacccugcgugggcuggccagccucuguucucgaggcugugaaugcucacacagcgccugggaaggcggauaacucagagaugcuuuucuggguuacuuuuguucugagguaagagagggcagcaaguggaccccgaugggcugcagaagccgguucgcagcagggacugauuacauaaguguuggcagugaccccgguaagucugguguuccuuauaaacccugcuuuccacaguugagcagaagacaccacagaugagagggagccccucccucacugaguggagucuuaaugggacguuugugacucucccuuggacacuuguacucuuucuacaaaaguuaauauucccugagacauuauuuacauccggaauggggcugugugacuggagguccucaccugcccauguuuuuugcauguuuuguagcaaacugauaaugaccaaugucagaauuaucuggcuuuauauuuugaccuuguucauuagaguaguguuaaugaaggagaaagcaaguuaggggcugguaccuugcuuucccuuuuuaaaaaaaaaaaaaaaaaacuuacuuuguguguguuuaggguuuuuguuuuguuuuuguuucucgguagacaugauguguauuuuuagugcuaaagcagggcucuucccaguagccucuuugagcuuuggacuccuuucuagccaauaaaaugaccuguuucgcucuaagucaauugcugcucauuuucugguugcauuucuuucucucuguucuauuuauggaccucagguaagaguugaguuuuucauauuuugcaguucauggcaccaucaucaucgaccuauguaagauccuuuucuguuuuaaucugugugucuucaauagagaaaacaugguuuuguguaugguguauguauggguuuguuuuuccccauaacauuuuuaaaaauuuauguacuguaggcugggcacaguggcucacgccuguaaucccagcacuuugugaggcugaggcgauuggaucacuugaggucagaaguucgaaaccagccuggccaacauggggaaacccugucucuacuaaaaauacaaaaauaauuagccaggcaugguggcacgcaccuguagucacagcuaauugggaggccgaggcacgagaaucgcuugaaccugggaggcugagaucacaccacugcacuccagccugggugacacagcgagacucugucucaaaaaaaaaaaaaaaaauuacuguaaaacucacucuuggauguauaguccuauguguuguaacauauguauagauucuuauaaguaccaccacacaugggaccagaacaaugccaacguuccaaagaauuccugaaccaucccccgcccauggcagucacugaucaguccuuagcauuuuggcuuuuccggagcaccguagauggaaucacacaucuguuguuaguggcuuuuguuaguggcguuuuucaguuauugucaugccugaggaauccuuccguguucaugcaugugucacuuguuuguuccuuuuuacuguuaaguagggcaccaggguguguauaaccagguuuaccuaucgaaggacauguggguguuuccagaauuuggugauuaugaacaguguugcuaugaauauugaugcacuuuuuugguaugaacauaaguuuuucauuuuucuagagcaaauacuuaugaguaggauagguauuuaauuucuauuuaaugucuguuuaauuuuccagagugccuguauaauuuugcauccccaccagcauuugggguacugucaguaauuuucauguuugccauuuuaguagguguggaaugguauuucauuguaguuuuaauuugcauuucccuaaugacuuaugauuuuugaguaucuuguccuaagacgcuuacuauuucccgucaguacucuagaguuuggaguaggauauucauuuuagguaaaugcuaccaugugggaauauggggccgggcacaguggcucacccuguaauuccaacacuuuggaaagccgaggugggaggaucacuugagcccagguguucgaggcugcagugagcuaugauugugccauuguaccccagccuggguaacagagugagacacugucuaucucuuuuauuaguaaggaaaaaauacuaccgugugguuguucggaauagccuuaccagcuaaaugccugguuuagcuguggguuuuuguuucuguguuuaaguaaaaaaauaaaaaccuuuaccgaucuacaauucacccacuuaaaauauacaauucaagaguuucugguauaucacagagcggugcagccaucaccacaauuuuagaacauuucauccccucgaaagauacucuacccaucaucauucacuucccauuucuucccagauucccgagucuccuuucugucucuauagauuugcguauucuggacaccucauauaaguguaauuauagaacauguguccuguugugucugguuuguuucacgcggcauguuuucaagggcucuguugcagcaugugucaauagcucuuuuuauugcugaauaauguuccauucuguggauagaccacacuuuguuaucuauuuaucaguugguggauauuuggguuuuuauuuuuuggcuguugugaauacuguucccaugaacauucguguacaaguuuuuguguggauauguuuuccuuucuuuuggauguauuacuugggagugggguuauugggucaaauguguuuugggagcccccaucugaauuggguuccaguaucagaguagcuagcgacccuucccuaaggggaacugaaaggcagcuggaugugggugaugaccgugugccuuucacaggaugcuucuuuuaccugguggaugggcucacgcauaauggucugagccccgacucgggaaacuuguuuauacugacggacaccccugugggucuugucugacuaccuggccaucauucuggugcugggaguccaaccuuguuugcucccacacguccugggguaaugugguugguucuucggauggaggguacagaguccguacaccaucacaacaggaagcaaguucaaacauauauuuuagaagaugcuuuugaaaaauggcuacauaaugauuguacagauaucugagguacaugugauauuuugauauuacauauaauaugucguggucaaauccaaguucaaagacuuauuacuuacauauccugggcaggaggcaguccucuguccuggguuacacaaggcaagaaugaagagucaggcagagagagagagcgacagagagagugugcacaacuggcaguauacauuauauaagagggaacagggcguggggcucuguaaguucucgggcaggccugaguguucuguuuaaaggaagcagauggaacauggggagcucagucugcuggguguaggagaugccucuaaguucuuaucuuggccagcgagcugggccuuuuggguguggucuagaacuggagaccgugucaagggugacuaagcccugcuucugguaugagaaaguuaaacuuguauucaaaauggaugccaaggcaacauaaaauuugaagaguuuacuguaauauacaaauuuuauguuuaaccuuuugaggaacugguuuuuuuuuuuguuuuugaggaacuguugagacuguuuucaguaguggcuuauguucucaugguagugaaugaagguuucaauuuccccuuguuuguuuuuuuaaaauuguguuaagcaguaucucaugguuuucacaugcauuucccucaugacuaaucauggcuaauuguguugagcaugguuugucuacguucuuggcaacauugauacuauaaaacuuucuuucaccaaucucuuagcuauaacaguauuuuauguuuauuuccauuucuauuaaucauaacuuugagcaucuauguauguucuuaaccauuaggauuauucuguugaauucauaucuccuaggaaguuuucuauaguuuaauguguuuauuacaugugauuaucaaauucccuuucaauuuucuagucaggaaauaauugucugauaauuaggcuuaugaaguauugugaaacuaaaaaagggugcccaaaacuauauguuuuggccugguagccacauuacaaauuaauucauuacaaauuauuucuagucugugaacaggagcucuugugagucucaccagcgcuagucacauuccucaagcuugaccaucccuuugagaacugaugaaacagcuuugaaauuggcaaagcugaagaauggacuucaaagcagagaaggugugaauuguuuuaagugggagcuucaugggaauaaaauaugaggcguggcccugaagguuaguuugugguauguuacaaaguuaacucauucugauuuaagaccaccuuuucugagaguuaggggaaagugcuuuuucucucugccauagcucguauggcauggaaccagacacuguguacacagacaugccccuggccccuuuaaaauacccccuguuccucccacccucacuuucccggacaauagcaauaaguuuaccaagaaagaucucaucuucugucccaacagaaauucuaaguagcauuucugcucuccaguggggcuugugguguaaguugcauuuaaauuggcauucuuuucugcugacccugaaaggcuagugguuuacuuguaggcaaauacucuugcuguuuauuaacauacauucuucugugaaauuuccuacuauguuucuugucucuuaguguugguuuuugauaccacagguguguucucugacuuuaucacacuaguuuuaacuuugaagcguccucuguuggggaaaaaaauccuugauuuuaauguaguuaauccaucaguuuuucaccuuauaugauuucugcuuuugggauccuguauacgaaauacaucagcuucucauagguuacaaauauauuuauuuuuuuucuucuauuagcuuuauaauuagccuuucauauuuuaguauuugaaguagcaagaagcgguggggagcaggaagaauucuggguagcugggaccgucauugcaggcuacguguuucuuuauauuuuugaguuuauuguaaugucaaacacuuguuaugcauugguguuugaauucuccuuugguacuuucccuguugcauuuugggccauguggguuuaugggauaacaccacuugagcuugacuugguggaauagagguuuuaggguugggggaagagaucugcaaugggcuuuugggaagugucauaaaagaagcuagagacaagaccuaguuagaggggaggcugccuuuaccaucacauuucuguuugucucccgccuuccugacucugugcucuggagaucuggagaccuggagaccugccucaggauaucccguccuggcugggaaugaagccagggagugugguagucuaauuuugggcucuguuuccucaucugcagacacugggcauacuugucuuuuaaguuauuugcagucuguaauugauuuggcucagcuggcccuaagauacgguauuccuuguguaaagucagagaaaucagagccaaagauaauuagagcuggaaaggccuucagagguggcuagcccuuaucuuucuuucucuaggcuagaaaaccauggcccagagaagcugagugauuuccuuuucuucuacuaucaacacuaggacaaauacucagauuccaggcaagugugaagcguuggcccugugccaggagcccgcaggccugucuugcuaauuugcucaggcuuucaaagcuuuugcagcccuuuggcuguugagcugggauuuagggccagaguuuccucauuccuggucuaccguuagcuucccugcaccugacgguuguccucuuaaguacuucucccccauuuucuuaccggauucccucucuccagugguguguucuccuucuacagaggguauuucagauauuuauucaauaguucagccauuuuacaaaguugaggagggagaaucggguggagcagacacaguggcacugccuugcuggaggcauccucgcuggcucucccgcccagcugcacauuuacagaggccuagugucggccagcaccguccuuugcacucaggccucugcucacaggucagcacgcccuuugcauguguccagugagguuccccugaaagccugagcaaauuagcaagacgggccugcgggcuccuggcccagggucaccguuucacacuugccuggaaucugagaguauuaggucacaucuucaaaagacuguauuuguccuagcauugaauucuuacucacggccaccguauuuauuggguaguucagcaggagaaauucuugccuaacacguguccgugguuuuagugcauuuuuagugcuucgccgaugcucaccucuguacucauauguauuaaaugauugaauuugaauuggugccgguagcugugccccacuuugacauagauccggaagcuuagccaggguccacaagucuguccuuuguguuugagugggaaauugcacugugugauugauaacggaggagcugcuucggcuacgggagacauugcccugugagcucggcagggcaguccuuguccuccccuccugugcucgcaucagcugcugccaggagccucguuuugguuuugugguccugcaccuuccuucguuagcacugcuguguuccucaccuguggauguucacgguugccuaugaaucugggcggugauuccauuuguucucauugcagccguuccaguuauuaggaauccagcugucugaaaagcuguauccuuccugacgaccuguauuuuauuuccuugucaccuuugcauccuagcacaggguccgugagaacguugcucuuuuugucugacaguucagacccgucgggcucuagagaauugacugauguguuuggaguuaguuccuagucguuucuggaguggugacugguuuagauuuuugccuuuugaaaagcuacuagacguaaaacuuaauugguguuuuggcgaguccuuuugucuguggcaguucaucuuuagagaaguaaauuaauuuguagguaagcuuuuucuccuuuuuugauuggcuaucuaaaacauauauuugaaucaaacuuuuaaaacagagauacagaaaacucuucaugaaaagauuuuuuugucuuccuuucuuuguauguuugauauacagauaacuguuaacaguauucugauuuccauuauucacauuucuguagugacaaggaucaaguaucugcaggcauuucuuugucccgggaaaagcagauuuuuucaaggaaaugauguguugauauauaauagaacauacauaaauacuuuugcuagcugugcaguuaguuagaaaguguugauguuuugacauuggguggcuguuggucacugcagauggaauugcugaaagaaauuuacauaaccuguuaagagaccaaucauuguugcacuagauuagguacucaaguuaguuuacagaauuuugauuauuuuugguuggcuugguaugagauuggcuuucgauuauaugcuucaauugggucuaaugacucuucccugucauuguaaauggaaucaguggagauaggucaaugacaagguugauuauagaccagggcuuacagaagcuaaucaucugcagucuucauuuacauacaugcuucugcuguuggcuuccagccaaggcugguguaguauaguacaugaauuuuggagucauuauugaucauauauuuccaacaagugugaugagguggaguuggcuuaaguugaaauguuuaguggaaaacauugguucguuaaaaguagcaguggaucuacagcucuuuuuugagaaugaauugcuauuauguuugcugucuacacugagguguggcaugaagccuuucucucgucuccuuuauaccuugguggaucuguguuuccggacacuuuuccuuuugaaaguugagaucccguucagaggcugacagacuugucccuagaagaaagggggcauaaauaugccaaaugcaaaaccacaaugauuucuuugauuacagggaccuuggggccagcuugcgguaagaacuugccuuuagaagauccuuugguucccaucagugucucccucuccucaaagggauggcagcccaguggacagugggcacaugacccugacaucgacagacucccacggagguaagcugcucugucagcgucgcccagacagacgugcaccuuccucaucagcccgaaccugccuccauccacaccuugugcacauguggauggaguacuggaggcuguuguuucucugcuuccagccaaggguagggaucagcgaccucaggugaaaaauagcccuuccucuccugggcuuagaaaugaauggagagaaagcaagcucuagcagcuuccuccugguugaggacagggaguuccccugagauagugcuguguagauagucaccgacgacuccacagcuuugugucugccccucaccacacaguaggcuucauucucaccaugaaccacuguugucauuuggggacaaguugaaagagucuauuucccuucuugcauuaaaggagaaacugucagcgggauugcuguuaaccacugugguggucaccacgaccugagucucgugcuaguguuugagagacuaagcucugacuuuucuagaagguauuauuccagauccugacccagggaagaggcaugguggaccagaaaucugcauuuucccagagcaaagcuacagacuggaaaauggauugcaaccuugcacaggcuugacuguuguugacagaagcucuacuuucuccugcucuguucucuuauuauuaaagggauggauauaucagaacaaguguguguuuguuguuuuaaaguuuguuuuuuuuuugucuucaguuaaguuaggcugcaggguugagagaagagaaauuuucauuugugugcuugggaaaaucaacuaggaaugaacuuucacuuuuacuguuuaaaaguaaaaauaucuuuggaagcugaggaauggcugcugggagaagucgauuuuaacccaaaugugaucuuucugucuucuccauagacuucacaucucccucugggacaguaaugaggagagaguguuuggccaucgcagguguaggagguggaggcagauucugcguggguggcuucugucaacagacgcuggacugugcagggcagcugcagugguucuggcugguugcuguggucagugggagucguggcauguuccugggggcagucacaucucugaacauuuccuuuaugacaguuagugcaguuuuaaaaaaggaaaaaucuucaauguuaaccuuuuuucugucucuuauuucuacccuuuaagauuaucuuuaugacuucuaaggauauuuuaagcucacagucacacuuggaagcagugcccuuguaaggcucugccuaguguggcuguauuagaaaggucauuccugguucuuacaugugcuucuccuuuccacgucucccacuggcgugcugacuuuccaaggggaacgugaagcuguccgcaguccuugcccuugcccuuucuuuuggagacugugugaaugagcagcagccacuuuaaugugaggcagccauauaaacaaugaacuuucacuugcugccaggaggucauaaacucaaggucaccaaaugaauucuagcuucagcucuugguuuaguaauguaccaaguuugguauuacuuuuuguuuguuuuaaucagguuucugcccucaucuucuauuugggaaauuaaaacuggucuguuggcauggcuggugacugagcggcaggcacauucuuagucucugacuuucugcagccaucuuugagugcauauaaguguuggguaacagucuacugaaugugcuacaagugugcggaguuguguucaucuuuaacuuguuuuuuuuaaaaaacacucucuugguaaauugggaucuccuguugaaaacuguauuuguuuggcaguugaguuuaugccuggagccccuagagcacauuuaacugguugguggucaguuguaccauacugaaaaaaaaaaaaaaaaacacauggaaaguauuucuaauauauucauuaugggaugugugagcccuuaauuaccugaaaaucugaauugucuuuccucacagguaguaguccucucagguguuuccuuuuuaaaauuguaaauggaauuucacauauccaaagaaauuaggauucccagugcugucuucucccucuaguagcauauuuugugucuuagcuuucuguuguuauaacagaaagacuggguaguuaccauagacugggugauuuauaaggaaauguauuuuucacaguucuggaggcugaaaaggccaagaacaugguacuggcaucuggcgagggcuuucuugcugugucaugacguggugggaagagcaagcaagcucgugcgaaggagaaaggcaccagggacaggacuugcuguauaacgacccacucucacgauaacaaaccuguuccugaagucaccacauuaauacauucaugagggcuccguccuuaugacccaaguaccucuuauaaggccccaccuccuaacccuguggcauuggagauuaaguuuccaacccaugaauuuugggggacacauucaaaucguagcauuaugacuguggaagucauuuuguuucuaaaggucuuuguucccacuugauccuaagacccuguuucuagggcuuuaagaccuagaguaaggugucagucuuuuccuccugccccaucuuuuaucaacucauugauuccuauguuuacuggacccagcugcucugcuucgggccaggaacgcagauaggaacauagcagauguggcccugcacccagaacuucuuugguguagugagggagagagacaaauaaccaggcagaugucacccugaguaagugcuuggaugaucagggcaggguuguccuuugggaacacaggacagggaaccauucaggacaagaggccaagaggccaggguuggggcagaguaagacggggcaauagcuuccuggauuaguuuuuagaguuuucugcuggcuuaggguuggagagcuggggcagcagcuuaaagaggggacccuccaauggcauaggggacucugcaagaaccuccggcagcagcacucugggucagagggcgaggaauugggggaaauuuaagaaggagauauuaggaaaacuucuuaauaaaggcaccaaacugauagggcaacaggggaaagccaaauggggaccuugggccgugucggagagcagacagggcuaggggagcagcuuaucgugcuuaucucaccguagagaugauacaugaggauuggccagugucagauaacugacuuuauuuuguaaaauuuuuuauuguuuuuaaauuuuuuacuuaagcuuuauuuuuaauuuuuguggguacacaguagguguauauauuuaugggauacaugagcuguuuugauacagauaaccuaucuugaauuguauucugccaaucgauucuaucauguaccuaauuuuuguaguuuauuauucagauaaggugguuuucugcucuuaaacugggggggcuggggaaauaagaauuuucacuugaaaaauucauguucuaaaacuuugacauagguagguugcagccuccucaguuccuggggcucucuucuggagucucucucgcugccccugcccuccuggcccccgccccaccccuggcuagccgaggaagaggaggauugggccuugcacaguugcacagugccugucuggagcacaccacagcucugugaggagggagugugcagguucagggcgauuccccuccugggguuucucagcuccacaggccacuucugugacuccgcggugaggcugugcaagcgaacccgacuucaguuccugaaaacugaauuguuuuuagucacuuugcuuaauuauagacuaaagaguuugaaacuacacauaagagguguaaauaaugugauauaaauauuguuggaacccucuguugugguuucccuuuuuuucccccuuauauucucauuucauuucaaaguuuuaaacaguaacuugaauguguauuggccagugugacauggacgcgcauguuuuacucaucagauguaguaagaaaagauguggcuacuuaagaacauugaggugugugacuuuaaaagucuaggugugucauuaaaaagugugagcaucccaguguucuccugggucucuggaaucaugaaauuugccacuaacaucacuuacacuguauuuuauuaaguugggccuacccagcacuugccugugugcuaaaucuaauuauugucauaguugggcuuguggacggguugggggaggaugggaggggaaggaaggggcgaggugugggaggaggcauggcagaagggucucagacugacuggcgagccgauggucacgggagugguggggggugggggugggaagguuugaccuaagguagcguuuccauaggagucccauucuuugagauguuaguaggugccaccuggucucaugaguuuggacgcaucagguuuagcagguuucuguuacaguauucucagagcuuuugggacucucuaagggagguuuaauaugcagcauuuccugacaguauuuaauugugggacaccccuccccucucugaaugguaaauuucaauuccauaucaagacauggcagagccuucuuaaauagcuucuccagccaacacacuugggaagaugaggccuuaggaaacguggugaagaacuaaguccagagaugcuaagugcagucaguaauagcuuucugugggccuccugcucauuugcugugguugaaaugcauuucuuaaaauguuuguuuuuaaaacuagaugaagugacaaaggaccaugaagcauuaaauaaaaggcaauuccugaaauagcauauuaauguuuuaaaugguuuuguuuuccaguaaauagcucucugagugaugcagugggauuugagagaaaagaagcugcaagguauuugugaauguccuguuccuuaggaaacacaaaguaacacuagcacgcacaucacaggagcugaacccugcaguagguuaaaaucuucagcaacagauugagagauugaggggauuaaaggguucugauuaacacuguguuauccugaaaucuuuuugucucaauuuuucguguucucugccucagguggguauggcucacgcuccugcauuuaguccuuucaguuaagaagucagucaccguugggaguguggaaugcagcugugggcaggcuagugaccucugcccucagcuuugggcagcaagaccuugucuuugcugaucagggcuuccagugcuuccgcugguccuuccuuaccucggcuacugaucacugcucccugcuuacucuuggaacacucuucuaguccaagccuggguuuccagucucugcaccuggccugcccccucuccuucucagauccacacagggaagcgaugacgcaccccaccccugaaaugccccauggaaacaugacauuccaccugccccaucagugaguucuuucagcugaugagccaggacucagugaauuagucagaaguuaccuuuuccaagggauugaugagagggugcuucuuuccauacgcaaucacuccaagugggaacacaccaggagggugugaaaaugcaggugccgcauccccacccgacugaccugauuuaaauucccaaggugcgggauucccucugccgugcgucugggaaauguguucaugccuugcaagugugaauguguggagaacauuaggcccuuacuugaagcugguuuuuuuuuuugagauagagucuugcuuuguugcccagguuggagugcagugguaaaaucucggcucccugcaacguccgccuccuggguucaagugauucugcugccccagccucccgaguagcugggauugcaccacuaugcuggcuaauuuuuguauuuuuaguaaagacagggauucgccauguuggccaggcuggucucaagcgccugaccucaagugauccacccgcuucagccucccaaagugcugauuauaggcaugagccaccgugccugccugaagcuguuuucaaaggaaccguugaggauggaaucaugaaugguuucuuggagacagaaaaucuggagacagaguuaccagaacauuuuuccccaguggcggucugggaugccucagccuggcucuguccuguuuucccuucccuuucugucccacuggcuccugcugugucugccaugggucugcagacaggaggacaugggcagguaaugccuccuggauucuugugcaggguguacaguggggagacggcaggggaggagggacaaagaaaccauucucucauguccaucuaaccugauagccagguguucaguuccaggccuugggcagccagguccagcccuagagguccucacacaccacucuuucacuugcagagaagacucaccagaauuuaggggcucaucccaaguuacaggaucccauucuuucccaaccaaugcccucauuuuaccagcagacaccccaugagucugggaggucaacuuguaacuugucauucaaccaaucacaggaugagguccuggcuuugcuuuucagcaaucucagcccagugacuguaggaggagagacuuucccuccagccacaccuagcugcucuuagaugauuugaugcagugcuugagcugagcauuugaauuccuuaguucauccuagucuuucaccacuuuguccagugacauuaggagcaaccaaccaacaucauauucucaguuuuucaaagauguuggaagggaucauacacagaguuaacuuagacccuucuuguaagucuuucgaguauccagugcagacgucuaucauaucucuaucaacaguucaaacaauagaccaucagugcucagcuaacuggacacaacaucauuagcaucuuaagauccaaucagaugagagagccaauuccagaaacuccaaaaccaauucagaaaaugcauccauaagacuuuguuccucuagaaccacucuugguaccaaaauagguguaguggggugugggcuugggacucccugaagugaguugguggcucaguugcugagugcagccagucccacuuggucuuucuuggugaauugaggguagauuccuuuagagaguuaguguuacaguucacagcaucuguccccaggacgcuguacccuguuguuuuuccauugcugugccaguuuucucuguacauccugguauccacccagcucugcgccagggaugggaggaaggugccgucuucuuuuaucuaaaugagagacaagccaaugggcaaguccagagccagggugugggugguccacagaauuuguguuaguggcuggagcugcccuccugagcuuugccagcagggcccaggucuccugagccaccucuguuuugggagcucuugaauuccucaaagagcaugacaggucauuugagguaagcagugugagauugggacaagagguucugaccucucuuucauggcguccugguuuucacuagggcaucgucacuguaucugugacauggaaggcaaaacaagggaacagaaacauuggugucuuacucuuuuugaucuggcaggcagggaaaaagaaaugugccuuauaaauuuuguucauagucugccuggaguuuguggugagagaccauaaaccaauuccuaacauacgugguuaguccuaccuucauaagugcugcggagaaaacuggggcacagggaggcuuggguggggcuucuggagcccucaguggaggggucagggagcagcucacagggaggguggcuuugaggcagaccccagaggaaggcggugaggaaagcaggacugugccgcgggcagggagguggccagagaagaggugugccgaagagugggccuggcagcugaggggugccugucccuggggcugcugggcaccuagccucugccagaaucggaaauggguuucuugcuccuagaaaugcgggucccaacacuguccuacucuaaucucagcauguuaaaacuuggagggggagaguaggauguguacccgcagaugauguggcuugcgcauuucacugucuguuuugugacuucucugcguuguuuucuuagguuuuuggcuggugauuuuaaacaaaauugauuuaagaguuacuugcaaaugucuguccuguuucugugccacuucuguuuucaccauuuguuggcuccgauuaaucaacucugcccucuaaaggaauggguuuuggguuugugauucucuuuaaguggugcaaauauaauaagcagagucugcaacauuuuauaaacaggaucacaugugcagcucauuuuaguggcaauuuccccagagguuuguaaguuggauuuuuauugcauugaagagggggcacaguguucuuugagaacagccaaaucguugaucucguguggggacacacccagaggagcccuuacugggacauggaggguuuuugucugguggccauugaguuacccuagucauugguuucugguugcgcagccacagcccaccggggcccagugacgcuggggacuucuguuucuuugcucaguagccucacgcccuccuuugaugugguagggcagucagaguugacuucuuuuuuccaugagaauucccuuccucuaagcaauaaacaaaaucuuuauccuugugacuucaguuuggauuguggcaauucucccuuccacuuuugcugccucgccaaggguuggaaaucugacuuguuuauuccaaacaugaggauucucugguucuuacgagcaugcuugccaccucuugacacaguccucacuucccugcaucagugucugcucaucugcuuaaaucaucccacccauggcuccccacagggaagcuggagaccuuuguccccucccgcaugaguguagggcagccaugcaccaaggcuuccuuugccauuuggaagucaucggcugccucccugaucagucuggcacagcugcaacuucugggagagggagaagcacaucuguuuucucugagaaaaaucuuuagugugcagggaucugcccuugagcuuuuguggaauauugaaaugguccauggagcccgugguaucagacuguaguggguaaaagcaaagcuguuugcuuuuggguggacuaaacacaucagcaacgacgaaacaaaucagcaaggaaaucuugcugugaaaucacaagggcguacauuucauuucgcaaucaauuaugggguaaaaauuguaggcuuagugccgaagauaauauaaaagaucugcuuugaaauguguccgaggacaaggacuaugaucccuuucucucugcugaacacacuguccuaguguaacugaagaaagcccccgaagacauuuggcagcuucauuuuauguuuuucucuguccagaaaguugaauggaauuaaaauuccaauuaggcuaaauauuuuacuucuccaaaaagaaauucagcucuguuuucuggcuaauguuaccuauaauuuaaaauaaguauuaauggcauuuuuaguucuuuuugucucaauaugcacauucugcaaauuuaaaccucuugucugggguaucuaaacacaucugauauauuucaauaaaauaauuaugccauaugcuuucuuuucuaaaacuucuauauuccugaguaaauuucuacaauguggcaugauacaagagaucacaaauguuaauuagauuauggaauaaaggacugcagguaaguaauaaaaggagacuuauuuccagggaggcaaaucaauucuccuucagcaguucuuguaggacagcaugacuuccaggcauuugaguaaguaaagacaccugcuucaaaauaaggaaagugggcugcgggaaccaggccccuuucuugaaucuugucugguaguaacaaguugucgugguuguugcugacaucggaccugguuugcugggugcuagacggagcugggaggcuguuucuuggagcccgccauccuguugccuggguuuuaugugcugccacagggucaucuucaccgaggcguugguggugguuccuucugugcuggaugcggcgaggagcagcugucucugcaucccuccaugggucgcagacccuucuccugggccuuuagcuggguguuugugccccggggugccucagugcgggugcccuuggauuugcaugucugacccuagugcagugugacuguuucaguagcucucggcuaacaaacuuauuauaaaucaagaacacauugauuuacauaacugacaguuccuucuggaauagaauugugcagaaaauaaaaaugaaguagcaaaagguaggagggaagagaaccagaggguuccaacacuagaaaaaaaaugccucaggacaaucaagcguugaacagacaaccacagugaacagucccuuccuuuggaagcuguuuagcuugggguuaaaccccauacauggcaguggaaauauaaauaugaauuugucacccaugcauuugaaauacagcauuugcuguuugugaaccagcucauuccauaauuuuuccuuauaauacuguuagaggcacuuuuuuuuuuuuuuuugagacgagucuggcucugucacccaggcuggagugcaguggugcaaucucggcucacugcaagcucugccucccggguccacgccauucuccugccucacucagccuccugaguagcugggacuacaggugcccgccacuacgcccggcuaauuuuuguauuuuuaguagagacgggguuucaccguguuagccaggauggucucgaucuccugaccucgugauccacccgccucggccucccaaagugcuaggauuacaggcuugagccaccgugcccggccgaggcacuucuuaaaaauuuuacacuuugggaggccgaggcgggcggaucacgaggucaggagaucgagaccauccuggcuaacacggugaagccccgucuguacuaaaaauacaaaaaauuacccgggcaugguggcgggcaccuguauucccagcuacucaggaggcugaggcaggauaauggugugaacccgggaggcggagcuugcagugagccaagaucgcaccacugcacuccacuccagccugggcaacacagugagacucccucucaaaaaaaaaaaaaaaauuuuuuuuuugcagaauaccguuaagucuuuauucuuucucagacauacuuucugacuuggucuuguuuggucucuuucggcugggucuugaaagaauuaaugcuaagucauaaaaaaucacuuuuuuugguuuucauugauauuuguaacauguuacauauugacauuaagauugucaucuagcagaacaauauuguaauuauuagaaauacuccacuuuugcagaaagaacacguguuacuagcuucauagcaagaugauggcauggaacuuaucugacuuggcaguugaugaucauuuacugugauguuugcucuuuaaugaagauggauggggaggaaagaaaaaaucucucucuugccucccaggguacuuuuuccugcuucucuuuguuguuucuuuucuuuucccucagauuuagguuauuuguaguuguauuucccugauugcuuuguaagcauccuuaaguuuaagcagaauguuuuuauuccucuuaguaucugcuagaauuuaagcacagaaacuucccauuagcagauuuaaugugucaaguuuguguuuauggaaaagaggaacaucucuguacauauuggacgcgagcacacgcacacacgcaacccuuuccaaaagagauggucugugacauaaaucccaagaagaauguuuuagggaaugcccaguguucuuuccaguuuauuaaaggggaucaggaguucuuaaaccuugcaugauggaaugaggcacguaaaccuuucaaauuacaggcaauuguuuucauaaauugauguacuuuuuggacagucagauuagaguucauuggcuucuaaaaggaaaucaguuaaaaauuaaauguuaagaacagucaaaguauuuuucuuacuggaauccuuuagaaauuaauagucugugaauuuuuuuuucuugugguucuuauuuaggcaucugaugcaaugucaggaaaucuggauuugagucccaguuucucuccuuccuugccaugugcaggcaucuuaaucuguaaaaugggaagaggcugauuaccuaaggggagacaggaugauugggagaauccaguggaguucucuucaugaaguauuuaguacaguaugaguugcugccccaugguacuaauauaagauggugguauggauccucccuucuugaccagggagagaaaaauugugggguuguuuucuuccuaaggaagccuguggccacccugugugaaggagaaugaggcuuuccugcuuucccagcucaagccucuugaaaagccugcauccugcccaccugggggugggcugugcggagcaaauccugaggauugcuaggggugggccggugguauucgagaaaaagagcugaaaaagauuuaaauacccggagacucucauacaucacauacucauuuccaaaagcacccuuuuuuccuccccuagaaagggcccucuuugggccagccccucucacuagacuacagcuuccuaucgcagaaagggcuucgcucuucacacauagaacugcacccucccacuuucuaggaguucucauccuuccuuaauaggaaccucuuccuccuccucuuccuccuugauuuuggcauuauguugugaugcccuuaaaaaauacugugcccugaaggaguugcuaaaauuaccaguuccuucacguuuuggaauuauucaagggcaaaaccauuugagccucuugcgaucuguugauuuguuuacacacacacacacacacacacacacacacacacgcgcacgcacuuuaaaggaggugaauugaucuauuucuucacccacccuuuucugccuauaguuuuuauucuuucuugaguaaauuuuauuaauaaauuauugaaauugucuaauucuguauguucaaauuuacuauuguaaaauuuugccauguguuuuauuugcauuaaaaauuuuuuccuguccuuuuauugcucuauugcaaauggauaugugaucuauuuuuuccuugguuauaguaacuggaaguuaucuauuuuaaaaaugauuggauucauuucucaucccaauauuuuugauuauuuaugcauguaucuuuauucuauucuuugcuuuccuucuuagacuuuuggauugaacacuuaguauuuuuuuuuuuuuuuuggcuuaguaaugaauguuuguaaugcuguggguuuccuugaaauaaaucuuuggcuggauuguauagcuuuugguguugcaguguuuccaguauuauuuguagcuaacuuguagugaugguuuagauuuuuuucuuugaugugaggaugugauccaguaauuuucaguugcuucguuuuguuccucuuuguguuauuucagguuuuaucgugcaccccuauguuuaaguugauguugauguuacagcggccuuucucccagugaacguuuguugccagcacaagaaaacguuccuugcuuugaagcacuucuuccugcauuuggggcccucuggaagagcgaagccuggggucucccuccccgcuccuuuuccuaaucagcagugaucucccccuaccccaugcucauaccuaaaaauagugacuaagccaccuguugggaacuuggacauuaguuuagggucagcagagaaggcauugcucgcagggagaugagaagggguguagguccggugggcuucugcauucuucuguaagggggcuagcuguacccccagcucacgggaacguggugaggacuggugacaugauguacgccagaaacccagcgcagugccuggcaucugaaagggaaggacaaccagugcuucccucuccacccuagccugacagcucccccggcuuucugugcugggcugguccccaugcaucuuugcagcucucucucguuuucuccagagaacacuucucauucuccaucuagccucuccuucacugugggaagccuccucagguuaguaggcaaucaguagugacaugauuugcuacagaaacuccaguguucuguuuuuuuuuuuuuuuuaauguaggcugccuucccuaugggaguggguuggagacguugagcugcugugugccuaaguuggacguuuuuguuugcgaacacaagggaggaugaggccuuccuuccacauuguccaauccggguuuucuccaacacuggaagcugucacugcuggcugguucuuuucuaauaaugaucaccugggagaauggaaggccggcgccuuuacuccacauucaucacguggaagcuuugacccuggacguuaguccaacuuaguauuguauguccugcccccaccccuuuaauuguguugcugagauaauguaagaguucaaaaugcaguuuggaacuaggguaguacaugggaagagugacccacaggauguaauguuuuccggugaauauaggguccucuuauuaacuaaagauaauaagugauagggcuggacuuuauuuaccuaggguggcuugcauaugaucaacaugcccuuugaguuaaaaauuuggcaauaguucacuugucaggaaggaaaaacucuuuuucucuagguuagguucagcauuuggggccugcagauuaaacugauaagugacauauuaaugagagaaaaagguuuauaucugugcacacaggagccagcaaaggaagcagcuggcuugcugaauaucccaccagaguguuuccucaaugucacagaaaugcaggcacccaucuccacucccuccccuaccuaccugcuguugcuguuuguccuggcagagcuggcugucuugggugcagaggaggacaccaucuuggcuucuggcuucucuucuuuccaugccuguccacugugggugcucaucagugccacuucuagaaccguuuugggccuuucccugaccuucugcuuugauuuucucauugcuuuuacuuugcuuuucuccucgcucuuacuuuccuuuucuccucauguauuuguuguuguaggcaguggcuggucauuuguucuauuagcacaaguuucgcugacuucccauugcuuauuaaauuaacuuugaacaccaucagcuggcuucaagggugucccucucauuccuagcugcccucugcgaacaggauuuuuccuccucuucuccaccugagccugugagaaacacacccccugccccaggcuggcaggucacagcccuucagggagcagcucaggugccgccucccuccuggagguuagacggaccuucgugagcaaccagguguucccugucuuuuguggcaucugccacuggcugucugaugcuaauuauuugcccacuuuucugucauuagaaguuccugaaagccagagccaggguguuacucacucugcguucccccucagccacccuggguaccuaguagguauguuauguguuagaugaaucaguuaagaaauccuagcgucugugagccugaggaacaaccacauaagcuuuuccagcucaggaaugguuccugcacuuugaagauggucaggggcugcucugaagguaaaauaggcaacaggcuuggauuucuuccggguucgcaagccugcaguucagacagaggacacuguggaguuaacacaguaauagugguucaaguugaugagucuugcuguguacacggccucacuucaucaucaucgaagccccucugaggagcaugcacauuagucccgggggcaaugggaaguggaggcucauaggcgaggccuuguuguaguugccaucagagcuggccugagccuggaugcaaaccaggccuuaaggcuuugaggccacaugcgucaucugcgcggaaagguaccuuuuacaaaaacucacgcucuuaaggaagucugugaccccgugugauuuuaauaaagcccgcugcauuguuuauaccucuuggucuuggccuuugguuacagcuggugaaauguggaggcugccaagggcauuucaggugcagagcagaguugcaguuucgaauuccuguuuuaaaaucuucacuguuagcuguguagcaucugcccuuucucguuugucuuuuuuuuuaaccuugguggguucgugugaccucugccaagcuccugugagaguuguuaaugugggggcccugguuccggucaaugauuccggguucuuaggaggcacuuccaaauacuuuggggcaaguuugccuggaagugcuaugguuauugauaguaugucuauauuaaauuaauuucuguaagcaaaaauuaccagaagcaaaagcuaguguuugcagcuccuauuacagaaggcgaacuuucccaauauguuaaaaacuccuacuuuaaaaaaaaggucaguaacccaauagaaaaauggacaaaggauauacacagcucacaggaaagaaaauaugcaugacucuucaauauauaaagauguucagccuuacaauaggagaaagauaaauaaaacuccccugaagcauccuuuguguaugaaugaauaacuggcuuaauuugcuggggcugccagaacgaaguagcgcagacugggagccuucagcaggaauucguuugcuaauaaaccuggaaagauguugguagggugguuucuugggaggccucuccccuuggcuuguggaugaccgucuucucccugugugcucauguggucuucccgugugugugugugugugugugugugugugugugugugugugugugucuucaucucuuuuuaugacaccagccguauuggaucagggcccacccuaaugagcucauugcaacucagucaccucuuuaaagagucacauucugcaguguugggaauugggacuccaacaugugaaucgugggugugugggagagggaagcacaauucaguccauaaaaaugaccaaaaaauaauaauaaaauaaaacuugaugacacuguggcaugggaaagggggaaauuagcacccucagacacugcugaggccauauaugggacagccucuuuggagggucacuugucaguaucuguuaaaaauucagauggagucccuucacccagcaggucugcuuccaggacccagcaaaacugacaaauguacagcucuuccuugacaccugggccgucagagcgaaaaauggaaacaaugugagcucaauaaggcaugggcuaauuaugguuaaaaaaaugaggaaguccuuuacauauggacugcucuuuaagaaacuuuagguaaaaagcaagguaaacaacaguguguguagaaugccaccguuuggguaaaagggggguaaaguuuuguagguauuugcucguaugugcauaacuauuuuucucugagguuacauuagaugucgugaugacuugcuggggcagggacgguugguuugcuggguaaugggggcccagggugggagggagacuucucacuguauauacuuuggcaccuuuuaaauuuucacuccagaauuuauuaauuaaaugaauacuuuuauuucccugaugagaaaauuguaucacgaggucauucauaacuuagguuauuugagguuguugaaaaaacaugaaauuauuucgauuaaagucaucauuguguugagaagccugcugguuuauuuuucuuggggaaugagugccucagaagucaugguuuggaagguuuuaugaggacagugguuccacaucugcaggacagagcuggguccuucccggagaacaggcugccacucagacgcuccugccaugaggccucuggugcagaauacgugaaucauuguaccaggcuucauuuugcuuagaaacuacuuagaauuguuaauugggcccuuuugguuuuaccagguuauucagaggcauuucugggugaugauguugauaaagcugauagcacuuugcaucuguugagcaccaugaauuuugccaagugcuuucccacucaugaucucauuuaauugucacuuggaacugugagguuggaagcaccgaucugauucccaucuuguuguggaugaagaauuuagaggguuuaaaugacuugccugaugucuccugguaagagcuggucuuccugcugcaggaguuucaguguguaagccaagacgaggaagaauggcugaacggugcuucuggucaggaaccaugucagauuugucagcguccaucguggguguaguucagcgguucucuguugggugauuuugcccucugggggacacugacgauguuuggagacauuuucaguuaucagaaccuggggugugucaccggcaucuaguggacagagccaggggugcugcugaacacccugcagugcaugggggaggccugcagcagagcugagcagcuccaaaagucagugcugggguggaggaucccugguguggcugugaaggagagccuugccugcagcccccaaagcuugucucuugcuuucccaagcuuauccguguguucaccuuugaagguuucuuccuuaggauugguagugguagaaacgauucuuugggaucucauuggaggcacauuucagggcccucuucuggcgcccauguugacugucuguuguccuaccuucccagugcagugcugcagggguguggcgcgagugcggcccacauguaugggcaccagaagacugagacccggccuucacucuguccccuuuuucuuucuuuuuuuuuuuuuuaauacuuuuaaguucugggguacaugugcagaacgugcagguuuauuacauagguauagaugugccauggugguuugccgcacccaucaaaccgucaucuacauuggguauuucuccuaaugcugucccuccccuagcccaccacccuccgacaggccccagugugugauguuccccuccccgaguccauguguuccugucccugcuccucuuccgcuuccucccauuucugugggaaggaggggaaagcugcugucuuaguggcuggcguuggguguuaggguccuccuccauuaauggcuggugcauagagcacaggaagagagccccagaagugccaggcgguggugcagcugcugccugugucuagcgggcuccauccggucccccgggccgaccuucagcggcuggaaugcuugcaaaccugaaaccgccuucgcaaaaugaugacugagacuaaagagaucgaacuuaacugacuccaucuuucuaaccuccaagcuguccuuguucauuccugggcacaggcugacuuaacuuugggagaaacuuacaguuuaaacaaaggcgguaacagcccuuugccaaagcagaccuccuucuugccuggggacuagauugcuuuuguaggacuaacauuagccacaagauuagaaauuauggcuuaggagucaggcagcuuggggcuacaagauucugagccucucuaaacugcuccuaagaucagugccugagauauuuugcaggcccugcacuugauggaucagcuggccccacucagaucaauaaacugguucaucugaucuuguggcccccacccaggaacugacugagcacaagaagacagcuuugauuccccgugauuucaucucuuaccaaucagcacuucuggcucacuggcuuccccuaccccaccagcuuauccuuaaaaauucuccccgaaugcucggagagacugauuucaguaauaauaaaacucuggucuccugcacagcuggcucugcgugaauuacucuuucucaacugcaguuccccugucuugaugagucggcucugucuaggcagcgggcaaggugaacccacugggcggugacacacccaaugagguugaaaagcagguuccacccagaguggagcuuuuccugaugcaauaucccacccccugguuguuggugcuggugugugagucacaggcccagcccggguauuugagacgcagugaccucaauaaggacuugagcugguuuccugagugcccucuggugagccuugugucuggguagccuugccacccagcgcgucugcuaccaggaaugaguuggagggaagcgggaaggcuguguuauuucuccaucuuccucuccaggaaggaggcggccuugguccugaggcgggguuugcucuggguagagagcucuggauguucuguuguugcuugcacguccccagaaggaucagggcgacacagaaaacuugguugaggugucuugcuagggcuccuuaaaaggagaagguagccaggugaaacuuaucuuguuugcuuggcaaguggugacguaccuucguggucagauugagagagcagcgaacugaggagggcggagcuuuggaagugcagaaggacgaggggguggucacuugugccuugcugcuccaggaagcugccuggugacccucaguccccuaagucagcaaaagauuguuucccagggugucauauugcacagcuggcuacagugggagaagaggcggggagauuaccucccugcugggagcuccccuugcugugagcagacuuaaugcccagaaaauagaagggaugggagccagugaaaccaguuaaacagcagcuguuaaaaagggagugggaguagaaacgucagaguucccagcucucuuagggaaaagcgauuuagauuuccuuugccaucuagaaagauacugguguuuuccuggaagagcuuacuguggcauacccauuccccaggagcaagcauuguggaagccugcaggcgagcgugugugugagaugaaggugugcugaaggacacucuugaugauggaagcuucccugaaaucagaaccugggaucaccaagccuccucaaggcaggugcccgugacuggaugguuauugaaugagcgacaugccugucccucugaguugggugucagacacaucauucgagguuuccgcacuuguccggucaagacugaaguugucuuuauuaucuuagcagucaagggcauuuaaacgcuugaaaagcauucaacauacauuaaaacuugggcuguuuauuuggacugucuuagaaucaacuccagauggcaggauuuaguuugaauugugagaggaauguauuuuauaaaugcagugcaucuuaccguuagcgccucccuagagucaacacgaguuacucuuccuuggucacaggguccacaguuaacauuuacugagcucgagcacaccagcgcugucccugagcacuugaguuugcuguuaaguggaaaaugcagagaaguaaaccugaaaugaaaaucagagcaauagauaauaaaaguaaaguuugcccagggcguggggagggaagacaagugaagcauuuuccugacuugcggaaccuccaaaagcaaaaaggccugggaaguuggggcguguucucaaagggugagcucacuuggagucagcgcagugagaccuggagucaggggcgaacugaggggucuuccuuggguguucuaagagccggacucagugcucucccaaagggaccaaagagccuuaaaaaagguuucuucuuuuuuuuuccuccaugugugcaaaagccaccaccgaguccugagucagcagcggagcaggcugacgucugaaccccgugaacccacugugaacccaaacucuggcgguggcgucccgugccagccauggguucuuggcugcucgccguggccaggcucuuggccaaggccucgugcagaagcucaggagacagcugcccgggccccuaggucgugaagugggagucgggauccagacccugcccaggcugccccgugcccugcacugccuggcuccccaaggagggcggacagguuugcgggcuuguuuuccagggaguagcacuuugggauuugugguuuuaaaaagagaacucugcaagucaugagggcugaguagcuugaagagagaccacagggaaggcaggcgcagagcuggggacugugagagccggggccuugagaggacacagacaugcauguuaggacagaccugcuuuucuggaaagcucccugaggggagacuguggcagcuuugggaggugcuagaauuggcugcccuucugccaaacaggcaagugagucggaggccacgcuaggcggccccuccacucacagggaccuggagacacacgguaggggguggggggcgcaggggaggcucagugcugcaggagggaggaagaggagagggucuugccuuggcacugcucucccgaugugugugacaccacugccucaaguggcugcaaguucucagcucucacugugccugaggaucccccagugaaguggccuaaaaauggaaacacccagucugcuuucugagauccuggggcagucgguggaacgcaugcccuggagcccuggggagucaggugcgggcccccgagcacaccccacagcucccucccagagcaugaugggggugucccugcacucuggaggucccugcacagcucucacuuugacacacuucccgugcugguacauguuuguaaaacuuucuaguuccaauauaauugugaaaaauacccuuugauuauuaaaaaaaauuuuccuggauucauuuugaaaaugauucucuucuuuuuuuuguuuuauaggauacaaaauuauggauaauaauggaauaucuugguggaggcuccgcacuagaucuaguaaguauuauguuggaugcagaauacguaucaaagcuuuuucucaggaaaccuggguuuuaaagaauccauugcauguauccauuucuuuuucuuucuuucaaguugcauuaaaaaaggaaccaaacuauuccuuacguguuuuuuugcuucuuauauaucacuaaaaauuauugguuuaccuuuuuuuuuuuuuuugagauagagucuugcccuguuacccaggcugaagugcaguggcgcaaucucagcucacugcuaccucuacuuccuggguacaagcgauuuuugugccucagccuuccaaguaacugggacuacaggugcaugccaccacaccuggccaauuuugugguuguuguuguuguuguuguuuuuggguagaaauaggguuuugccauguuggccaagcuggucucaaacuccugaccucgagugauccccgcucucagccucccaaagugcugggauuauaggccaggugcgguggcucaugccugucugucugcuuuugaaaccagcuguuuuguuucaugggaaaccaauaaauguauucauagaaggaagcaaggaaggaucaugccuggaauuaucucaacugagaacagcuggguagcuuauuuucugaaacagguucuauuuacuuuuguagggcuguuaucucaucguuucauauuucacaugacaacuuaguuuccaaaauaagcauguaauauuguaauuuuggaaguaaggggcagggugugauuaugaaggucggaugucggaugugggagcaguggucaugccuaaggggaacacacacuucccugcuugccagcgcucccaggguguggagguggggcuggcccgcaccagaugucuccucugaacucucccucaagugccuucuguggccuccaguccacauguaagguaguggaagccagguggaggguggcuguaccguccuggucugugauuugcuuguguaaaacauggcuuccuauuggguuuugaugcagugcuuacagauaaccagcauaugucaugagcacagcugaagucauccuugaaacauaguaaaugcaaacgaauucgugcagcuguuuagcacuugcugucucauccccgcuguggcugugcagcgaagucacugugaucacucuuuccccaccccuucuguaagugcaggucauuuaggugaguggugauuuucaagauaggccagaucugucauugcaguguuagagguuggguccuggaugauaggcggccaucaggaugacagggcugugguugcagggagagcugaaguuagcuguguuacuuuagcauagucuacacggguauuacucauuaaggaaaggaaaccccuuugagaggaaacuucuuaggccugguacagugguucacgcuuacagucuguucacuuuugggagacugaagugggaggaucacuugagcccagaaguucaggacuggccugggccacauagcaaaauccuaucucuguaaaaaauuuaauucuagaauaaaaugaaacuuuuuucucacaguaauaauagcaauugauaguuuguuuugggaagauaaacuucugaaacuauauguaucugcagaaggcuaacguacccaauuuacauaaucaaauauuauuauaaaccauaaaaauaauugauaaaaaugguauuaaaaagggagauuucaagaaaaauuaauaugguauaaaauuauauuaaaaagggaaaaacagcaauguagugggauuacuuuuacaacuuauuuugguuccuuuccauaaauguacacauaaagagcuuuucauuuuuucacccuguugggaaauacuacagaaauguagaaaauuaccucauuuuauguaauuagauuuacuauuaucuaagugaauuucauuuguagcauauacgaaguuguuuacagggauucuuuuuccaacauuaaguccuucagaagagcaauuccaggaaugcuuuagcguguucauauuuaaugauauaauaauuuauuuggugauaaccuucagauuucuuugaauugcagucugugaaauuuuagauauuacaguuggaaggaaggguaaaacucuccacuuaaaaaaucccacauagugugagacuuccagcaaacuguuuuucacuucugcuuaaggagugcuggugacaagggacagacauuccuuuuugaaugccccuaaucgucucauuuaauuggugcaggaauggagacccucacgggugaggggucucagcuaggagaccuucaggguugaagggucccagcuagcagauagggcugggccuugacccuugcucugccagcucagagccuguggccucccuugaccccgcaguguccucuaccaaccucugauguuguugucuuucuccaucuuuacccuuuucuguuggccugcucucagccccucaaagaggccacacuuucuugggaagggguguuuuggagguaggcugggagcuguugcagucuuugcuucuuucccacauccacagcaccgggcccccucgaggugcaagggucucccggagcugaggggaacuggaaguccaucuggaaauuuacagaugccuggggcacccuagagaggggaagugacuuugccccaaguuaaaaauuggguggcagacaacauggcauauacauaaaucucgggccccacguaucagagcgaaggacgaagcagagaggcuuuaggacuugaaggcugggaugagcccaggucugcuguugggcaugggcaucccucagcuggcaggggugcaucccuuagcagccaccuuuuccgcucuccaggugcuuuuuaacuuuuaaaaaaugcaaauuugggauuucagguggagacuagagacaguauuauuaagagccaugaauauaaaauagaaaauagguacacauuuuauuuugaaugcacauauuugagugugugcucaguccguugauuuaaaaaaauuuaaaauaaaaugguaaauggaaauuaagugucuauaugaucccaaggccgcugggcucuuggaauauagcuugaaaacuacucaagucagucaucucucaaguuccagccgccuugccuguagggugcccugacuuagaagagcauaagaaguaucacacaguccaagacacccuaacuuaaaugcagucugucuuuguagcccggggagggaaaccauuuuucauucagcauagaguugugugccucccgcgugucaggggcugcucuggccauuggggauuauugccguuggacacagcagcggaaaguccugcucuuggggaguucugguggggaggucugucaauuacaccguuuguuagaagguuccuuccuuacaaggaaaacaaugcaggcgagggaggugaaugggggagcuggagugaggaugagccacagagggccugagaccagaagguuuuagcugauuaaaagaucagccaguguugccagagaauccgagggacaaccuuggaaucuaauuacaaagggacaaugcuacauaaaccagucacuuaaucaggcagagauguuugacggacuuaaaaaaugaguacacgacauggguuuuaagaaaugagauggcauauucauuaauguuuaggccaaguugccaucauagcagcucuaaaacagugucucacaaaagauagaaauuuauuucucccccugcacauggggucaguggcucugguccauaccgucacggucugugcugguggguggcuucagcaucuggagccccaggcuucccuuggucuucagccauuguccucucccacugccagugcuucagggccaagaccaagcaggggcauggggcacauuugcuccugucugacccacuggcgaggucuuagucaccugaccacaggcugcugcucagagucugggaaaugugguuucuuguuguggcugagugccccggccaauagucccuguuacagagcuucgaagcaggggaggacaggcucggggagggggaguuagaagucacacagaggugggauguggucuagguuuuuuuccuggguccuauuugaagagucugcaagugccugaaugauggagagcauggucgcaauggcgaacaccagcugcugacuuggagagcuuggccugguccgagcugcucaugaggcacucugggggguagacagcagccgaauacccuuuauagugaauuuugacgcagaaaggauuuccccccaaguaaggagaguuuuaucucuuuuucuccccuuccuccucguuccccaugggcauauaagucaaugauggaugguguucagggcagauuuaaaagggcagaaccaugcagacagucaucacagagccagcccuuaauuauccaggggaggauuuuccaugaguguuccucaccucuuccucuuagcgcccuuugggaaugacagcaggccgcucugccguugcuuuugggagacuugguaauggaagggaggugguuaaguccagaucuaaccacagguauugaucgucggcuugggcacagacuuggugaaggaggagaugggagaugggacccgacucuaaugugacuuuuuuuuuuuuuuuuugagacggaaucuugcucugucacccaggcuggagugcaauggugcgaucuuggcucauugcaaccucugccuccuggguucaagcgauucuccugccucagccucccaaguagcugggauuacaagcaugugccaucaugcccggcuaauuuuucuguguuuuuaguagagaugggguuucaccauguuggccaggcuggucucgaacucccgaccucaaggugauccacccgccucggccucccaaagugcugggauuacaggcaugagccaccgcgccuggccucuaacaugacuuugaucuuuggucgacuggauucuccugcacuccagcauuaugaacaaaagcaaacacuccggcaucucuauccuccuccccacuguccacccaggugaugagaaaagucuguguuccucauuuugaaaauuaaaauuucuacauucuaugaacacugaaaaauagauguggagaaagcugacuuaaggcauaguuuuccugauuguguucuuuagaauaguaguuuugauaugcauuucuuauaaauaagacuuuuguucagguaacugggaaaaaacuacuuucuggggaacagagucuguggcguaaugccuuagucugagguaacuuuuggacaauaucuuaauuggaauuugggacaauuucuggcaggcgauggagaugggcauuuugaccuucucugagcauaugugugcggucaaacuaaaagcgacaagugcauucucugcaccuggguccuggguggagaaggccagggguggcuggauuccaggugugucugcugccaggcaggccagagucccagcgaggccagugugugaggagaggccaccucugagaguggcccugacccugggauugcuguguagaccagggcaggccugcgagccaaggcagcacagcucacccaugggccggaaagcagggccagguaugagucaggcugugguuucggugacaagggcugucucgguugcccccacacugcaccccacaaguacuuccggauguggaacaggaugugaaggagcugaggcacgcaaggacugucgggcucugucccagagaugugcacgccugagucggaugcuuccuguggaggagcgcccuaguuuucauccccuuuggcuuaaagcacauuucuuaucuuuuuaaaacuaagugaaaggccccagauuguaucuuccuguuggcuaaaaugugugggugugggcugugaagacauucacugucaagucugaaaaccaagaaugggggaccaugauuugggggaacccuaccugcaucgauuagacaucugcccucugucuggcuccguuucugugguuccggggagcacugguggcuuugcugcugucaucuguggaauuacuguuugugacugacugccccacucugcagggggcgggggggggcuucccgucugguuugaagugagccuuuguuagccugguuuuccuuuccuuuuaaauggagauguggauaccugacauuucuuccuuucaucugauauaguuguggauauaaaggagucaauaggaacaauuauuuugaguuucugagaauaaaagcuuucagagguaauuauuaucuuagggauaauauaauaguuauuauuauuauauaauaucuauuauauaacaaaucccaaacuauuaggauuuaagcucuuucagcugcauucccccaaguuggggagcuuuaacugcagauuuaaaaaauucuaauacaaggauauccucagaggcgccuggcuccuaggccuucuuuccuggguguuuuuggguaccaggggugagccuucugguaagggaaccacauauguuaggacagauccuggcugcucugucucuuggcuguucguuuccuggagugaaauccccagccuguaccccgccccugccauggccagaggggcacccugaggucagcugcaggcgcaggccgggucgugggcuuccucauuggcucagccugcgccccgccccugccauggccagggggucgcccuguggucagcugcaggcgcaggcggggcugcgggcuuccucauuggcuccucuuugcuucucugcuggcuuggcuucauugagcaaagccauuuucucgggcccuuuguuuuuuuaagggucccucaguggacuguaauuguuagggcaaaaucauguguuuuaagugaagaagauuucagguuuuaauuacccuuguccauuaacauggauaguguuucuguuuuaucucaaacuuuucauaagauaaucauuuaaguaacuuuaagaauuuuuuucucuucuuaguuagaaccuggcccauuagaugaaacccagaucgcuacuauauuaagagaaauacugaaaggacucgauuaucuccauucggagaagaaaauccacagagacauuaaagguaagaggacauccguuuucauuccuuugaaauacugaaggugguggugggguugcccugaagacuucucaagggaaggugcuggcgcccauuuguccugcacguuugccuugccugggcugggcuggcuuugagggggucugacaaaaaguguagccccggugccugugcucgguggguucgccacccagccagggagaagacgcgcuuguggcagugcacggaguuguaaguccgcaccgcccagggccgccuuggcuuucuuuugcagcggccaacguccugcugucugagcauggcgaggugaagcuggcggacuuuggcguggcuggccagcugacagacacccagaucaaaaggaacaccuucgugggcaccccauucuggauggcacccgaggucaucaaacagucggccuaugacucgaaggugaggggagggugagggcggcgccgugccucacgaggccuggagggcucccgccuuuuguucuuuagccugguagcuuuucuaaguuggaacgaagcugguaccuugagguaggucauaaagguaauucuucaaccuugguuaugaacaguuuucuccucugucuccugcuguaucauuuaauacccugugcugauccagcccaccaugaucgagguuuuuaacucaggcuauguuuguuugguggcagcggggacacaggauggagcggguuuggaggggggugggaggaacugaagggccaugguggugagggguggaggcgugugcgguugcagaggggcuccaccugcugucugggcacagcugggggucgaagugcaagugcguggaaucggcaaccuugaaggggccuguagagaaaggggcucccacaagagaaagggaguccacggaagcgugagaauggaggaagaacagugcuuugagugacugcugcagggucuuccuauuauuuuuaguucugaggauucucguucccagccuguccuugucaacaugugaugaaacccuaacccuuucuucccacuguuuuuuacuuguccuguguuagggacacucuccuaauuuuucucauauucuuuuucucuguugcccuccacuuuugugaacucuguuagaugggacaaaaaaucccgggacuuugccuccuagggcucugguuuaacuucaguucgcacagucugcucuucuuaggacccuguacacaguuaaaaggccacaugauccacggagaauuggcuuuccugggcuccaaguuucugagcaaacaaauaccuaacucagauaugcauauaggccgaaccuugcugcugcuuuuaaacagaaaucuucccaguacccaguaaacuucccaccuuguuaaacauaguacaggaagcaccaggugacuuucccugcagacccaggucaccguugcaagcuauagacuguuagaaagcguccagguuguagcucaaguugcaggcguaccugguuccaccuugggaggagugagcccgucucacuguugagugguagcgguggcugugacuuuucugagcacuaugauggccuugacagccucuggcuggugagugacugauggguucccccaccccccacauacccacacagcagaccuggcuggucuugggugugugcccuugccugggagugucucuaccccacgugggagggacacugccuuggcugcuucucaucugcagucacuuuggcuguugacccuuuuccuggggucauguaauuuugggacucgaccaggaacuuacauguuuaguccauucucuuuauuuuaagcugaccccauuuaucaaaguucaucuguguagauuuuggcaaggcugagacuagaacccauguuucuuaacucauuggaugacaccaccucgauuauucucuucucauucuuuguaguaaauuagcugaucuaccaugugacugaggacucugauuuuagauuucccucucucccuccuuccuuuccccuuuccuuccuccccuuccuucucucuuucucucucuuucauuauuguauuuauuucauauugauucuuucauuuaacccauucuguguaggcacauuuuucuggauuccaguaauacuggaguagacaagaacaaaagucucuucuccuguaugucuuaaauucauaugggggagacugacaguaaacaggaagaauuaacagcacuuuaggagcaagcgugcuguguuguagucaccauuuucagugaguuaccugccuuaggugacaaauaucccuagagaguggcggggcagaaggcaugggcaccucagugugcggccauuucaggguugggcccuggcaggauggcguucuaguugagaugcaagcugagagagguuuaaaagaguuuugaaagcaucagugcacagcuuuaauugguguuuugaaagaaaacuccagaauaaauagaagaauguuuaaagauuuaaaacuuacccaaggucaagaaugaugugaacccauaagucaaagagguugccugguaccaagcaaaaugaaugaauagagaugauuacauaugucagaaccuuuuccagaggaaaaaaguuguauuacaaacuuauuaaaaaauuaagugccuucaaaggaagaaaaucaagcuggugccauucauucacaaauuuguacugagcaacugcacugugaauacaacugugaucacgacagcacacucccuccucuccugaaguagaagaaacaauaaauaagcaguuucagaucaugcaaagugccguggaaaaaaggagacagggccaugugaagaucuuccgcucuugguugcaccaucacugcucacaugagaaccuuuauucgagagcuguccugucugccugagccauccgcacccaccuuccuugaagggcaaguccucccuucagaguuccaguuccaacucugaacuggaaaucaugagcaaacucuuauguugaugugaaauugacuuuccagguuuguggacccgggaggcguguggugagggccgaugagggucacgucugugucugcgucucaaaguucucagaagugggguuucacgcuggggccuuagggcugagauuuccuuuguuucccacugggcguggcucuggacuggcagcucuugucgcaagcagggccugauaagggcgcucuuccuggcugcccugugugugucccuccaguggcuggcuugccugccaggcagccagugcucuucaggguacacuggaggccgcucuggucucauggcucacucagcugcuucccagcuuucccuccauucucucuugcaugacuuguagacauuuccccuccuagucugugcacugcagguaaggaaagaccuuccagcuauuggggacaggguucuguaugguaguuaugaaggcacgugcccaagucacaccuagguucacacgcagauugucaaaggaaggguggguugggagaagugauggacuucaccugccucacuagcuucuucaucucacugaacuaaagggaauacaaaccuccauuuccuguauauguuuggaaccuuuuugagcauugucaccucuggcaguagcugugcccccuuaucuugucugggcugcucagguguugcugaaugucuuugcauacaaagagaaucuuaugucagucuuaaccuaagcaugacauuacuaaguccugauugcccauaugucguaagaaccuucacuacuacuguuuuaaggugauuuggggaaguuugguuuguuugaaggaguccccauccuuuggagauggugcuaagggagauaccucugcucacugcgaagaagccuccgguuucaacacuagagaaaggucuugggcugaagaacucucaucucccuuuuuccuuguaagaucauuacgaugguauguuagcgaauggauugugcuugguuugaaguguaaccauggugaaaaguggaaacuggugaugcauugauggaaaaaaauagcauuguugaagaugagugaaagcguggugggaugagccgaugggcugccagaacccaggcagccagccugucuacugcacugcguaccagcccuuccugucacuggucacugagcccauggacucccugcuccugccuacggcucaggaauuguccacaggccuggcugggaggaugagcccugagggccagggaagaaugugaaccaggagacagcaggcuuuauuuuugcaugaguaauguugggccacuuuggucaaccuuguguugcucuuaauggucauaaacaucacauacgccucuagaugccaguuacaaguguguuccuaaugaucgcaucugcuuaaguaauaagcuuauaucaaaugagauuuuguuuugauugauuacagcugugauuuaggguuaucccugguuuucuucuugauuauagaguugguuucuucuagaauuauuuucucuauauaauuaaaaucacuuaaauuguaucuucagauguguagcuagcguacuuuauuugacaugauauugugaagauguaggaugcuguugcauagauccccacaucucccaauguugaggagaguccagaaccaucaguaacagagaacucaggguggucacucaggagcaugccccaggagaagauucguucgcaguuaaugugugcauuugcagcuuuugacuggagcuuauauuagaaaccacuguuuguuuucucugugagcagugucuuaaugucuaauuucauaucuuucccaaaugggucucuccuuccaccucauuuuaauugcuuuggaagaugacugccugcuccccacauaaaguuuacuuuaaaacucagacauaggccaggcacaguggcucacgccuauaaucccagcacuuugggagucccuggcgggaggacagcuugaggccaggaguucaagaccaaccugggcaacaaagcaagacccccccuugcccccccgacucccaccucuacaaagaauuuaaaaauuagcugggcauggugauaugcccuauagucccagcuauccaggaggcugaggugggaggauggcuugaaccugggugacagagugaguccccucccugccaaaagacacaaaaaaaccucagacacaaguucuugaucugcugucauuuuuccuagaagcaguaauagacaaacucaauuauauuuaugaguuucccuaucaacacauuguugaguacauccuacuucauuaaguuaaugugccauagcaacuuaaucauucuucugagguugaacauaaguaaugcugcuguugaauauuuugggcagcccauaccauuuuccaaauuuaaaauguaguagagaugccuaggaaucgaaguaauugguuuuaacaaguuuggauauuuuuguggcuuucgauuuguaugccaaauugcuugccauugauucacaugccaguccaggauuccaaauuacucauaguuagaugucuggugggagagccagcaggcaggaagaccacuugggagcccccuacagaaguccuggggagaagagaucccuuuagacuaauccaaaguuaggagggguagaggggacgcagggugcugagagcccaggaaccauacacccuggguugcagcuggauuuaggaggguccaaagaggggauccuaaggagcugggugacccucgugucccuggcauggcuaccuaguaggauguccuccccccgccgccuuuuuuuuuuggggggggggaugcagggucuugcucugucacccagacuuaugaucucgcucacugcaacuucuuccucccagguucaaaugauucuccugccucagccucccaaguagcuggaacuacaggugcagcccaccaugcccggcugauuuuuguauuuuuaguagagaugggguuucgccauguuggccgggcuggucucgaacuccuggcuucaagugaucugccugcgucggccucccaaaguggugggauuacaggcgugagccaccgcgccuggcccccauguuuguucuugauggugcuguacuggcugcccuccuuggaagccaggagacugauacguggguugcguucagauggggccagcagggguuuucucagugaacuucccguggugcacacugcgugcagaagcaggcguucgcaagcaggcguucggccgccugcuuauuaucugucccugaaccugaaagcaaguccucgggccucugaguaaaaucaaggcaagcgcaucaccgacguacucucagcagagaucggcuucugccagggccugccugccagucaccgaguguguuuagcugguugagaggugcuuggaggucuggaggugcauccgucagagaucauguucaguagcacaauagggugaccguaguuaauaauuuguuguguuucaaauagccagaagagaagauuuggaauaucccagcacaaaggaaugagccguguuugaggugagggggaucccagcuacccggauuugauuguuacacacuguauacuuguaccagaaaaaauucauauaacuauuauguacccuuacaaaugagaaggcucugggucuguguggccaggagacagcaugcuuugaaaacagcaguagcuguaaugaaaucugagaggccugggggaagcagacagauguggaaucacacaaacuugagagccaccuguugguguggagaaccgcugccacacaagagucacaauugccaccucuguucuugccucuccccuccucgguccucccuccuugugccugcucacuccuguccuccugucgcugccacaguucugggugcuugcccacccugugcucccaugcaccugcuucccugcuccuaggggcaagagacugggaucaguugcauuucugcugauuuuuaagauaaugcaaugcaagauaaagcagaguccaaguuguagagggaaggaaaauaguauuacuuccaacgucagcucuucuagacugaccccuucaguacaagauuuaguagaaagaauuuagaacaagacuugcuggcagcuuuucaucuucacugagaauaaggaaauagaauaugccguaggcaucauucccauggacugcugggcuugggggcuuccaguagggauuucugguacucacuaaggcugcaggaacaugguaaguguauccucuggauaguuaaagcacccugcagccacaacgaugcuuccgccuaugcauuuccuugcuguagagugagugugagagauguauucgauucucacugaaguucuuggaauaaugauggauuccagugcacagugagaacagcaggaaagcuguaccagacucaggcguguucucuaccccaguccccauucgucuuucgccagcccauauaggacuauguccugccucauugucggccucuguccuguuuggggauuggugucacaugcugucaaugucucaucagcugucaaguuccucuuaggauggccuggcucuucucauugacaugacacauucaaggaauucauuccuuugccuaacugcuugguugugccacaggccugugcugggcagaaggagguggggcagcuggaccugagauguccuaguggggccacacggcuucugcagaugucuccucugggacauucggcagaaaaugcagacacuagagagacacaguaaaugacaucagcaagaaaccaccagacaaaucccgaauuugggaccuguuucuuuaaguugaugucccuggggagacuggggacaggacuguuguagguugaaagagccuuagcgaccuggcagucaguuguaccccguggacuuuggauccugauucagauaaaccaaccauggaaugacaguuuuugaacagcugagaacauuuaauuauacaugacauuaaggaauucguguuaauuucaggcacugauagguaguaaaaagucuguauauuggcacacggaaauacucgggggaaaaugucaugaugacugauugauuuuaaaauauacucggggaacacauggacaaagcucguauggcaaaauguuaauuaguaaauucaugcaauagguagaugaggaugcauuauauuaauauuucucaguucuuuguauguuugaacauuuucauaauaaacuuuuuuaaguucugggccccugguaaggcaccuuacauggccaccuccuccucuuccaccuccauucuacagaugagagaaacagggcucagagguuagcucuuucaucuaacgucacaggacuuugacuguagaacuggcauuucaacccagguaucuugagaccaaggugcccacucucgaccucagagcugugcccuaaguucuaagcacugcuggagggggugacucgcgagcguacacccacuccggacuccuccucucugcucaccucucuuacugguccugcuggcccccgggacuccacggggaaugccgaaugcauccagcaggaggcguaguaggagugaauugauaagccaucuccauguagaggcagaaaacauuuggcauauuacaguuucuccuguugucucuuuugaaauuacagcgagggcuuauguuuuuaaauaucaguuaaaaauaccuuuuucaaaaccucagaaguauugagacauguuaccauuuucccccuaaauacuguguauuggaauagauuccugcuugguguuuguaaagaugcuuuucuuguugcaggcagacaucuggucccugggcauaacagcuauugaacuugcaagaggggaaccaccucauuccgagcugcaccccaugaaaguuuuauuccucauuccaaagaacaacccaccgacguuggaaggaaacuacaguaaaccccucaaggaguuuguggaggccuguuugaauaaggagccgagcuuuguaaguuucccagggaucacagcguaccucuucaugugcggcuugacuugguugagauacauccuguugggauugcuuuaaucacucuuuucagcugucuuccugguauuauucauuuuucuuuuucuaaguaaguaugauugacuucuuugguuugcaaauacauuuuaauuuuuaaguauuaaaaaucuccuuauuuucuuuuagauuucugccaucucauacuucauugaaucugaagaauauucuccuuaauauuaaauguggaaucauaaauguuuaauauuuauagaagaucaggccauaaacuguuacacuguuuuuaauaauggcaaagguuagcuggaaacaaauggcuaaauaugucuuuaaaguaaauguuuucacuuuccagguggcauguguuaggaaacaaaagauuagaaaauauaaccaagccacccucugugcuucuuccccuccccuuccugccuacuuucucuuuuuagguuuaauagacucuggcagagccauacagcaguaacgacuguguggcuuugccucauuuucugucugaauuaggacauuucuuugaaaguaguguguguguguugguguuggagguagcaccauauguccuuguuuuguuucugaguuuuccagcagaguuagcugaaggcuaagcugagccccccuuuucuuaacucuuauguaaaaaugggugguuacuuuuacaagagcaccaugguuuccuaauaugccaguucugguaaaggaauuaaauggguaaugcaacauuuucuaaguacgucuaaggagaugcaggcugagaccaccacaccaguguuugaugacuacaucagcaucggguggugguggggcuuguccugcaugccacgaugcucugcauuuuauuacacgaugauguuucuugcagccaucaugcaccagcaccaguggagaugugugcaggcaugucuucccauacaaagcauguguccuguaugggcuuaugccccagcacacagagcuccaccccacagcuaccgaggagcuggcugagaggcgagaauaugagcaccuccgggguaguugggguuucacccuuggauggacagggagggagaauacuugaggugauccacguuucucaugaguuugaaucugaaaacaugcuuggcucuuguaaucaagcuuuuguaauuuggagugagugggaacuugguucgacucgguguuuggguguuccugcugucuguucccauuugggccaugcugguuuccuugggaagcacauucccugucacuaucgccauccucaaggcaggcagcugaccaggugcugcuugcgguggccaugcugagcccagggcaugggugaaguccucagcccaaucacaagggaagggagggagggaccugggaaauagcccuucuaaaccgggaaaguugguggugaagcgcauccaguugcucuuucagcagacaggaaaaaggggaucuccuggcuccuuuccaguuucucugagauaauuccaaauugacauuucuauuauaugguuggauguggccaaacguuaauacagaaaguuaacaaagcagcccagcaugguggcucacaucuguaaucccagcacuuugggaggccgaggcaggugcaucaccugaggucaggaguucaagaccagccuggcuaacauggugaaaucccguuucuacuaaaaauacaaaaaauuagccuggugugguggugcaggccuguaaucccagcuacccaggaggcugaggcaggagaaucguuugaacuggggaggcgagguuguagugagccgaaaucgugccacugcacuccagccugggcaacaagagcaaaacugucucaaaaaaaaaaaaaaaaaaaaguuaaacaacacagaacauauauuuugucagcauuugucauaaaguauuuuauaaacuaggagauaagcuuuuuuuugagacagagucuugcucugucgcccaggcuggagugcaguggcgcgaucucggcucccugcaagcuccgccuccuggguucacgccauucuccugccucagccuccugaguagcugggacuacaggcgcccaccaccacgcccggcuaaauuuuuuuguauuuuuaguaaagacgggguuucaccauguuagccaggguggucucgaucuccugaccucgugaucugcccgccucggccuccgaaagugcugggauuacaggcgugagccacugcgcccgaccagaucauuuaagcucucuuaaaugaucccugugaagcucugugcagaguuuucugugaaaauguauuuauuagggacauccuuggaaagacagugcccugcccaccauagcacccagagcccaggcguagguccugagcgacucgucuuugggugaguugcagugagaagcgcuguggaguagagaguccagccaucaggugucaguguggcgguugacauuuugaggcagaagucuguccuuugggguaggaccaagaacuucaucucauacuuuaauuguuggguguguuuuuccagagacccacugcuaaggaguuauugaagcacaaguuuauacuacgcaaugcaaagaaaacuuccuacuugaccgagcucaucgacagguacaagagauggaaggccgagcagagccaugacgacucgagcuccgaggauuccgacgcguaagucggccccugagugacccaagcaugugugugggagggauccgcuggucuuugucacuguuugguguggguuucguuuucuguugaguuuuuuuuuuuuuuuagacaauccagguugguggcaauuguuguguuagacacagccugggccuguuugggaguuguuuagccucuugacguugcugguggaguuucugcgagugaacucuugugguagagcugugcauggggaacuggaccuggcuguuucauucuguuuuguuucguucuguucuguucuguuuuccauuaaacuuccuguuuguaaaacccugaucaggugaaacugcuuuacauggaugucugaaaggccagaaaugcauguguuugugauucuguauugugucugguagaagcuucuguaccaggaguggcuuacugagaauugcugucaaguuuggcaucuaggaauucccuuggcuuaagaggcggaguggggcuggagccauuuguguggggagggcugggggagguggucgggcagacuugugucuggaaguccgagcgugggacucgucuguucucgugcaugccuuggcagaaguuaaaguuggcccacagugcagguccaugugccaggccaguugaaugaggauuuccggggaugagacccuaagugguuuuucagggucucuaggugauuccaguuuaaagccaagguugagaccacugcccccggaaguucuugagguacugccauugggagauugcugggguagcaacagggaugacaagagaaagagacuggagagagguuuggagagccaggacgcggcgguggauuugggugaaggagggaagccaauguuccaggcuggggcagcguggcaccagguguugugauguguggugcgggaagccgaguguggggugaaccgugugugagucugaguuguccaggagagacguccagugugaaguggcaccgagguguggaguucaggugagaaagcugggcaggugaagcgggcuuaggggccacugcucuguggaggucacuugagccgagagaaaaaagggugucaguuggggcaugugggggagugaggcuggccccuaggugugagggugaggcuccgccugugagugagaggggagagguauggccgaggggcgggaggaggugcaggcuuaauggggccacaggcaucaggggaugaucagcagggccuggggcucauugccucugaggcccauacaggacagggagugaucagcacaccaucaucucaugaugggggagggagcgcucggagggacacgggugggcuuuggagcgaguggaggguaccaaauagaggcagugagugugaaucccagaaccagggcugagagauggccaaggugaggccaaaguguuggaaugacaggcaugagccaccacacccaacacagggacaucugcuucccuggugagaggaggagcccagcagagagaagcugaugucccagagaugggcucccagggaggugggggagguguucuccgggaggaggaggagggugggcaugcacacacuggcacgccagggaguuguggaaccaccucccgauggucucuucucugugagggaggaggcgggggggucuuugggaaaucccagagggacuggacaagggugugauggguggggacuuggggcugguggguguggguuuagagguccccaggcggccucccccugaacgucccagcgcccccagagcaggugugcgagcacugaugggauuuccugcauuucuguguuaagggaaacagauggccaagccucggggggcagugauucuggggacuggaucuucacaauccgagaaaaagaucccaagaaucucgagaauggagcucuucagccaucggacuuggacagaaauaagguacgucugcucacuccagaauggccacgcugaccucagucugcaguguuuuggaggcacuugugugugaagcuugcugugggugcggcugggguccuuuguggcagcuguccuggaauuuuguugcuaggggaugggcagaugaagagcuuuaguucugucugaugauccagguguucacaccagggagucuggccucuggucuguuuugugccacucuauucugcucucugcagcccugcuguugaguuaggaugucccgauguggcaaugucaugggguuugggggugacccgugaaaugacuucauagcucugagggacuguugugcauguugcgguuacuuacauacauaucauaauuuugugacugaguuuuaaggaccuuauaaguaaaugcauugcuuuugauauuuauguaaaacaauuuugauuaauugguuuuaugccuguuaaauuuaugaaaggccauauauuuagggucuuguaaagcauagugguguaguuucuuucaggcagggugggccaguggcuguccccuguugauccuacaagucccgcuuugauaagugaacagguguuaaauguccaaauagagguugcaaaaguagaaacucggucucuguccuagacagccauuggaauggccaaucuugaccugauuucuauuuccaggguuucauuaguaaaguacuuuucucucucucucucucucucucuuuuuuuuuuuugagacggggucucuguugcccaggcuggagugcaguggugccaucagagcucacuguagccucaaacuccugggcucaagugauccucccaccucagccuccugaguaacugggauugcaggcaugugacaucacgcccaguuuauuuaaaacuuuuuuuuuuuuuaauagaaacauggucucacuauguugcccaagcuggucucgaacucuugggcucaagugauccuccugcuucggcuucccaaaguguuggaaugacaggcaugagccaccacgcccaaccaguaaagcacuucugcguagauagcaagacgaggcaguucaccgccugugcccacacagaguccccuuccacauggaacccagaugcugguuuccccggugcguggguuuugcaugucacugcagaugaaacuuugaagucuagugagaggcagccgauagucuccuucagauguuauggugcgcagaggguguuuccucagcgugaaguguagaggcaacuccugcgcuuccauaguccaggugggagguuuauuaaauuauugccaaugugaacgucaacuguuucugaugaccuuuuuuucccucucccccaagaugaaagacaucccgaagaggccuuucucucaguguuuaucuacaauuauuucuccucuguuugcagagguagguaccuggcuggccuuuucggagugggaggggagggggaaggagaagcuggacacacuucaguggugauguugccaguuaagaguuggggacauuaagacaagcuggcaaaggcucggaaagccugcauggugccuucccaaaggcugucagcaccaccuugcgccuccccuguccugggugaugcccacuccgccgcagccuggaauguguagacuggaugacagugacccagcccgagacccugugucacccguugcccugcuuuuuagcaaaucucauuguguacagccugcucucuuugccucagaccaauuucuggccaugugaaaaguagauucuuucuucuaaggagacguuggaugcccuggaguccuccgguuuccccugagccacauguuucacugaagucccuccucugcucagcagugcugugcucccagcugggccuccccacgcccacucccugcucagccucucccucccagaggaaagugcucccguggccguguuuugagagauuuucaaaaguaggcuuuauaagaaugaagauuguucugcaucugguuaguagcggauuugaaaauaaguuggaaguccccucuuuucuuguugugccccuuccuggcugaggcugccuuugagguacucacugugggccacacacgcaucuguuugcguggggaucuucccucuuugggcaguuuuccacugcggcuguguuuagggguccugguccuugaaggggaggugcucaggagaggaagugucauaggagcucauucuccuccccugugccugcgucacgcagcgggggacccccggccaugggccgugccuggccagccacgguccugccagugccucuucccagcccuccaauaagccuucaccuguugcccugcccagcaggugcccuggaggguuugucugagggccucugaccuggcaaguucagggcccggugggagcagggcuguggccagagcccgaggccucaccugcagcuucaagugggaaguagccgagcccgcuggugucggggaagccacagggcacgcggaggcccugcuggaugaugucuggcuucagcccuggcucaugguucugggcaccuguguucuuccuaacuaggauguccggguugagcgccauccugcgcuucauuuugucccaugggaguuggccccgugggauuuccaggcugugcuccugcggcccugccauuggccgcuggaauagggucagucaggcaguuagggaaagugcauggacuuuuucauucuccugaggcuguuuauuuuuuuacugggcccaugaagcaacuuugacauaauuauucaggacauauccuaaacgccgucauauccuggauuuuccagguaaccaauugcuaaacucacaggcaucuuucccaauguauuuuuaagaaugauauuugcuacccuagaguucagaguguuuauuguguauuauuucauacaauacuuguagaagcccaguagaaggauuauauccccaugcuuacagaugaggacauugaggagacggguguuggcgucccugcuuuccuucagggagcacaggucagguugcucccugaagucagugauggguccagcacguuccacacggcaaggggacaggcccucucccagggcggcccuucugccgccuuugcuccuucuuugagacuuaggggcggggcaugggcaggagggagagugcuggauuguagcugacccucucgggacuuguaaauacugucaagugauugggaguccuagacaaacacgaguggccgccucggggccggcggcguggcccugugacagcaagaacuucaggaacaaaugcucucuacacccacuggcccuccaaggucagacccuucuaguuccugccugccccuucaguagcgaagagagaagccguugcucuuagggcagggcuggguuuggaaaugacagcauguguucaacaaccugaaaaccaagcugaaugucgccugagauguuucuuucuucccugaagaggaggcgguguccaucacaaagagccucuucuguugaguucugagccaugcuguaucuugacuugaacagcucuuauuuucacaguucacguuuuugggccuccagagagagacuuggaguugaccuucaacugagggaagugucugaaggcacuguugugauuucucuugggaguagaggugccaggaagaacacuggagauucccagaauuuaaggcugccacuuauuuacaugaaaucaaauauuuugacucuacucuggaucacaaaggcaguuugcuggaguuuaagaaccaacccauuaacauuaggaaguaagcaguguugagaucagaauaacuuaggauaggcuuugaaauugcuuuucugguacaagguuaugguugaaauaggaaaacagcacagagaggacaguccaucacggugagacuugggaaaggcacacagagagcuagucgucucuguucuggccucgaacaguaaugauuauggucugaugauugcccuguguauacauaacugcucucagagcauuugaaucaccuuucuucaaaaggaacccgggccgggcacaguggcucacgccuguaaucccaacacuuugagaggccgaggcgggcggaucacuugaggucaggaguucaagaccagccuggccaacauggugaaauccugucucuauuaaaaauacaaaaacuagcugggcauggaggcaggggccuguaaucccagcuacucgggaggcugaggcaggagaaucgcuggaacccaggaggcggagguugcagugagcugagaucacgccacuguacuccagccugagcaacaaagccagacuccgucucacaaaaaaaaaaaaaaaaaaaagcaauuugaaguggccuggagcccuagccaaagcuuuucccggacacccuggggcugggguagugucgugguccacacgccguguuguuccuugaacagcaugcuucccaguuuugcagcuggugugcuucaugccauucuuccuguucguguguuuucaguugaaggagaagagccaggcgugcggagggaacuugggguccauugaagagcugcgaggggccaucuaccuagcggaggaggcgugcccuggcaucuccgacaccaugguggcccagcucgugcagcggcuccagagguaacuacccagggccccucugggcuggggaaggagagaccugcacuugggcugggacuuaguugaugaguuugguacuugauucuuggccugucuguuccuguuaucuugcaggccucaggguagacagaguugaauuagaggagacuuuguucugaauucuagaaaucaaugugaaugaaggaucugaaucuggaaacuacuggaaagcccacaggacuuagugcauuuguagcuuuugccacauaaauacagggugguggugaaauaccuguuuccucuuaauuaugcagcuuaauuauuggccagagaaugaucguucuuagccagauguguguaacuaucuaucugguuuucggcuuuaaagucaagugugagaaaugacagcagcuuugguguggucaacucagcgggagcgggcgcagguguguucccuguguuagcugugugugucaugucuggaagccuccuugguagggguucaucugugccagccuguagggagcuuuugucccugcccaguggccccaccuguugaaugcacuaugggugaggacucaguggggugacaguuuugcccucccugcccccucccaacuuguuguaggaguauccaugggaaccaagccccuccugacugccaucuggcacaagugcaggcguuuggaggcaguggaugugugcugggaagccgcucugugugaccugagggugauuugucacugggcuguccuccacacccccaggaggaccaggcgugcugcugccuugacaguucaucuucagguguccaggcugacaccucccaaagcuggcugagacucugugaucaugagggggauuucugggucuuuccugagacugcgucccaccugacaguacauaaagaaguuuugcacacgugaggucccuuuugcuauuuggaagugauugaaggggcugccuacuguccugugaagagccccucuacguggggacagcaggagaaaaccacaguucugauacuucacguuuaugcuucugaacucggguuucuuaguaagacauuucaacuuuuuaaguugcuagaaaauaaaaaugaucuacuuggcugccuucaauuuugaggcaauugaaggacgaucccucccuccuuugauacuaaaaacaauauaggaauaaaggaaaauagaauuaaaaagucacccaucuuuugccugaacacaaacuuuuugauuucucaaacuuagcaucacauaccucauucuagaggcauuuauuucccauuagaaagagcuuuauaauaaaacaaauagaacaaaaccagaaacggguaggauuguuacugucuuguugggcauuuugcucucugcuuuuguaguauuacuuuuaaaaccaauacuuuccacacuguccagaauugccugaaauuguuaugaacuguuuguuuauauacgugacuugauuuccccagggcagcuccagggcacagaguguguggcuuguauguguugaacugauccacguuucccauucccaggccccuaucucucuguuccucuucuuuuaguuguuaaggcaaguugaucuguaccagugcuggccaguagaaguacagcgugggccacacacagaauuuuauguuuucugcuggaugugguggcucaugccuguaaucccaaugcuuugggaggcccaggcaggaggaucgcuugaggccaagaguuugagaccagccugggcaaaauagcaagacccugucucuaccaaaaaaaaaaaauuuagcuaggcaugguggcuuguaccuguggcccuagcuacuugggaggcugaggcugcagaauuguucgagcugaggaguucgcggcuauggcugugaucacguuugcacuccaggcugggcaacagagugagaaccugucucuaaaaaccaaacaaaaagagaauuuuacauuuucuaguagccauauuuuuaaaaagcaaaaagaagugaaauuaguuucaacaauacauuuuuuaaccugccagauccaaaguauuauuucaacauuaauaacaacaaucaucaauaagguauuuuacauuuuuggagggaccgucuuuggaguugguguguguuuuacacuuagcacaucuccauucagacgcagcacauuuuacgugcucacugggcaucguggcugggguugacccuauuuacccucgggcgggucuguagcuaccugaugucuguguuguguuuaaaacuuuacuuugcagugaugcaugggggaagccaaguuggugcucucuuuccuuugucugugaugaggagugcccucuuuccuccucuguccucagaugagcugccucuugaggugcuuaucaucucucugcaggcuuggcugugguacccacuucuuccuucccugcuccugaagcucccacugagcguucaccccgauggcugccaaaaccacgguggccauggcuuagacuuccugccaguuuugcuccaaacauguuguuucaguggauggcuguaggaaaaaugagagccgccucuccucugaagcauuuucagagccuuucugucucagcuggaauuaauguuuggauucuuuugugugacaucaacucaucccgugauuuagucauuuguauuucuugauaguugagucuuaggcuccguggcuaaugugugcuuuugggaggaccuuauguaaccauuuguucucugggagagaugccaaguauuucaaaugccugaaaagaggagcucuagauuggaacguuugagauaagccuggucaaagacauccucagccaucucuccuggaccugugauuuggagucuguuguaaaaugguugagggaauuguggucaugaggggaccccguucucacccuuuguugucuucugaagacaaucuuguagaauuuuuggaagacacagaaauuacccaugaucccaccacuguagcccaaaucucaucagcaucuuugggugcauugccuucuguugucauaccaggucauaaacuuacugaauucucuuaucuaccuuauagugcaaagaagauuuuuuagaauuucuauaguacuuaauuuaggauacagaaguuguucauguaaauauacuuauauagugcacauauacaggcugaauaucccaaauccccaaucugaaacuuuugagcgccagcauggggcucaaaggaacugcucucuggggcaugucagauuucggauuuggggcugcacacugguaaguauaaugcggauauucccagauccaaagccagaagcauuucagauaagggaugcccaaucuguaauuuuguauguacuuuuaaacuuguacauauuuuuaauauugcuuuaauauauauauguaaauacagauaauuaccauuuuuagucuguuauuucaguuuguauaauuuacuuaacugauucuguacuguugggcaucagaguuguuuccaaauuaguguaauuacgaaaaucccgagagacaucuuugugcagacacguuguuccugcuuuggaccauauuucggaagcaguucuaggaaauagauucuuggacugcaucacuauuuuuauggccaaaauggguuuccugcccucacaucgggaaugcauaugcaucccuggaaucuuacugugucaucauguauggaucaauguucacuuuuugacaauugaucguaaguaaaagggauaugauuucccguuuuauucacaucucuccagggaggcugaacccauucuugguuuuuggugacaugcucuggaguuuuuguguaagaaucaugaucuucucagucuuuauaugcauucuuuuaaaauuagacuuacacauugauauuugcuccacuuauuuuuguaugacuuggaauuucuuaugaaaacuaagauuuugguuacuauaugaauuuuugcacagggaugagaaaugacauguguugacuucucucucucucuuuuucccuagauacucucuaagugguggaggaacuucaucccacugaaauuccuuuggcauuugggguuuuguuuuuccuuuuuuccuucuucauccuccuccuuuuuuaaaagucaacgagagccuucgcugacuccaccgaagaggugcgccacugggagccaccccagcgccaggcgcccguccagggacacacacagucuucacugugcugcagccagaugaagucucucagauggguggggagggucagcuccuuccagcgaucauuuuauuuuauuuuauuacuuuuguuuuuaauuuuaaccauagugcacauauuccaggaaagugucuuuaaaaacaaaaacaaacccugaaauguauauuugggauuaugauaaggcaacuaaagacaugaaaccucagguauccugcuuuaaguugauaacucccucugggagcuggagaaucgcucugguggauggguguacagauuuguauauaaugucauuuuuacggaaacccuuucggcgugcauaaggaaucacuguguacaaacuggccaagugcuucuguagauaacgucaguggaguaaauauucgacaggccauaacuugagucuauugccuugccuuuauuacauguacauuuugaauucugugaccagugauuuggguuuuauuuuguauuugcaggguuugucauuaauaauuaaugccccucucuuacagaacacuccuauuuguaccucaacaaaugcaaauuuuccccguuugcccuacgccccuuuugguacaccuagagguugauuuccuuuuucaucgaugguacuauuucuuaguguuuuaaauuggaacauaucuugccucaugaagcuuuaaauuauaauuuucaguuucuccccaugaagcgcucucgucugacauuuguuuggaaucgugccacugcuggucugcgccagauguaccguccuuuccaauacgauuuucuguugcaccuuguaguggauucugcauaucaucuuucccaccuaaaaaugucugaaugcuuacacaaauaaauuuuauaacacgcuuauuuugcauacuccuugaaaugugacucuucagaggacagggcaccugcuguguauguguggccgugcguguguacucguggcugugugugugugaugagacacuuuggaagacuccagggagaaguccccaggccuggagcugccgagugcccaggucagcgcccuggacugcuugcgcacuugcucaccgagaugaugcaguuggagguugcugaucugugcgauugcuguagcgguugccggggaccuuaagaguuauuuugcuucucuggaaggggccuaugcuugcuaggcaggcagccagugugucuguuuuucuugguuugcugugggaccuugcuuggcgagggggaaaaucucuggguuucuggagugggaggguucgugcagcagcuguugacugguacaugaagcauucuuuuauguuuguugaagcugaugauugacaucucccgugggugugccaguucuuguggaguuaagacaggauuuuuggaagcaaggaaguuagugggugagcuuggggauguagcucagcuaucugcuggucuaguggccucuaagcuauagggaggggacagagcccugagcuacagaugcuugaguggguuauugugucgguuugcuagugcagucugguuuuuaagcucuaaaauugagguauuuuauuagaaguggauuuggguugaacucuuaauuuguauaagggauauauuuugguuggggaaauagaacugaguugcuaauucuuauuguacucauuacuccauacaagaauguuauguugaauaauaaaauuggagaagauuucauuuuguguuuccagggaguauucuguguggggaacuguuuccuuacgugaggccggcggcauaagucaaagaugaguuuuguccuugcgaaucacacagauugagucuguguuccccagggugugccguuaccugauuuuuaagugagccagggcggacagcagcuuuucugauuuacagaguucuucagauuuacaaauggacaaugacaucacaguuuuuagcacugaagccagucucaugcuaguaacagugggugagccgcucgagggacuggguucuaaugaauacugguaugaacggggagucucugcagucgccagacaaaucauacucagccccuucccccguagagcaacaagugguucuuuuagaguugacuggcagcauuuccugucgggggaggugggguuugauggaguuagaaagcucgccucuguguacauucucuccugggcuguuacuuucuguagacgcacaaaaucagccccaauguuuuuaagggcaucuuagccaaggaagcuggcuuuugugucgccacuuccaggccugcauuaagagagagcccaggcaccagggcuaccacuggaaccugccucagcgucaacugcugcuggucuguagccaggcccagccuuugagacggguuuacugucaccaguagccucucagugccagcccugagcugcuccuggcucagcugcccagagccugcagccuggggagguacucagccucugggagacgagggccguggacuggguggcugguagcuccugcguuuuugagcuguguccuggcuggcugcugccaaugagguggacaccagugugguuuggggugcacuggccacuucuugcuggguucugauuuucuuggaagugcaucugccuuccuuauccaauaguuuuaucccugcauugcucuugugaaguggcugguuugguucuguauguagcauuuuguaccuuuccucuggcaaaacacugucaguuuauaaacauuuuuuauauuucccuccuuuaaaaacagcuuguguauuucugcuauaaaaugugucagcaaaggcagagugaccuaauagggcauguucuuaagcacagggacuguaucaugcaggggccaauaaagcucaagaaaacgag

SEQ ID NO: 192525 - RNA, 186075 nt, Homo sapiens
uugacugguaaauauguauagccuggaacaaggcuuuauuuguacaagucugauagaaaaauacugaagaguaaaacacauuaaaaacuuuauuguaaguaucaacaucuaaauuugcaucaauuugauacaucguugcucauuuugcagaacauaacaguugcacauugcaagagucaacuugcuucgggucuuuucaugcucauggcgguccaccccugccuucccucucccugaccugcauccuguccuccacagucugcccugccuccugucgccacagguugaagacccaagcccugaggagaaccugcugccagggggcuggcuggcugcgagccaggagggccaggcaguuagcccugccacagggaggggcaggcaagggaucguuucuccucuuccugggcugagcccaugccaggccagccacagagugcccuagucagcccauguggcuccaggaagccugcuguuguucuucuccaucccauuucacccgcagccuaguggcuaacucuggauacucugagcaaaauuaacccaaguuucauggagaacuccagaaccuugaaccagugcaugguuaucaccauucuuuguuacuagauguaggagaagguacugcagaguccucuggccuggaacagcuugggggaggauucagcucccuguuucucccucacucccaggagauucgaaaacaaguuugagagaaaaaacaguaacuaaaaaaguccaugaagaaggaucugacauguccuuugugaaguaacauuacccucuccccaucacgacgcaggagaugacauguuacaguaagaggguuacagcaauuccccaucuggagugccauucaacugccugcagaaaucuuccauuuuaaugcauuuuaaacacauucaaaacgagugcugacucuccaaccuagggaaaaugcccaauaaaaaauauagauagaaaauacaugcuaauguaauggcaaacuuaucuccacacuaaaacggcaacagucuugcgguugagggcaggggugcgguggaaccucccucuucccacaagaacaucagcaccagagaugcucgguccccgggcugaucugaugguggggaccacgcacugucacucggcugccgguccggucccaguguuggccugggacuaucagugcugcagcaggaaguugguggcgacauugaggucauuguuugaagcucucagggcuuccaaagcaucaccucuggaaaaucccaucuccaugagccgggcgaccugcaggcagagaaaacgcagaaaccugagggcgcugacauugccgcuuaucccugggccccaaauguucuucaugugagccuuguggcaaaggucaaaacuguuuacaaaaaaaccaauuuucauuucaauauggaaucugauacuuaaaaguuauaccagguacaaauuuuucaauguucacuauguguagccaauauauaugcaugaucgcacauaacccucauucuacagacaaggacacagggcuucugaggguaaaguggccuacugggaccaggccuuggaagcaggucggcaugagcugcccaggcucacugcgaggacacacgacucagcgucguuugauucccuaugguggugacccaugcucagcccuggcaucgcacuccuggcaucacugccacgcucggcccuggcaucacacuccuggcgucacugccacgcucagcccuggcaucacacuccuggcgucacugccacgcucagcccuggcaucacacuccuggcgucacugccaugcucggcccuggcaucgcacuccuggcgucacugccacagaacugccugccuuugggugcucagacuacuuugacagcugugccacuugcagccuggggcuuacgcaggcagcaaaguggggcugagccuggggcagcaacugaggaaggaggcagugaaagccaccagaagcagggaggaacaagcaugcauuguuuuugaccacaaauccugauucugugaauacggagauuuccuguacuuuucucuacaggcagucuccaguauugaaauuggcaauguuacuaaagcuuauuugcaaccuuuuuucccaauuaagaauauauuacaaaaauauucauggccccagauugccacaggaauacauuuuuuuuguacuuauauuaaaauaaacugcacuugcaguaacaccucaucaaagucaacagucuuguacauguugaguuuuuuagccacuugcgcauuaaagaggcuuuuguggguucaccugaggacuuagucagaguuuccaauuuuucuuuccgaaagagagcgagcuacuuggugcuacaugguggaaagagaaggggcccaguaucaccaccccuuccucugcucaggggacucagugggugugaauggggacuauggcaugggguggcuggaggaggggccgggcaugggccugggcauguggcuccagaaagccugcuguucuuccucucuaucccacuucacccgcagccuaguggcuaacucuggauauucugagcaaaauuaaccuaaggacucagcaaggugaggaagaaggugcagagaguagagaggcaggugggggagggaaccucccagugaccacccaggcccagacacccagacccuccucccccaaaagccuuagggaagaguugagggccaacagggacacgcaguggacacugcucagaagcuggaguccagccagggcuuuuccaaacggggggugccgcccaugucaugggaccacucagugggugaggacuaggcuuacaaaugcacgcagugagcgugcuccuccccggaacguugcuuucaacccuuagcacggggacugacgcacagcccuggcuaggaagccaagaagggcugccaggugucuuccaaaugccuugcgguggggagggcuguccuggagcagcaagaugcccagcaccugggacacuauggcgcccucaggugauucaugcucagcugcccagggcugguggacagcguagagcaaaggcagaaaccuucuaguuuguuuucccaccagaggagagagugucguagauaaaaaaaacaaaaaacaaaaaacaguagcuaacaaaacuagaauugaaaagaauucauuugguuggcuggaaaaugaucagauggaauuuaacagagauauguacuguccuagacuuaaaaggucaggcaggauuugagagaccugacucgagagcauuuuaugugaaaauuccugaguguuuucagcaggcccagcuuaacuggccacaccagugaugcagcuccuuacacaagagcgugcacaggcacacacacacacaugcacacuacuaaugcaucauaugcacaucagcuguggcugagugcccuggccucacugccagguggcugagaaugcugccacccugguguucugccccucacaagcugccauccacacaaugccacagcucuugauuuugcccuuugaaguaaccgagaacaacccuauucucuuuuccuacauaaagcacuuugcgggugugacagcccucuccuuccucccucaacccacuggcuuuucucggcccccacccaggccuguggguaccguggcuuguucugcuguguugcugucucugcccucugcccugagccugaugacuccucuuccccuggugggucuuggggccccugccuuuuuccaugucucccagacuagaaggcccccagagcgaaguccucauugccccacugccuucuguccugggcucccugcagcugugucuguggggugauagcuucuccccaccacugugaacucccaguaugagggcuguggcugccuuugcucauuccuguguuucaggauccaguuccuuucagcccauccccucccauuugugcacaccgucucagaacaccgcgcccagaacugagugugacaccacggguguggucucaccagggcagugaggccacugcccuccaacagucugggcccuuagcuucaaugagagcagaggaaugcauuaguagugugcauauguguugugugugccugugcaugcacuuguguaaggagcugcaucacugguguggccaguuaagcugggccugcugaaaacacucaggaauuuucacauaaaaugcugucaagucaggucucucaaauccuaccugaccuuuuaagucuaggacucuacauaucucuguuaaauuccaucugaucauuuuccagucaaccaaaaugaauuauuuucaauucucauuuuguuaucuacuguuaaucaucucccucaaacuuguaucaugccuaaauuugauuaguaaaccucuacaacuuuguucaaguuauuauugaugaaaaugucaaacacgucaggucaaagagcccagaacucuguguucaagggguuaaucaacauuuuuaaucaguuucaaacccacuucauugcacuaucauuauccauucugcaugucaccaacaucucucauaagcugaugagauguugucaaaggucuuggugaucucuugccaacaggauugguuugguguccuagaccacagcugucuuuucaacguucacaaaccaucuauuugauaauaaucuguuuaagcuuuugccagaugugaaacuucaauucugccacuugguucucagaauucacacuuuccuuuuccuuaggaacauuuucaagcuaaguguuccucccugugcuuucucaagccuccaucagguugugcagggagaggggcuggaggacucaggcuggauaugugucauguggaaggaaaacucucucugaucaagguggucuuuccaaucuuggguggaaauaaccuguaugauguucccuccaguuaaggaccauugucauugguggagauaacucaggccaaacgggagcuggccugccuuccuuccaccuacuauccaccaccaugaugccauggcccccaaacaacuuggccacucuuaaugacguuuauuuaaacggcuuggaaaagcuaccuuuacuacuaccuguaguacuucaagugcagcugaggacuggcugcuucuuugcacccagccagcacaaacgaauccauuugcuguccacacucagcaauuuggagaucuggcaaaugacgauucauaaucuggagugaugaagugugacuuuaggccacagcuccaccuggcacuugagcucucccuccacugaugauacauuugguuuggaauccacaggaugcugauaaugggcuggcuacacacaggucaccaacacagggcagcagcauggacugcaugcaggcccugcccuggagagggaagaaccccuuaggucugggauggcugggcuggguuguaagucacguaggugacauccuagaguaagaacgaaagcuuucuauguacacgagacuuccuucugaguucauucucucagacaugaacgacaugugccgcggugcugguuuugacaacuaagacuggcuuuucacaggucuuggcagaagagagcgucugcugucacagcuugcagcgggcucgcucuucauccucugcggggcagaucaugccccuuuagccaaagcuggcuucagagcuuuaagugauuuuuaugggugagaagacaagugugacaggagaacuuucacugcccacugaccuguuauuuucaccagauuaaaaacuauugcuaaguagcaauaauguuagcacaguucuuuaaaaagaauaaacaauuacacuaagaaagggcaccugaagguuucccauaguguccaaaacuaaacauccauggcaaacugaaacugcaugcuugggcuuggguaugcgaugacaaccagccagcaaggacgagaagggucaggggauagguguuccgaugggugcuuacccaauacuccccaguggaggggugcagugcagugcucacagccgugcaaguuagccaaguggccccugcuguccuuucuuuauguaguuucagagguucaccauauagacaguaagaacuggagcaaaaacuagcagcacagagaacaguugucuguagggcucuuugguggacacuaacaauuacugcuguggcucucacuauuccucugcucagagaagcccagcacgcccaguccccacacaucucauuacggucucuccugggaaagcuuacucggcaugugaagcaucaacuccugugcucaaauuacagaaagacgaaauugaggccugcgcagacgugcagucagguaagcaaaacacacguuaagcauuccuaaucugaaaauucaaaaucgaaaaugcuccagaauuugaaacuuuuugaguaccaacauggcaguacaaauggcaaguuccacaccugaccucaugugaugggcugcagucaaaaugcaggccacaacauguaguuuauucagugucuccaagggaaaagagacccucucacccuccuucagcugugacaugccuuuucugcacaugccccgacucccccacgcaagcacaugccagugggcagguuccccacaaugaccugcauggggccaaaacccacgugcgucacucacugugcuuuuuugcuuacuuucugcucuguguuauaaaaauguuguuaaaauaucuaaaaggugugcagauacccucuggguaacagugauaagaaaaagauuuauguuuaucuauagcacagaaagucaagcuguuggagaaaguggagagcaguguaagugugaaacgucuuacaggagaguaugguguuggagugaccaccauauaggaucugaagaaacagaaggauaaacuguugaaguucugugcuaaaagugauaaacagaaauuaaugaaaaauagagaaacacugcauaaagcuaaaaaugaagauccugaucauguaccgaggauggaucccuugguguugcagugaacaccugccacuuaaugcuaugugggucaggaaacaagcaaggaucuaucaggaugaggaacugaaaaugaaaaggaacuaugaauauucaacauguuggcugcagaaauuuaagaaaaaacaugaaaccaaauuuuuuaauguggugacaaagcaucaugaagcagcaaagaaauucauuggugaguuugccaaggucauugcugacaaaaaucugaugccagaacaagucuauaaugcugauggaacaucacuguuuugguuuuauugcuccagaaagacacaacuacagcuaaugagacagccccuccaggaacugaggacaucaagggcagaacaacuuugcugggaugugcuaaugcagcaggcaugcauaagcguaaacuugcaugacaggcaaaaguuuguguccuugcuguuuucaagcagcgaauuucuuaccagaccauuauuaugcuaacaaaaaggcauguuuaacuagggauaucuuuucugauuggucucacaaacauuuuggaccuguggcuugugcucacugcagggaagcugggcuggaugaugacugaaauauuuuguuauaccuugacaacuuuucuguucauccuccagcugacaucucaucaaaaaucauguuuaugccauguacuuuuccccaaaugugacuccauuaauucagccauguggccaagguauucuuagaucaaugaaggauaaauauaaaaguaccuucuugaacaacaugcuagcaacaaaugaauggguauggaagauuuucaacaggcguuuagcgugaaggaugccacacaugcuguugccaaugcauggaacacagugacugagaacacagcuaugcaagccugacacaaccucuggccugugcuauguucagugaugaugacgaacaagguggugacuuugaaggauuccacaugucaaaugaggauaaaaugaugccugaccuccuaacagguaaaaaauauaccuucgagucugucaguaagccagaagaaguggauauugaaguuuuuauuuuuuauuuuauuuuugagacagagucuugcucagucacccagguuggagugcagugaugugaucucggcucacugcaaccuccaccuccuggguucaagccauucuccugccucagccucccaaguagcugggacuacaggcaugugccaccaugccuggcuaauuuuuguguuuuuaguagagaugggguuucacuauguuggccaggcuggucucgaacuccugaccucaagugaucugcccaccucggccucccaacuugcuggaauuacaggcaugagccacugagcccagccagauauugaaguuuuuaauaucgauaagggggcuccagcuguucauuaacugacccauggugaaauagcugagaugguucugagucaaggugacugugacaacagugaugauggagaugaugcuaacgcugcagaaaaagugucuacagacgacacagagaaaauaugugaugggcuuacugaaggacuagagcagcaugcauuuuggauaagggauacucaacuuguagggacagaaaaccagguucaugcuuccgugaaauaaaaaugcaggggaagcugcaugcugucuuaggucugacuccagcgcaggguggcagggagacccgagcuuuggaguuggccccgugugaccacaugcaggggaccaggcucugacucucuguuuccucgcaguuugggagaugagagggaugcaugugagaagcccagaacagugacgggcacaugaccagcgcucaauaaacaugaccucucaggaccacuauucuccuauggagggcagcggggccagguguguggugggcccuaaagaagucagaaagacaggaacaaucuuuuuaaauggugagcauaacauucuaacaaaaagacuguguuguucuaaaauacacuuuauguauuuauaaaguuuagcaaauacacaacucugaugacuauauaaauaaugguauuauagauggucagcccaucucucucccuaucgaaagcaccacauuuuagccacaacacacauuaacucacacugaaacccuggacuacuucauuuucucugcaggcugcuuccugucucuguaguccagcuacugggaugagaagcaucagaacucaccaugagcaccugauccgaucuaacauccacaggaagagaaaguuucaauguaaaaucuccugaugucaaguuguuaaaguacaggaaugaauguuuacaggucuccucugcucuaaggacuggcacuagguacuugcaugaguuggguacuggguuagggccuugcauggaucuggucucccucauagacggugagcucccuugagggcuggcaccaggccuggcuugcuuccccccaacacagagccugacacacccggugcccagcaccaguuagagaaggcugaaugugaagaucaaaagugaccaauaaacauguggaggacaaaaugagaaugcugguaggacacugagacucuggaaaagacugugcuaggauagacacuuguucuggcgugaguggaggcaauggugaggcgaggcgaggcgaggcacggcgcugcauacugcaacuucgucaguguuggcuucaugggcuugcagucauucauuggucuggaaaauuuuaaaaaugucucaaagaaauuuucuaaaaagguguucuuucaacauucccucuccaucucagagcacagcgaguaccuuccuccugcucaggcaucacaagaaguuucugccuaaaaauccucaccacaaaauaucagauuagagugcagcuugguuucuagcccccaaaucgaaaugauuccuuccucuaacuucauugagaagccagcucuaguuggguucgccuccagcaugcuuugcuuuccugucuuccacaucuacuuauuucuuauuucuagacacuaacauuccccaaauguaacauccagagccugcuuuccguaacaggaaaccugacuuccagaggugaggagcagagauaaggcuacucagaggacaccaaggugcagcuggugcuguggcaauggcaaacuccagcuccgcccucacggggaugaagacccacucuggagguguccagggugccccaccagagcccccacagggaugaagacccucuuggagguguccagggugccccaguggagcaaggugugacuccaucaguugccuuucgucacgagcuucugaaccacaggcgucagcagcccuucaccagcccuggugugacacuuccacauggcuggcugaccaaggcaggggagcaugacagaaauaggcguugccacaagagcacugucacugucaccugacaauguuccaaaggagagcaagauggaauacauucccuaauaaugugcuuuucagagaacccacugaaugaggaaaacacccuagagauggaaauaaaucuguaccaguuucucuuuccuuauuuuuuauuuuuaaacaucuaugauugggaugugugugccuacuaccucaagauaauucucauuuaagaaaaugccagccugggcaacccuugucucuaccaaaaaaaaaaaaaaaaaaaauuagcugggcuugguggcaugugccuguagucccaguuacucaggaggcagaguugggaggauggcuugaacccaggaggucgagguugcggugagccaugauagcaccacugcacuccagcuugggauacagagcaagaccaugucucaaaaaaaaaaaaaaaaaaaagggaaaaaggaaaagagaaaagaaaauaaaugaaaucccacuuugguauuuuacuugcaauucaacuccucuuugacauaaguaaaaugggacauucauuccaaugagauuucuagcaacuccccucagugaaagacuccuuuugguuuauucaaacuagagugugguuuucuuuaacuucccuuuuagcuaagugcgucaaaaacaaauguuuuuuuuggguuuuuacuucccauauucugacgcuugcagaaagcgaugcccaccugaagacggcccccacccgauccugagcucacacugggugcaggguagcaugcacacccuguugggggagcccagaugugcugggccugccucgcccacugcugucauagcaacuggcaccgguuaccuguuggcaccagcugcccacccccaugcugacgcauggccgagacccuugcaaggcagugcagcccccaccccccucucccugucugaccacucucuuccuugggagaacugcagauccccccuccuuucacaucucuugguugaacucagguuucugguuauuacagacccugccagcguucugggcugcucugagaccaacugugucuagagccucgucagggucuuguauggagcaggucuuuaguuaaggcuggcugagcuccuuuguguacaucucucagagcacccagcagaaugagacaccccacaaaaguugguuacuauuugaguaccaucuaguauuucauuguaacacaucuaacuuugggaucuuguuagaaaacguauuuccaaucuacuagagcaagcaauggaaaaaccuggcauaauaccacucucuagcacauuuuuuaugugaaaacaagaguucugaaagggaaguuuacuggccacaccuucguguucaacccuucuccgaccgaugcuggggcaccuguguguaucaggcuuuucauaggguagcaaacaaggcagacauggccccagcccucaggaagcucgcuguccacagggagaccagacgccaugggaggcuaacccaauacccaaugugcugccaugcuuggcuacucagagcagaagcacgagaugugucucaaaaccaauaaauauuagagcccugcuuucagaaggugagcauuuuaggaguuucgguggguuuucuggagacagugguaaggauuccugagaugagaagagaggagacagccucauuaagauuuagauucucuaauacuaaauacauuuugcuauuuaucagcuaagagugaaagcaccuuguggguuuaaagccauucucucuacuugggcuaauggauaucucagagacauaaacagaauccacacgacgugucaugugaauugaccaaaauuaugggacgccauuguuuugggcuccaacaaaccagaagaccaaacuaaauggagucacucaugcuaaaugccacacaaucaaauugaaacuuuaaggaagcagacagaucccaaaacaagaagaccugcuuuuucuaaaaauaggagaucccagacuacacaagucagcauaauaaggaacuccccucugcuuuaacccuuaaaaaaaaagcaaccugaaguaacucaauguuaaccuaucaguuauuuuucuauugcucuguuuccuucuuacaaaaugcacuguuccaguacugccuggcgggagcucacauucuguuuuguagaauggaggcugcacuaauucauaaguugcaaauaaaagccaaauagaucugucacuaaauuugcuguaauucugucguuugacaugcauuauaaauguauuauuaauauuaaugcaccaaaugguaacaucucuugucugggcaguugcaccauguuuccugggccuggauagagaaaauuauaagauuauaaccugcccccuccucuguguccaguccauccucuugggaaacccaaugaugguguuucuuguguaagaucccgcaugguuccuuggugucuagaguauaaccacaugccacacaucagacccuuggcgagccugucuggccuccuuucuguccagcuucuagaaucccaagaagugccccggcccuccaguccccucuacuccagcccacccauccguggcuccccaccucccauguacuugucuucaggccccuccucugcaacaccacugcccugacggccuuucuuggccucagcagcacccgaacacuuccacaagcucuuuguccaccuguuucccugcccugggcucacagcuccucagggcaggacauuccgccuuauccaucuuaguguuuucagaauucagcacagcgcuuagccccggugcagagcagacagcuggucacugucagcuaaaggaaagaaagacaugaaucgaagagaggaagcugaaauuugcucaucuuccuuuuguuaaaucccagcuuuggucuagucuuauuuaacuuucuugucugauuuuaccuaacagucauuuucuaagcuuugggagggucagaagagauacacuugaugaguuuuucccccuuugguuuuaaaaaaaucagaagcaaauaugagaaaaauuuaaucauuuguuaauuuugaguaugggucauaguaguauaaagauaccuguuuaaaaaaaaaaaaaaaaacaauaaaaaagagagagauggaauaauggauauacuuauuauuauuauuuugagacagagucuugcucugucacccaggcuggagugcaguggcgugaucucagcucacugcaagcucugccucucggguucacaccauucuccuguccucagccucccaaguaggugggacuacaggcgcccgucaccaugcccggcuaauuuuuauuuuuuuauuuuuuaguagggacaggguuucaccaugcuagccgggauggucucgaucuccugaccucgugauccguccgccucagccucccaaagugcugggaucacaggugugggccaccgcgcccggccuggauacacuuauuucuaagauagcagacauugagcguauuugauuacucgaaggaguuuuaucaaguggucuuuggcuuggcauuuuugcuguuguuguugacaaacaguuucuauuuaucuucuucuuccuccuccuccucuuucuugucuaccuuucucugggcaacccuggcaggaccuucuugccacccauuuucccuuuagacucagagccggugacgccaccugucuuucuccagcagcuuccccaccuugguguccuaaggcugcuucucacggucacugauuccacagcucaccaagcuugucuacccaucuccaaaagcaaucccagggucuauggauuugaugcuggggauccugaacagaacaggcaguggucuuuggggggcauuaggggccuucuccuugccucccuuagcugguccaucauccuucauuuuccccccacagccuacuuuauccaccuuuguccuuucaucagauuuagacuucucuuuccccagacauuaucuuucaacucuaagagcacuuggaaaguucugugaaauugauaggaacuugugggguuuucuucugaucuuccuccccgcacgucugcacagggaaggcaugagcagacaucucgccuugugguuuccggggaucgcuguugccauccugacugucuagcuagcaggccaggcagcacagggcgcacuguguggcuuggcacucugcagccucccaccgccugccugcacagcagccuccuucuugggauauucuuaaauggggcugggguggcaucucugaggggugaugaauuggcagaggugccguggguuuacucaccaaaaaacgggaguggauucugaagaacuaaaaaucuugaaucuuaauaacagcaaaaauagcaaaaguagaaaagguggcaaaagauuucuauggcuaucaaacuacuauuggauuuauuaaaggaugcacauucuucuuagaauauucugcuuucaaaguacauggcauacauuucaugucuaccagguuuucuugaacucucacuaaauuccuaaaguaucuguuuacagcagaaaaaacucaaauaauaauuucuauuuuucuuggcuuaaaaaauuacuaaguuucuuaaugcauuaaaauuacguggcucugauauuuaaaugaagaaaauacaaacauuuaauugaaaaaguaagcaaaaaaagcuuuuguuaauucaaguuaucuuaacauguuauuaacaaauauuuuagacagugguuaaacaaacuggccaagagauuauacaauauaaauuuauaaacuuuuuuguaagcaucuugagggcaacaacaguaucuuuuuuaucuuuuauaaucucuauaguacccacugcaaagaacaccaagagccugcagaaugaauaaugccaguaagaaccuugcaucuuuaaggcaacaaugguuuauaacagcuauuugcaggauaaucaagaaacaccaaaaacaagauuuagaaaaucaauguauaagaaaguguauguuaaaaacaaccccucauguuuuuacaacuucucguaacacggagcgaggaagaaauuaaguacuguuuuaaacugauguugacaagaaguaaccucgcuguugucauucugggaugaucaaggaaaaaugacucauuaaacaaaaaaaaaaacaacccugaagacuucaaucacacacauacuccuuucacucccuuuuugacacuuuuuuuuuccugaagugcccaaacugagaaauauaucaccuuuaaauaccucgucuuaacggcugccccaugagggaugugacucacugcuguaucaaguaaacaguaacauaacggaauuuugauauuucuuuucagcugaacuugacagcaguaucuuauuuuuuaaacauguuauaggaagauuuuacacauggcagguuauugggcuuuucuuauccauggggauaaccuuugucuagaaauucucuaguggagguagaagaggaaaacuguggcuccauacuccaccuguuaauccugaagagcugcugaaaccaucagucugaguggagaaguggcaagcgggaggggcuggaucaagucaaugggcacgugacagugguuucucuugaaaacaccugucacagccuuacccauggguggcuaugagaucccugcccaggggcaccuuuugaguuuugggaaaaaugaggacaaaguuuugcuacagaggcaggugcguggcauuuguucacucuggggacagggaauggggaggcgauggcguggaugguguggucagcugugaaaugcugaucucaauuuguuuuguuugcugaaagggaaaaacaacaggcagagggaaacuucaaaguauuaugauggcaacacucuuaacuuucuuuuauagauuuugaaaagguuguaguuugaaauaauuucaaacuuagaaaaguuucuagaauaguaccuggaacucuugauuccuccuuaaccagauucaccaauuguuauuuggccauagcugcuuucucucucugucucugucacacauacacacaaucacacacuauguacugacaugcacagguauuauuccuaagccauuugagagcagguugcacacaucauggugccguuuuccuucauacuucaguguguauuuucuaagaacaagaauauucucuuuccuaaccacggucgguauguaccaaguccuggaaauguaaaauucauauaauaccaauauccaauccauaguccaauuucaucaauugauccuaaaauggccuuucaucagacauuuuuucuccaguacaaaauccaguccaggaucacauuuuccacuugggcagcaugacucccaagucuccuuuaaucuggaacaucguauuuuugaagaacauagaccagguauuuuacagaaugucccucaaauuaaguuuaucuuauuuucccuuacgaucaaaguuaugcauguugauuguaacugcauauguuacaaggacauaacugauagguccuuuucaggauaugaacauaauaauucuuuguuccauaauuggugauguuaauuuugauaaccugguuaaggugguguccaauuucucuucuguagaauuacgguuuuccuuuauaauuaguaaguaacuuguggagggauacuuugagauuacaagcgcuccucaaccuacgauggaguuaagucccaauaaauccacuguacguugaaaauaucauaaguugaaaugcauuuaguacacuuaaccuacugaauaucacagcuuaaucuagccuaccuuaaagaugcucagaacacuuaacauuacccuacaguugggcaaaaucaucucucacaaaucuagaguauugacuaucucauguaauuauugaguaucgugcugcaagugaaaaacagaacgguucacagucgcugcccagcaucgcaaaagagucucguaccacguaucgcuggccugggaaaagagcaaaacucaaaauuugauguauggcuucuacugaguauguaucacuuuugcaccacuguaaaauugaaaaauuguuaaaguucgacaauuauaggucagggaccaucuauauauaaauagccuagucuucauauauugaucauuuuucccugaauggauuuuuauuacgaugcuugcaaauuugugauuuucugauacuaucauucuuuguauauuuauuacuugacauuccauuuaggaaaagcauuuccuucccuccaguguauguauuuauauaaauauuuaucuacuauuauaaugcauguauucuuacuauccuuuauuuauucugauccccaagccgaugcccuagauguggccagugggaucccgcagcuggcuccaguguccuucugacaggccccagcagugacugaucacuuccuuacuuuccuggcacacgaugauccagggcuauccuguacguucccuacacugggccuggaauccaccguuuuccuaaauaggccugguuccuuuuaguggggaggaguguuuagaaaccagaucugggcaguaggugagcccacugcuaccaggaggccacugcuucugagcccucucggucagagugaggguauguguacacacacacacacacacacacacacacacacacacacucucucaugaguuuacgaugauagugauaauuccuuuccaaccccacaggguucucccuugccuuucccugcuuuauauauuuauuuuccuucuuccacaauaaaaucaaccgaguuccucauuugcucaaaucuauaauacacacagcauaauuuuagaauugcuauacucauaccuuuaugaaaacuaaaccuugaagaaauguuuaagauuuguuugcaguucuuuuuguuucuucauuagacugaggguauauccgguacaaacguuacugaaauccauuuucccuccuucaaugugauuauguuauucauuugaaaugcaguuagagcauuuguuuguuucuuuucaguuuuacauuugucccuguccuuuugguuugcuuguugaauauguaaaacauuaacaugacucaaaaccauacaaaagugaaaccaugccaaaggcacacucccuccccauccucccaccuccuuguccccgauccuucacagagaaccaaucucauuaguuucuuguauauaugaaguguaagagcaucuaaaacaagcuaccauaauacauucccacccgccgccccccaaccaauaaugccuuccuuaaacucguaagaaccacaauagccaaaaaaaagcccaaagucucuaucaugguggcagauggacugcugucaccaucuuuguauuuacacgcuugauuacuuuugaguccuguugaucgaaacugcuucaacucugaaacauggauuuagaaugaguaccagguauuacugauuaauuaccuguuccucagaaacuucuagagggggcgcugcuggcucagacugccgaccgcccugauaguuuacguuuugucgcugacguaaaggaggaaaaagacgauuccaauugaucauuccucccuaaaaagagaucaacacacaguuaucagacacagaaggagcagaaucaucauaaugcuuggaagagcuuucucucaaugcaguuacaucuauagacugggaaggaaguaucauauugauccgcucuaugcaagcaauucaaauucaaaaguaucacaacauccuucagucaauagcacaaaauuggcagccugcaguaggugcucaggagaaaagaaaguaauaggcaguguaaaagcucuuugugcacuguggcucuggaaggcagugaaagacacuguacagacacuccuaauuucagcccgacugugacgccacugacugucccaacuccaguuaacucuuaggagcucagggcuuugcagggugugauaggaaggaaggcauggagacgaggcuaaaucacugagggcagccagaaaucugguguuuccaucacggcccuuaaaaugcuccccugcucuaccuuucuucuucuuaugacugaaguaaauccugagcgcacacaguggaggaagacugcagacugugauaaaaccucagcaacaggcuagagagugugaagggaaaucugacaaacagcaaaaaggugagaagugagcaucaguaaccaucuuucugaggguggcuccacggauccugaagacugacagcaaugccguuccuggcuuagucuaugucaccaacaaaaaagaagccaccaugggaagaaaaaugcaucacaugcugcuuuaaaaaaauccauguuucuagcuauauggcaaucuuugaauuuauuaauuuaaaucucuauuucuagaagucuucuaguccugacaaaauuauagacuaagaucugaaacucuuccuacuacaaacaccuaaaaaugcuauuaauagauaaauauuucuauacacagcuaaauaugaaagaaguaaguggaguugcaaggccucaggaacaagugggcgugggaagcagagccgcacacugugagcagccugggagacgggggagcagaggcccugcucacccaggaccacuuggguucuaucacuguuugaguucggaagaugcggccuugggucugaaagaggcagcaauuuugagcucaauuaucugucuaaagauacaaucuucaaauggcagcacccucagcgaaagggaugaaaaaaaaaucaaacuaaaaagccugucuucccccggagacagcaggaaucuugguccugccugagaauuaagaaccacaggcaaauuugggguucaaguuauacuauacauauguuguuauauucauggucucagaacccaucaaaaaaguuacauaaagauugguuuugggauggagauaucgaaggagccaagcaaaagcaaauguaaaauuacucuggagagauauucucuugccuugggguuacaugggauuuauaguuaaagcuccaguggggaaaaacucagaauucaaaaccacaaaauccacaaggaaaucacccaugaugagcaagucggcacacaaaacacacaagagacuggguccccaaggaccugaauauaggaggaucugaaaaugauuacacacuucaaaaagacuaggacgucacaggaggaccuuaaagaaaagaauaagguauuaugagaaaaaacagaugugaaaaaaaauuagggaaacagaagccacucucaccucucaccuccuccccacaaaagauaaaucuaaaauauaaagacguacacaaguugauguaaagagauggaaaaaaaucagagaaauacuaaucaaagaaagcuguuguugcuacauucaugccaaauaaauagaccucgaaggcaaaaaaaggcaguauuagggauaaaaucaauagaauacaugaauaucauauuuauauguaacacaauggcaucaaaacacagaaagcaaaaauuaauagaauuacaagagaaguggaagcauccagacauauauuuaauuuucagcauauaacucaguaacugauagaucaaccagacaaaaaauaauauaaaaaauaacaaguuuauuucugaauggacauauauaccuugcauuuaauauuuagagaauauacauucuuuuccauuacauuuaaaguauuuacaaaguaauuguguacuagauccuauaugaaauauucacaaauaccaaaucauaaacauuacacagauuauauucucaccauaaugcaauuaaaugagaaaucaacaucaaaauaauaacuaaaacaaaaaaccucacacauuuggaaaccaaaaaaauccucauaauggaaauuagaagauagcuaagaaugaauaaaacuauuaccuaccuaucaaaguuuaugggauguaauaaagugguugauguaauuuuuaaauauugagauuaaauuaaaaaaagaaaacugaaaauuaaaggguuaacuauacccaauuuaagaaguuagagaaaguaacaauaaucuaaaaaaaugagaaagaagaaaguagaaaguugagagcaaaugucaguaaaacggaaaacaaagaaacagaaggagucacuaaaaccuacugcuggcuguuacaaagucaaauaaaauaggcaaaccuggcaagcuugaugaaaagacaaaggaaggagcacaaauaaacaguauuaagaauaauacaagggauauaauggcagauuuuuaaaaaaucacaagaauacuuuauucauaccaauaacuuugaugaaagacaacuuucuagaaaaguauaacuuauuaaaacuuauucuagagaaaacagacauugguaauuaucuuuuaaaauuguucaggaccaucuacuuaagcugagccauaugugagacucagcaauuccacuccugaauaaaagaaauucaaacacauguucaucaaaagacauggacuagaacguucucagcagcauuauuuccaacagucaaagacgggaacuacccaaaugcccaucaacuauagaauggguaaguuauggugcauucacauacuguaaucuaauaaagcaguuugaaugaaugaaccagaaugacaugcaacaauauggcugaaucucucaaaugauguugaacaaaauaaacacaaaaaguacauuuguaugacuauuauuauauagcauguacuuuucuggauauauaucauacuuuaauguaauugaaacaguacuuaaaaaucuacccaccaaaaaccuacaggugaaguguaugaaaucuuuaaugacuccuuaucuuauauaaacugcucuagaguacagaaaaggaaggagaguuucccaccuaauuuuuugggacuagcauaacacuguuuccaaaacuagacaaggccauuaugagcaagaaaaauuauacaauauauaguuaauuuuucuuggguagauacaauaauccuaaauaaaauaucagcaaauucaauccaacaauguuuucaaaauaauucucuuaucuaguaugaugugcuguauuaggauuuaucucaaaaaucuuagaaaaacuagcaacauaauccacacauuaacaguuugaaggagaaaaaucaaacgcucaucucaauagguaugaaaacaauuugacaaaauucaauacccauucaugaagagacaaaaaugccuauuaccaauucuugcauucagcacaagucacagcauaaugagaacaaaaaccaaacccaaacaaaaaucucacauaaagauagaaaaagagaaacaaaacucauuauucaaaugaugacugucuaccuagaaaauccaagaguguuuacaaaugucucucaaagcaugagaacaagagaguaugauuaaaaaguaacauucccucuauugaaaucauuagagaauguaaguacaaaaaauuacuauuuauaaauagcaauaaaaauauaagguaguuaagaauaaaaucaaacaaaagaucuacaagauuucuaaguaaauggaaagauucagcauguuccugaauugagccugguaacauguaauccuauaaucuauccagacacugccaacuccagucuagcagacugcugguucacuuccaauauccauuuucccccuuuggaaaaaacaguuuugguuuucuuggguguguauauacgugugacuugcuaccuuucucaguaucuuuccauguugacuagguucugacaaugguaugucagcagaaagggaauaugggccgaccaggaagauccucagaggcaggggcucgcccuucuuagaggaucagguggaagcccugugcugaggauacagcagcagcaaagagccgggggcugacaccuucaggacacugccccgccggccugggcugcccacugcuggacuucuauacaagacagaaauaaacuaccucgguuaaguuucugcuauguuguguuaucugucauguggagucagauuccuauuauuauuccuauucccuaacugcuauauacucaaaauucaaaaguaugcacauguguauauuuuggugggacuagacuacuugaaguuaaagcucaaaacuaggcaugacuauuuugaagaaauauaagaaaggauuucucuaccaguuauuaggacuuacuauuagacugcaguaauuaaagucaugugguauuaguggaaguuaggcaaaaaauccaaacagaagacagagucuaggaaucaacaguaaacaugggcacuugguuaugagcccguacugaauacaguccugggacaacuggcuauagauagggaaaagauaaaacuaggcccuuacuucacaccacccacaaaaauaaaaacuaagauuaaagauuuaaauguggaaagccaaacugugaaaauuuuuuugaagaaauaggagauuauuuucaugucauuaggauaggaaaggauaucuaaaacagaaauacgaaguauaaaucacaaugaaaaaagugguuaaaaauuacuuuaccuguaagaacuuuuguauuaaaaguucaauuguuacugaauuaaauaagacaaacuacagauugagagaaaauguuuacaacauauaacugcuauaugcucaaaauucaaaaguuacaaaucaaugagacuuaauaaaucaaugacacuuaugaacuuauaagacaacacuuauaaaucaaugagaaaaaaauaagugacucaagagaaaagcagauaauguauaugaauacuccauuuacagaaggggaaaucccaagucaagaaacauaugaaaagauauucaaucucacuaguguuagggaaaggcaaaugaaaacaaguuauuuuauacccacaagacucgcaaaaauacacagcccaacaauacugagugugggaaugaugugaaagaaaugggaacucugauaaguugcugaugagaguauaaacugacacaacccuuuuggagagcaacaugucaagaucuagugaaacuauucuagucuaugaccuggcaacuucaccucuagggagcugugaaugcugaaggggucauguaugaggaucuucugugaagcacugguuguaauauuaaguaagaaaaugaaaaaaauucaguuguuccuaaggagggaaauaaauuaauaagugguucuauuauauaaaagaccauuauaaaagcagcuacaauaaaugaauuagauuuacauggguaaaucucaaauauacaauguuuaaugaacaaauaaaguuguacaagaauaugcauauacaacauauacauauaccauuuacauaaauuguauguaguuuauguaaauaauauaaauaaaauguaauacuauuuacauaaauuaaaaaauacucagaacacgaguauauauacuauuuuaacuuuuuuuggggaugagggucuugcuacauuguccagacuggagagcaguggcuauucacaggcacaaucauggcgcacugcaguccugaacucccggacccaagcaaucuuccaucucagccuccugaguagcugagacuauagaugugcaccauugcgucuggucuauuuuaacuuuuuuagauggauauauggucauggugacucuguucuccuacccccaauccaggagauauuuggcaaugucugcucacaguuuugguuguuaugugaaggaggggaggggggacaggaugguggugcugucggcauuuaguagguagaggucagggauguugcuaaacauccuacaauguacagggcagccgcuauaacaaagaauggucuggaucaaaaugucaaugguguuuagguugagaaacccugauaaguauguauguaguaaagauacaaaaacaugcaaaggcacacaacacacccacuccaggacaguggaaggggaaugggcuuugaguuccauuucauuucuuacaagagagugagagaaucaaagaguaggcaaagcaaacaaaaccccaaucccucuacuccugugauaguagaaaagugcuuaaaaagcagaaaguuacggcucuagguucuaggauguuuugacaugaaucugcucuuuacguaggguuaaauaugagccucuauaaacaggaaauguuuccuuuacuuugucuucuucaaaagcaauaaccacauauuuuaaaagugaagaaggaaacagcuugcaguuugaacaggcguuuuaugaaauacuuauuauuaguuuguaagaagauuucaaaugaaguaaaaauucuuguguauauauacauguaugaaugaauaaauauauauucauacauacauacaugaugguuucccaaccgaggagcaguaaaaguuucugacauuuuauuaagcagaaguuccauggaacagaaauccauguucuacaggcauugaaagguuucuggaugggauggucaggcagugucuacauuagagaagccagaagagcucacggguggcugaccucgggcacucgagcguccacaggagagugugagccaggcacgcggucucauccuugcucccgaagagcgccccaucuccucgggggaaggcaagauacccagaaauggaaaagccagaacaaugcaagaugauauauaauuaagaugggagcugugaggccuaaaucaaaaggacuagaaaagcucagaguggacaucaacccacugcggccaaagcacagggguaagacuuccaagaggauggggcuggggcugaauauuaaaagagaaugauuucaacgauggagaagagagcaagcaaggcauuuuccccaagguguucaaagaaaggggccuaaguggguuuauaccgccuucaaggagcaaagcaaugcuaaggaauaacggcagagggacaaaaagguagaggaagcugaguuaagaacagucucuagagccagaauaacugggcucaaaucccagcucugccucuuauuguaacaccuuagaugcauuuucaaacauuuccaugacccuugguuuucucaccuguaaagugguaauaauaacugcacccaccucacauggagaguaugagaaucaaaagaguuaauucaugugaaacauuuaaaauagaacguaaagccaucuauaagcuuauugcagcuuagcuaugauuauucugauccuuacuacuuggccuuauacuuuauacaguauuguuucucgucuucccaacuagacuacaggauccuggagggcugugauggauggaagaccugaacauauuucccagguggccaguaccacucucagcucacugcagccugagcugacugcucguacaaguuggugccccauaaaagaguaaaauggagaacaauuacagagggggcauuaugaaugcgauguuuuagaaaagccaaaaugacuuccaaaagcaucuucaucuuauuuuaagacuguuggccauuggaaacaaaugcacccuuucuucucagucuuuggugcucagaaagccuuuaucagcaugccagguuuugaagugugaagcacacagcaggggcaccuccagucuacaaucgguggcccccugcaggccaccaugcagggaagguucugggggagaccaugggguaggcagcgaagggcgaugugacucuuuaggggugcugugcuugggcacacgggaggcgaggcagggcccacacaaggacuuacucagugugcuauggaccaaggcuuucaaauguuuuccaccucauggcacacacagaaaaagacagauuugcaugguccacaggaaaagccaaaacuguuuacagcuggcccaguggcuucaggcccuuuccaguugcccccaagcggggaggggaccaguaucucagcccaucuaugaccauggcacaguggcugggaagcuuuaccccaggccauaaggaaauacuuacacauuuaggaaacagguugauuuaacaggagucucugacaaaggggaugaccuaccacggagaucaagggcagaaaaagacuagaucguuuuacuugaaugaguuaauguaaaaucacaaaauuaucacaucuacuaauguaccugguaauacuuucagcaacaaaaguagaaagagaauuaagacaaccucccugccuuuuagaagcucauagucugguauuuuaauaaugaaacacuuuuuccuuuuucuuccagguuaucaaagcacccuuuguuagauccaguggauccuccugagcgcucugugaccugccuucuggcagcaccaggucuuacugaccacucuuccucgacauucucuuccccaggcuuuguggcaucccgcuuucuuucuagcccucuagcuacgccuucucaguguccucagauucuccuccucccacuccuguccuucagacacggguguucuugaagguuccauguggggaguguuucucuccuucuuccguguucugggugcccauccauuccuagggcuucaugggguagagacucccaaacucgaaccuccaacccaaacacugugucucagagccauguaacccacugucuccugaacacacuuucaucuaaauguuaaggagacaccuaagauagaacacgucccaaacaaacucaucucccaccccauaucucuugcuguguccccugucuuggggugugacauccacauccauccacugcauaaaccagaucucuaggcucuguccacuggaacucccccgccacugucuccacccucacucucacugccccgugugagaccacaguccauggccgggguggcuccagaguuaguuccuaagauacaaaucucgucaagccccuccucuacuuagaaacccuuugcuggcuccucauugcccuuuuauuaauuuaaaaauauuuaauaacucauuaacaaucacaagccuauuacuugcuaacauaaauauagauuuuugaaauaaaaaauaaccauguuuucccaaacagaauuacugagaagaguggcacuguuuuccauuuuugcaaaucucuuuaaugucugacuuacuagaagguugcuggauucucccaucugcuucugcauucgauuuuguucuguuacucugguuuuugaaguacaugaagcaaauccagccacauagauacacaguuagaaaagaaagggagaguacauuaagggccuuuucggaugacuacagacauccuccccuuugaugcuacucaaugcaucccuguugcuuucagaauccgacagaaauuucuuaccugggcuuaccagacuccugucugccacuggagucacuuucucacaacaccgcccucacauucucuacuccugcuggggagccugcucucaccacccuguacuccucugcgugcucucacaccucaccaucccuuccccaggacagcucucagcacaucccauuucacuugcaggcuaaccggccugaaucucacaacagccuauuagcuccacggggacugugauucuccaucuuguccuguuuguagaccuggccuccuguacgaccuggcauaugcaagcacucaagaaacaguugcaaaauggauaacugaauggacaaagacauagugaggcauauugcugaguuaaggcguaugggguuuucuuagccaagacuguaguuaguugggauaugaagacccaggugauggguuacuaaugaaggcgggguggaaggggugagagggguuaaagcaaggaggcucccaaaggacaugcuugauaccuacauucuucauggacauagcauccucuucuaauacaagaaccaggaguuacaaagaagcaaugcugggaaacuggugaaaccacaaauggcagcuccucauagaagacaguuauuugcaauucccugugcucuguggaagcugcagcuuuugguguaaguaugaauaugcuuacacuuaguuuuacucauuugccuucuaugcguagugcgcuguccuggggccagauaaggaggcugugacacagagaaaugacuaauuuccuauggcccugaaaagaguuuggcugagauaacaaaacaaacguacauuaaaaacuaaacaagaagcacuucaggacugaacgagaggcaucuuguuagacuuaaaacuguagucacgugucgcuuaacaacagggcuucauucugagaaaugugcuguugggugacuuuguugcuguguacuuacagaaaccuagaugugaucgccuacuacacaccaaggcugcuugguguagccuauggcgaccaggcuacaaaccuguacagcaagucacugugcugaauacuggaggcagcuguaacacaaugguaguuguguaucuaaacauagaaaagacauagcaaaaauauggcaucauaaucuuaugagaccacugucauacaugcaaucugucauugaccaaaacauauuguuauguggugcaugacuacaagagugagcacaauacagagagaaaagacaccacagaggcugcuguccucagcaaaagcuuuguggcaaaacuggggaaaaaccaaacaaagcccaaaaaaagaaaaccaaacaaagcccaccaccagaaccacacacaaacuggcaacacauucaccacuuggauaagagauggggcaacgcgaggcccagaagaaaccaugcugcauauuugaaagccuugguuccuugguaaagucuuaaaaauaggaaccuuagaaaacucagaagacugaaucuaacccugucaugugaagugccacccaugaucuuugugucgugcuauaaaaacaguguauuguaucuuucugugcugcuuagcaguagucucaguagguauuggaaaaaauaauaaacuagagggaaaggagaugaucgcuugaacaaagucccaggcuaguuuugcagcucucgguuucacuuuuccuuugugguuucucacagugaccaguguugauggaugagauacuucaaacaguacuauuucuucuaggcagaacagaaggcaguuuccauggcaauacgaucaggagacacaauacauccuguugcucaguuuugagaaccuuuuggcuuaggggacagaaguuuccaacuaucggcugcccucugccccgucucuucuuccucugucuugcucuagucggcuggagucccaaaggccacacgccuugccugugcauuccaugcaggggcuaaaagggucagggccacagcugguguuccagggacugauuggggauggcaaugaggacagaaggugcaaagacaucuacagaguacaucgggaagcuccagcacagcuuaggaugcaacccaacagccccugcaagggaugcuucuacuguguacagucugacagacaugugucccaagucuuguuuacuuuaaugacauuucuuuucagaggccugacauaccuagcacagcugaucuuacugugacauagguacaauuuuacaaacagguucaguugguuucaacagcagcugcaaacccaagagagacagguuuucccuuuguuucaacaaagcacggcucccagccaguuccaucuggggaggcccuggaggugcagggaagggacucuggagagagccaugggaugcacauggcucagccaugcaccagggcguccagugggucugugccgccgcugcccuccaggcccccugcacagaguggggugagacucugggcagcugcgggggggcuuguggcaccaagcacgcugcgggcugagccacaggccugcguccuggcucucguuuguuuugaaaacgugacugacccaucacuccucauggggaacuuuuccuccagggaccgucaggaccagaggugucccaaccuuuuccuguguuuugguuugguuuugguuuugguagagaaugagaaugcuaaggcugcucugugaggaggaggugguggugagaggguggcguggggggaccacaggguuccacagcccacagcccagcugcaggucagggacaucagcgcaggaagagcaugccaaggccuugucuugcagcuuccucacucccucgacugagugacacaccuguaagcacugaacgcuggugacgguaagggccacacagcgaggacugagacaguggccuugaagacauaagaauggaagugcaucucucagaguguggauuauccauuucugcaucguauauucuguuuucccuuccuucauucuuuugucugccaaauuuggggucauuuuuuccuucccagcauuggcucuacacacaaauuauaaaguaaaagucaaaauuaaaauuaguuuugguacuuguuacaguaaauguuuugacagaaacagaggugaaacuccuaauuaaaaaugagacuggggauuacucaagguuuccccucuucuuacauuuccuccguggagaguucauccauuuucaugucuucagugaccaccugagucucauucccgcacuugccuaucugcguucaccguggcaggcggauguccacuucccagcucaugucuggacucagcucuccucuguccaucaaacccagccaacgcugaaggacuacugauuuuccccugggagaggaucugcccguuuagguccuugcuguugcacuccgagauuaugccaacaacuucuuggaugacaugacugccaguaagauuuccccaauccaaucugcaugccacggucagugagugugcacaagaagcccuuucacaaugacacugccucaaccaaaaacccucgggcauccugucugagucuguccuguuuugcaggucugcccaaaccagccccaucguaaauuacuucucuaaauuacauccuaaauuacuaugucggcucaaacugucccugccaccuaaagugcccucccuggucccuuccauuugcauagggcccaacuccuguuucccaucuguaaguggcuucuuucucugcaacccaaacccuccuguuccccugcucugcugaacuuccacagaacucagccaagccgccaagugaacagagaauaaaacccugagucuggguuuccccagcuguaaaauggaaagcuggacuagauagccuuaagcuaguuaugagcugucucuucccaaucauuauauuaaagaacaucuggaaggccaaacaguucucucucaaaaaggagccucaggccaccugccagagccgcugcaggaggagcuccuggacagaugcuggguugacacccccaugucacccggcucacacugcucaugaaugucaccuguacaacccccuaucuccaauaagauaugagcuccuugggcaacuguccugugagagccacaguuguggacaguguccacgugagggagcaggugcagagcagugaaggggggugcgguggccucccccauccuaaacccacgaucugccugcauccccugugaacaggcacugcacgugugcacacaccuccauugcuuagacagaaugauuuuaccaaaucucaguauggcuaaucugugcucuaaucuugggugggagaucgugacucacgacucugaaaauuccuggccucuggcugcuuucuccacaaaaccacgucugucaaccacagcacugggcugcuggcucugaaaccuuggggguugcacgaaaucaaggcuucucgagggucucaguuuuccugagaugcucauggguacuccaguggucuguuccucauuaagagcuuuuuucugguuuugaaaacccaucaggauggcuuuuuuuggggaggaaaaacuucccagaaugauuaugaggaugauuuuucuaauauaccccugguuuaacaugauacugcuccagaguacaucucuaaauucauucguccuuucaaaaacugauuaauaagugacaaaaggaaaacccaggaaaagaauuaggauuacugauaacuuuuacaucuucaaaaagccaaguacaucaucaucauuugcuuguuuucugagguaucaugagacuguaccucgcucuuuuuucucaugaagacaccaaggcaggauggaaaauagaaaugauuuucucaaggucacuuaaugagucagucuuggaaaaggaucacacuuuagauugauccuaucuuucuguucugaauuuugucaaaaagaucaguaugaucaacuacaaaagcacuggaaacacagcaguagcuucugcaaggagguacagauugagauaaacagcguagcuguaacuucacugaaaauagaguucuugcaaguaauuuucauuuaauuugcagauuuuuaucaacuaagcacuaguaacuuauuccacaucugaugcuauauacuuauaaacucuugaaagaagaaagucauaaaagaacuagcuuuaacugauuagacugcuuuguugacaaggaagcauagcaacuugaaaagaaucguuuucaaaucaaauugcaccaaaaagugaaagagcauagccaaaaaggaaaagugcugaggagggugccacgugccagcuugcugucucugaggaugcucgggacacaugagaauucgcucccuuuggauuccugguggacuccuuugcaacacacgugcacugccccuaccccggacacagggguggagacggagguagagaguuuccgacggugcugccuccagacacaauuucuugacucuuccugacugcacuacacauuucucccagaagagugaccaucacauuucacuguaacugacgcuuucuacucuaagcucagggagaggagggaucgugcugccuuggucacugugggacucaccagagccuggcacugcguguauucugcggaauagacgguaaugaaaaugguagcacuggugaggccaagaggcaacaggaagcuuccuaaggaagcuggccugaugaaggggcagugacagaaacuggucugguggaguggcacuugcacacauaaagcucuacuaggcagaucuugcuaucuaaaccacagagggaaaaucaaccaugcugcaacaugcgucaaccucagaaacgugaagcucagcgaaagaagccagucauaaagaucagcuacauaugcuuccauuucuauaaaauguccagaauaagcaagucuacagagacagaaaguagauuaaguggcugccuaggacagggcggaugggaaugacugcuaauggggcgcaguuucuuuuggggugaugaaaaauguucucaaauuacgguauuugugcaauuaaaaaauacuaaaaaccaccgaacuguacacuucgagggggugaguuauaugguaugugaauuccaucagcugcuaaaaaauacaucaaggaccaguaaauacuuuuaaaacacuaaaaaaaguuauugaauucaaaauacuugauuaaugauaggaacucucaugauugacagggcagaucugccuccuggugcacaucucagaugauaccaaauggcuguugcugggggaggauaaagagagaaacaauuuucacagccacagaauguuaccaagugaggaugugcagcuaaacucacuuuaaccaaaugcugcgaaaguaacugaaagcacgugugaguaucgcugagccacucugggugucaguagcuucuuuccuugcaggcaaaacacagaggugauaaucaaccaguuaacaccgggcagcccaaugagaugaggaggcaguuaaaagaagagcaccaaggacuccugggcuuugcugccaaaugucccacuuggcuuguaccaacaagcaggauucauucacacugggcuucaccuuaguucugcuucuaaaauagauggaaauuuuacagaaaugccuaauggaaaguuuuauccccaaguuuguguugugguauauaacagaauucucaucaucagccaacagagagaggauuggcucccacaaauaacagaugaccagaacuaagagagaauucacauuuccagguaaaagguuacuuugaaagcugcuggcuauauaaccuucuacagcagggacuggcaaauauuuuucuguaaagggccaggugguaaacauuuuagguuuggaagauaaagaggcaagagaucaaagauacuauguaguuaccuauauaaccauuuaaaauguaaaaccuguuccuagcuucagauuguacaaaaacagguaguuuggcccacaggccaucaccugcugacuguugcucuagagguuacaagcuuuuacgaguaauaacuaucaagguuggcuccuaaauuaggacucucucaaacuuccugagagccacaaaaacagaugcccaauacuaugauaauaacuaauaucugauagagccucugguaccuaagguaauuuuguauaauuuuuuuuauccccaaugacaacaguauucuacagauuguguauagaugucccugucaacccaggauugagucccuaacugcccauucuuguucuuuucauuauauuacgcugcuuucuauugugagcauggcucugaagaaaaacaacacuguuuucuuccuuucuacacucacacacgacucaacacaauauucugacaccagaugugcuggggggcuucauaccccaagcagugcuccaguggacaccagcaggguguccuauaauuuaacucaauccccacacugucucccaggagauaacaucagagcccacagguuaagggcccacucccacaagacugcuccccuacuucagauggcaaucgccagaccuaaccugcgguucuaaccaacgugcuauaaaugaggguucccgugguccacuccuuggguucaguuaauuugcuaggauggcucacagaacucagggaaacacugacaucuacccauuuauuagaaaggauauugcaagggauacagaugaacagucagauggaagagaugcacagggcaaggcauggggcauggccccugccccucucuggcacccccugcacccugcuccagcacacauucagcaaucuggaaguucucuaaacccuguccuuuggggguuuuauggaagcuucauuauguagauauaauugauuauaucacuggccauuggugaucaacucaaccccucucccuaaucacagagguuggggguggggcugaaagucucaacccucuaaucacuuauuaguuccccugguaaccagcccccaucugaggcuauccaggagagccuggacaucagucauccaugugaaaagacacuucucacugugggcgaaggauuaccuaggugccgagguaagaaacugaaggcacaacuguuucaguauaaaaaagaaaauagaguaagaguagucauaauacaaauuagauauagagaugaucauggacauuaucaaucauuauaaacaucaugaaucauuagcuuuuaauauuacucuuuguugcauuacuaauauaaccuaggaauaaccggcgggcauagggucaggugcugaagggacauugugagaagugaccuagaaggcaagaggugagcccucugucacgccggcaugagggcuccuuggucaagcgguaaugccagugucugcgaagacacccauuacuuagcagaccgcgaaagggagucuccuuucauuggaggagucagggaacacucugcuccaccaccuucuugugggaggcuggauauuaucccagucugcccgcagucauccgaaguccuaaaccccucccugugaugcugugcuucaacggucacgcuccuuguccacuuucauguuccucccguacuccugguuccucuuugaaguucguaguagauagcaguagaagaaauaguaaaagucuuaaagucuuugaucuuucuuauaagugcauagaagaaaacgcugacguauggugccuucucucucucagcuucggcuaccuaagagggaagggccccccuguccugugauuacgugacuugcuucaccuugucaaucacuuagaagauucacccuccuuacccugacccccggucuuguaugcaauaaauaucagcgcacccagccguucagggccacuacuggucuccgcaucuugauggcaguggucccucgggcccagcuguuuucucuuuaucucuuugucuugugucuuuauuuauuacaaucucaucuccgcacauggggagaacaccugcuaagcccuguagggcuggacccuaugcucacuguggagauuccaagggcuuuaggugcugugugucaggggccagugguagagaacagauacaucuuucucaucacagcacacagagcuucuuugcuacagcgagcaaagggagggagacaugcaccgugaagcuguggagacucagguugcacaggcaccauucggaugaucauuacuacaggagacuccaguaauugaucuggaggucugaagacaaggaggcucugcaaagccugcccucguccuucacugugaugagcuaagcaugcucuagcucaucaccaacaauauccugagcacacagaauuuucacugucucccaccuggucuucuuccucuagugucaccuuuucuuuucuuuuucuuuuugagccgugauugcaccuugaccuccagggaucaagugaucguuccaucucagccuccugaguagcugggacuacaggcacaggccaccacgcccagcugauuuaaaaaauuuuuuuguagagaagaggucucacuauguugcccaggcuggucucaaacuccuaggcucaugcuauccuccugccuuggccucccaaagcgcugggauuacaggcaugagccacuguggccagccuaccgucaucccuucagacaacguucauauuaugacuaaagugagcuuucuuaaaaauaaaucuaacuuacucuccuguuuaaaaggccucacugauccaccacuucuggcaggaugaacacaacagcaauucuuaguuugguagaagacccguccuggccucugcucucuucccaaccaugucuuucauugccucuuucuuauaggaaccucaaucucaggcgaaugcaauuccuugcuguccccacagcuguuuugagccccugugcguuuuuucauaaggccccccgugacugaaacaccugccccaaugcuggccucaagauuacccucgcuguaucccuuagggagaacuggccacacccacuguuuaggcucaggguucuuuuuucuucucuuugcacagacuccuguagaaaccuagugccuaguacagccucaugucuuccccucgcuggcugcaaacuucuugaaggcgcaggcggcgucuuauuuaaucccucagggcaguacacugcauuagagccaaaagacaaagaaguacaacagcuccuguccuccaagagcucauauucuacuggggaugaacaaaacacaaacccaugaaaaguuauguaauggcccuggcaguguaaagaugaucacagcugcaaguagcaaaaugacucugagaugccaccugcuuuggagaaggcagcucugcugggagacaagagugagucagcgggcaaggaacuacugagagcagcuuauguguguccagcauagugucccgaguuuacaaaagaaugggacagcuguggauguggagggagauaagaagugggcaccacaggcugcagcuaauacucugcagcccacuccaucuucacugccacaggcccaugagacaagccuccaaaggccucuggauagucagugcuggcgggaaauguccagaaagaucuguaggaggucaaagcacacuagaugacguuaucacaugccugugcuuaaugaugagcaugggaccacuguacccugccccugucagcaccuaggucucaugucucaguugaagugagaucuauagagccaucacccuggucacuguucaucagagcuguggaaugggaauaugccacacaguggacuaaaaaugcuucaggagcauaagaucauauugacuuucucacagagugaaaguaacuugaacggggaccagcgugaccacagugaugucccagaaugagggcagccagucagaacagagugauauugaccuucccccacuuccagcucaugcagcgcuucucauccccaucucuccaccgaagccccuuucaaaagugaacucauucugcugaauccagugguggucuuccaguaucaucuucacuugccuuuuuuuuccugggggggggggggggcgcccggggauaguaacgucugaaucuguuccugaaacaccuacucuuccugaaacauucuacuccgcaggcucccuggccacugaacugguuuucuccuuggucccuggggguucuuuuuuuucccucuuugcacucucuagacaugggucuugcuuucuacuguucucucaagaguauccguagaucuuuuuuuuucuuuaaauagagaugggggucucaccauguggcccaagcuggucucaaacuccugggcucaagcaaucugcccgccugggcuucccaaagugcugggauuacaggcgugaaccacugcacucaaccucuguagauguuuccagcccugauuauucaucuguguucagcuugcuuaaagucuuucuguaucuauuuauuaugcucauauuugcucauuaauucccacaguuccuaacaucugccaggcauuauucacacacuggagauauacagaaaacaagucugcuccauccggagacacacugguggagaaagggcaguaaaucaccagugaacaucggguuugcggugccacgagagacaggcagugucuacaggggcagagagagcccugggagccccccaggaagcuggggaaggccucccugaggaggcgauauuugucaggaaugccgaguaaauagcagcuagacaagugaaaaugauguguaugugggagggguggggugaagggguugguacagggaaguucauucugggcagagaggaaagggaagauguaaaggugagacugcgugaaacaauaugagcagcaguuaacugugaguaacccggugaggcauggcuggccuaagggcuugcacacggcagcagaaaggagaugcggccacauagcaggcaggagccuuguguuggaaccacccugaaagcuauggagaggcccugaaggaugauagcuggagugaaacaagcagauuucuguuuucacagagaucacugguggaggcuguggggcaggcucaggagggaggcagucggugauggagaugggagggaagaaauccaggcaaauggcgccgguggccugaacuacagcacuggagaugaaugacggacuuacaucaaggagggagacucuuuggggcugaacugguggggaaggcaggaaggacauggauguauaagugggaaaugucuggggugaaacccuagguuuggacuuucggguaaacaaugggugcuuuucaucagguagggagugagaaagggaaacaaauuuagcaaagaaacaguacaugucggcugugugcgguggcucacgccuguaaucccagcacuuugggaggccaaggcaaguggaucaugaggucagggguucaagaccagccuggccaacauggugaaaccccgucuuuacuaaaaauacaaaaauuagccggaugugguggugagcgccuguaaucccagcuacucgggaggcugaggcaggagaauugcuugaagccaggagacagagguugcagugagccaagaucacgccacugcacuccagccugggcaacagagcaagacucugucucaaaaaaaaaaaaaaaaaaagaaagaaaaaaagaaacaguaccugucaagagcugaugggacagugaaguggagauguacuauaggcaguaggauauuucggucuggagccccaggagagagggagguccagucucuagaucuugagggacucaugggagccaugagcucaauaaaguggugaggacaggggcuggguggguccccuugggugucuaacgugaaaagcucaguaggcagagaacugagucuugggaaacaaccuauuuagggagugaacagaggaaggagagcucgauccagaguacagcaucagcccagccaaggcacuccucugagagccgggcuuuagaaaccuccuucuauuugucuccuccucugugguuucuccuuucccccguccaucuuacacugugcaauaaaaugacauuuuucugagauaacuguccuaucuuuguuacugaauaaacaauuuuucacagccaauguccaagccgaaaucuauugucaggcuuaaacuaccucccuccauuaucaguuacuauaucauuucccauuucucacuacauaucugcccacaugucaaucacagggcuccuggaggucucuccuuuuuaaggucucauuagcaccuccaugccucacucuugcugguccucuccucuggaaugaugugccuuacccucuccacccauccaaauuccacccguccuucuacuuccugaaaucuuuuuuggcagcaucaguccacaccaguggcucucuccucagauuuucacugcaugggugcuucaguaaauauuuccuuguuucuuggaugcucaucuauuucagcuacaacugccugagcucccugaaguuggccacaaacucacggagggaaaggacauguucuucauuuauuuugugcccacagcgaagccaccaguauuggucagagagcuucccaagcagucuaacugucuaacugugcccccagagccacacgaggagcacguggcaggggguggcagcgagcaccugccagauggcaggaugaacucuggcauaagcaggcaagagaaaucuaaagaaauacaacacugaaucaagacuugaguguuauuuuggaauaccugaaaugaaaaacugcagacagaucauguguaacauacagcaguuaguaacugaaaaaaaaugacuuucugacuaaauaaacucagauucuaugaaaagcaucuaaaaaucaaguuuuuaaauaaauaacaguuguauuuuaaaugaaauacacagcaugagauugccuacaauaaaagauacaggagcaaacaacaaaaacauguauuugaaacauaaagaagaagauggaagcaaaaguucuaacuuaacccuaauuaaaccugaagccuggcacugaguuuccugccagccaaagugaaaagggggaaaacaaaucaccaaggagcucucauauugggagguauaugaguuagggaucagaaacagagaccucagagucagacacagcugggucucacucccagauccccaucaacagcugcaugccccuggacaagcaagcacuccccugagccuccggggucaugagggaauaccugcaucucucuaggcguacaccgggcauaaaugagauaacauauacugaguacuuacuauaggacuggcaaaauaaauggugguggucuucuuacugauaaagagugaaacaugcuaauucugcaagagagacaggaccuaagcuccauaagaaaaaggacugggggcuaucuuuuuuacaccuguguccucaauguccagcucuaggccuaccauauaauaagcacuaaguacuuauuuguugaaaaguaaaugaaaauaaacuuuucuccugguauuacauuccaauacaacugcacccuguacgguacucgugcaugcacacaaauacggcagauaauuuccaguggugguuuaacaaaagaguucucuacguggugauuuaucauacuuaugugaagaaaacugagacacagcugagugaagaaguucagcaggaggcuaagugcucagguuuggguguacccaugugcggacccuagaagagaacuuaggaagcuuaggaaaaaaucaagagucuggucugugcugcccagcagaccacucaacguaaaagcccagcaagagcccaggggcugguguccugcucuggacuucagaucuguuagugagaccauccuaugaaaguggaggagucugacagcaguguagacagccauaaaggccugugccacuucacaggcgccuggugggaaugcacgcuccagcagggcagggguuugggucugucucauucccugaggccuggguacaaccuggcagaucccgugauguuccaaguaucuggggggaaagacaccgugcggaguuuacagcaaggcaggaaaggagaaccacaauggggguccguagaauccuggagcgagggcgugcgcaaacagccaagaaucccacuugcauaaacugcugcugcaccaugaagugccugucuguaggccacaaagugagcauguggucagcaguggagacccaccaaguuaccaagccaggugggccgacagaaacccaucaucagauggacacgggcaucugggcucagcauagguggggcugcagggcaugggugagcugcagaagcaggcaugccagaccacccuggcagccaccucugcugcaccacagccucuucccagcuaacaccgacuaccacagcuggugggccccucaugaccaagugacagaggggaaaacagccaaauggacaggcuggcucaggacaugaguggcagcugaaagaaacggcugcaugauggcucaaucuugaaagacagcgaucaggggaacccccuaugggcagagccugggcagcacauuuggucaucaacucugugugaagagaaguggccugaggcaauuacacguguggaucugcugggcauggcagaucaccugguuggucggucaggggacuggaagggagggaacaaggaggauccagcuaaaggaacagcaucaagugucuugcaggucgugcccaccacgggcauccaccacagaaaaggcaccaaauggaagguggacagaaugacuguggcuccaucaccagauaacccagcgcuggcacacgaauggauggccauggugguagcacagaggaaugugugggucccccucaccuaggccgaccuaucuccugccacuauggagcauccaaccuggcauccacagagacugugugugccugauaacuaccgucugcaagcagaacagucacucagcgccgagacuaugcugggcccuuuccacucugcaguguuauggaacacacugucucccaccccuugccccugccccaaauucacacgcugaagcccuaacccuacgaugugacuguauuuaaagguaggaacuuuaaggagguaauuaagguucaaagaggucguacgcaugggacuuacccaacaggacugguccccauuuugggacaacucagaagggcucucccagcuucacugugcuccauaagaccagcgaggcuuuugcuggaacugcagcugcucccucugucccaucuugcugccuucgccagcccgcccccauagauacugaugcugacgguguucucucauaaacucuuuguauaaaaaucuuccuggggaggccaaucugagaaaugcaacuucucugguuugcuuaugaggacaaauucaaagcucuccaauggagaaucuccucccaggauuccaaagguaucucagacaacauauuucccccaaaucugcucuuuugauauuggugaaauggaacuaucagucaucuaucuaagauuaucuaggccagaaacaucagaaccauccccuacuucuuucucucccucauaagcucugugccucuaccuuuauacucaaucacuacucaguuuuucugaccuugaucauucugauuucucauaccuuucgcucuucucucaguuuccuugaaggauuuaccuccugcuaaauacgaggcuucaucuguagccuguguucaucuuggauguagcucuucucuuacagaacuuacuacuucuuugcuuucggcucucagcucucaucccuacagaggugacuccaucaccuauauauauauguagcuuccacauuuccaagacagagauguccauccuccagcuuuaaauacaccaugggcaucuuuauggcauguuccagagucacucaaauucaagcacaucuuuaagaaacaacuuuugcuucucuauuucucuuguagacucugccccuaauaagcugcccccuuccucccccccccugauauaaacucugggaccugcaucuccaaugggacucuaaggaccucaaaccugauuucacuucuccaaaccaucgugagaucugcagaccuacuucuugcauccaaugcuaguggaagacagagagauggcagagguaacuguacgguuuacaacuaccccagggguaaagaagguggaggcgaaaaauggggagcccugugggcuggcucacagaaguguccaagaaagaucaggccugagguuuuagccugaugugcacuaacccuccuucucucacugcccauggaagacaaauguaguaucagauuguuuggaugcagaauuuguagacaaaugugcaauaauuucugauuauugauagcaagguugagaaaacacagcauuuuuuuuuaucuacuccuugguuguuccacugaaaaucuucuugccuucauauucucuucauuucaaccaaggaaaaucaagaaauuuuacauuuguucuucacuccauagcauaugauuagcauuuuaacaggaagacacuguggcuuuuacaagauuauaaaaacagauaaauagcacaucuuguuaacuagguugguguuucucuaagaagucaugcuuaucuaauauagguggaacaagaauguccaguuugaccaaucuuucagcugcaauuuauuuuuuaccuuuuuaaaaaacuaagaauggccacuaacagagaccuacaaucucuuuggaaaugucaaaauccacuugcaaggcacuggaauaaaauguagucucuaucucacaugcaaucacagaggaaagauuugcuugggccacugagaauuucuaaauuuuuagugauuauuaucacuuuuaccugcugcugucucugucgccucccuugugcaaacugagagaacaucagcugccgguccagcagcuccauucucugcugucucuggauguccagcguggcucccaucccaauucuggcuucgcugguggguucugaagaagagaagauggguucaaguguccaagaaaagaauuuugccauccagcuggggaugcagagcaccugaugcaccuggaacauuuugcugucguagcacagaccggacaucuagaagaaaaacguccaaugugauuguuuaaauguaguauuauuuuaaaaaauguacacgacucaaaaaucagcagccuccagacacugcacacgguauuuuucuuagucauagcaguguuaggcaauaagcaaaauccucuaccacacugcagaacacuaagcagugcaaaucaacacaaaauugaacuuaguaaaacaaaauuguuuuuuauugaauuagaagagcuagcaaaauucuaaucauuuaguauucaaaguucugguaaaagauugucaagacacugucuucauuuuuuaaaaagccguaaaagaucugauuauugaaacacuuucacacuguacugacucugcgguuaccuuuguuggcagauggccaucacagagacaccagcagaaaacaacugccaugucucagcugacccagucacacgaucaauuuaucagagaauaaacacaaucuaaaaucuugguuuuuauuuacauaguguuuuaaucaguuuuucaacuacugauuuuucuagacauuuaaaauccucaccaauauuaguuccauuuauaaaccaaccuugucuucaucuugaaggucauuuauaauguaugguuacagaagucucaaggcuuccuaugauuuucuaguuaaaaaugacuauggcuauuccuuuguaaaaaaaaaaaaaucuugaugugaauuugauucuuaggauuagaagaucagauuagaacauauuugacaacuuucuaauaugagaaaaguauacuucaauguuuaaaaauaaaauuuaaauugaugaauuggcaagaauucuuugagacugugcuacacaccaggcacuguucugggaacuuagaauacagcaaagaacaagauaagcaaggccccacucucacagggcuuauagcagucaauguggagaacaggcaguaaucaagucaacacauaaaacuauuucuggcaaguucugggaaggaaauaaagugacauggggcacgaaccuacucugggggcagcgggggacaucaggagagcccucagagaaagugauacuugagcgaagaucuuaaggaugaugcggugcccgugacuugaugaacuggggaaauaacauuuugggcagagaaagcagcagaugcugcgcagcccgagcuugggagugucuauuagauaucuuggggggcuacugagugggcagguggcuauguaauucuagaacucaaggaaaaggucgagauaaggauuucagagucacuggauaugauaugacauuuaggguaacaggacuagaggagauaaaaugggggggaggaggagacacagcagaagagagaacaggacuaaggacugaauccaggagugcacaaauauucuauggacagacagaguaggaaacgccaguaaggaaaucugagacagggcugccagugaagagaagggaaauagaguuuaguuaucacugaagcuaagaaguguuuuaaaauagggauggucagcuauaucuaaugcagcugauaaguaagacagaacuagccacuggauguugcaaauggagguguuugauaaacaagguguuuacaagaacaguuuugguaccaaagacagacuguaguaggcugaagagugaaugguggacaacuucugguuucaaauaauuucugugccccuuuacucaaaaauaguacaagacaaagaaaaugaaaacagaaacaaacuccaagguccaugaaaccagaaacuaauccugaaccaugcuaacaaaauagaaagcuuaucaagugauuauaaaccacucugcauauaagcagcauauaaguccaaaugccugcagagaguccugugggacucagaaaagcacagggacuagagcaagcuuguucaaccugaggccugugggccacauguggcccaggacagcuuucaaugugguccaacacaaauucauaaacuuucuuaaaacauuacaagguugggcgcaguggcucacaccugucaucccugcacuuugggaggccaaggcgggcggaucacaagaggucaggaguuugagaccagccuggccaacaugguaaaaacccgucucuacuaaaaauacaaaaauuagccgggcgugguggcacacaccuguggucccagcuacucaggaggcugaagcacaagaaucgcuugaaccugggugguggagguuacaguaagucgagauugugccgcugcacuccagccugggcgacacagugagacucugucucaaaaaaaaaaaaaaaaaaaaaaaaaaaagaaaaaaagaaaaaaaguuaggagauuuuuuugcaauuuuuuuaaagcucaucagcuaucuucaguguuaguguauauuauguguggcccaagacaauucuucuuccaaugugucacagaagaguucaaaagacuagauaccccuggacuagagggucuaggcccuguggaaggaggagagaaguagaggguuacuuaagucuggguaagaggcaccccaguuccuccucaugcuccauguacccuuucuccccuccacagagagaagggaaaagcuguguagggcaugaaccaaggaggguccauguggguugggaaggccaaggccucugcacaggcagauuaugugcaucucaugcggcugucagcauagggguuccagaagaagacaacagagggaauaugggggaaaggauauuauauuuaaagagauaaacagcugagaguuuucuagaauaaagaaagaauauaaauccuuaggaugaaagggcaagagucccuaaaagaaugcuaaaacgaaauuuacaucuagauccacuguggugaaacaaaagaaagaaauccuuaaaagcaaccagggauaaaauacagacuguuuagaaagaaaaaauaaacuguuagcaaauaacagcaagaaaaacuguaagauaauugggaauaaauaaauaauauauauauaaggccuugacagaaaaaaaagaaaaagauaauaagggauauuuuuucaaaaccaacccuagugauaauaaagauaccaguuccaugaauaggaagaugcaaaacuuuuaagauaccaauuuucaucaaauuaauacauaaauuaaauaucauucaaaauaaaaucuuaacaggguguuuuguuggaauguaaaugccaagccucaaauucaugcggaauauuuaagguuugcauuuuaaaaacaccauguugggagaaagaagccagacccaaagccugaaaacacgauuccacuucugugaaugaaugaaccuaaaccacacacuaagcaguaaaacgagacaggaaagcgcaaagaugaugacuaugugugcuaggaggggucacagaagggagggagaaagaaggggaaggggucacaggagggaggugggaaggaggaagagaggugggaaggaaggggggcaccaugggcugcggggcuggccaggcauggucuguaccugcaugguggauuauggguauauuugcuuuauagugauuugcaaggcuuugugacaguuaguuuguguuguauaucacaauuaagaguuaaaagacaaagaaauaaaaaacccagaaaaggcaaggcaauuuuaaagaaacguaaguccuaucagauuucaagacauacuauaaaguuuggcuaccuaaaacaguguggucuuuaucuaggguuacuuaaauagaccaagagaacaagagccuagaaauaggauccucaguguaagggcaccugguauucagcagacauggguaaauugggagggaaggggcacaugggcuauacacaaggaagagacagaacagggccccuuccugacaccaaacguaaacuugcaauggaauaagaacucaaauagaauucaugaaauuguaaaucuuucugcacaaaauacagaaggaauaccuuuuuggcacugggguggcaaaauauuuuaaauuaagaaacauaagguacaaacuagaaaagaaaacacacacuggucuacuuuacaauuuaaaagcuguaguaugccaaaagcuaccauaaaugaaaugaaaacacaagaggccugaagaaaguauucagaauucauacagccaaccaaggcagcauucagaacauaucaagaaacccuaggaauguguaagaaagagcccaguuuuaaaagcauaugaaaagguaauuucagaagagaaaacucaaauggcugacaaacucaugaaaagauguuuauccucacuuguuuuuaggacucugaaaucuaaaaugagcaaucuuaaauacagcaacuggcaaaaauguaaagcuccucuaacauccaguuuuaucucuuuuuuuuuuuuuuccauuuuguggagaaugagguguugccauguugccaggcaggucuugaacuccugggcucaagcgauccuccugccucugccucccuaagugcugggauuccaggugugagguuuugguaaggauggagggaacugagaacucucacacagucccgagggaaggugaagcuauggcgccucuggggagcaauguggcaacaccaaguagagcuuugaggcucauuccacugcagcccugcaugagagagagaggaagcagaaacaaaucauccccaagaggggaacagcugcagaguggguuauucauacaacacaguacuauacagccauccagaugaacuccaugugcguguacugauguguuuaaaguggaaugaaaaauacacauagaagguaucacauguugcgcucaucuuccugcaaaauuucagacaacaaaauaauagucuaugccguuugugcacacaucugucugcgguaacuacagaaucacagaaagcagucuuugcuguagaggggugaugggggacaggguaggggguaggcagaggcauucucuguaacaaauauauauuuuuaaugaagagagacauaugaagucaauauggaaaaaaaaaaacaguaaugaauuggaggcaaggaaguagaaaugccuuuucugaagaucugauauaaaacagaaaauaggguguauaucagcauuacgcugauucagcagaagauagcaaaauguuauaaacauaacaaaauauuaaaaauguaguacaaauuagagcugugagauuugaaugaaguacaaaauuaaacauuuuuauuuuucggucucaaaguauucaacugugauuguugauuuguucauugcucccauuagcuauuuuaacuucauauaucuagaagcuguuccuguuuguggacgcuguuauuaggcacacaaacacaacugacccuuucgucauaacaaagcauucugcuguguuuuuaguaauacucauagagaagucuacuuugucuaaucuuaaaacagccauuucagcuuucuuaugguuacugucuccauaauauaucuucauccuuuuaauuucaggcuuuuuuugugucuuuguauuuaaagugugucuuguagauaccauauagcaauuuuuuuucuuuuaaauuagucugacaaucucuaccuuuugauuggaguguuuagcuauuauucauacuuaauguauuugcuugaauagcuggauuuugcaauuugguuucugucugucucaucuguuucuuacucuuuacucccccuuuccuacguucuuuugugcuaucaaauauuauuuaguauuuugguuuuuuucagcuauauaucacuguauuuucccccucauauuugcccuagagguuauaauaugcauucaaaauugagcauaauauauuuggaguuaauacugaauuacuucauguaaaacaggagaagcuugcaagacccuacaguaaguccucacuuaacucacugauagguucuuggaaacuccaacuuuaacugaaacaaaguauaauuuugucuccucaaugcuguaaugaaaagacguugaaugaaaugacauuauuugaaugauguuuugcuuaaaguuggaauuuccaagaaccuacugacaagguuaagacuuacuacaguuccauguaaugucuucccauccacugcguuacuucugucauauuuuacaccuauauaccuuaaaagcucaacaauacaauguugguuuuucugugcucacgccuguaaucccagcauguuaggaggcugaagcaggaggaucacuagaggccaggaguucaagaccagccugggcaacagagcaagacccccaucucuaaaaaaaaaauaagaauaaauaaaaagaauuagcugggcaugguggugcaugccuguagucccagauacuuggaaggcugaugugggagggucacuugacccaagaauucgagguuguagugagcuaugauugcaccaaugcauccagccugggugacggagcaagaucuuguugcuaauuuuuuuuaaaucagguuuuuaaauaaauuaagaaaaauauaaugaaaaugcauaguuuuugccaguauuuaaggaguucacaauuugguagaagcucuuaauuuaugggggggaggccacagacucccuuaagaaacugaggaagguuaaagaucuucacucuccuguccaugccuucccugcccccacaaugacaaucagacgugaguauacacucacaaaacuauguauucaauuucagcaggaccauucugugaagaauauggauaccccacccaguaauaaacaaaaauaggacugcaaauucuggcagggaaguagggcuuuuguguucaucugcuuacauuucuaucccaucuaucuaaauguaaacucugaauggggaagauuuggguugcuuuugaucacuacuuggccucugcacuuagaacagugucuggcacauaguacuguaaguauuuccugggugaauggugaauuaacaaaugcuccacaaaaauaaauacauuaucuuagauccuuuuaaaggaaauuggaaaguuaugcauucuuuuuggucccaaguuuauacuuucccauaugauaaaagauaaagaguucacuuguccaugucacuggcacgccagcaugaccucaaguugucaaauaaagugcuacugcacaauguuuuagauuuucacaaaggauuaaaauauaaagugcuuaaaacccuagucuauggaaagaugggacaaaaauaauuacauuagauuucacuuaauuacugccaaaagcuuuuagagagcaucaguuauuauaauacuauguuacauucacacauuauuuuuaauuuuaauuuucauuaucucucucuuucuuccccccccagagacgggguuucaccauguugcucaggcuggucucaaacuccuggcuucaagugaucuucccaucuuggccuccccaagugcugggguuacaggugugagccaccaugccugaccuaauuuucaugaucucauaaaccuuuuuuacacuaggucuucugaaugagcgaguuuucuugaaauccauagacccucugaaaagcaggcuuuagaaaaagaccauauguuggauuugugugucagggggcugggggaacucuaccaaggaggucuugcaggcccucagaccuggguaagccaaagagcaaacggaggggccacugaaaaagaaggcagcaguggcgcagucuccggcaggcaaggggucagugcaggacgaucagauaaagcaaaaaggaacaaagagcauaugcccgggaagacaagcucgaguuggaguuugagcacuugggcaacaggaagcaggaacccuggcuaggaaaggggacacauggucacgcaaccagagaaccccuggcccacguccagcugagagucuaggccaaagacccacgcuggcuccaggucagagggagcagccccccauaugccaacagcagaagcugugacccuguaagucugagaauguaaggcaagaggaaaugauuuucucuuaguccacuaauaaacauggacgucaauuacacgguucuucagauuuuccagaugcuucauccuuuuaggaagggaaucaugaaauaaugcucaucaggcaaauaauuuaauuugcuggguagaaaacaugcaaaacacucuugauuauagagaguaaacuucaacuguccucugguccuguuuaguacuagccugaaaccacaacaggcaaagguuagaaacuaugacuuugcaaugacacacaggugucgauugcuuucuuuggccaacuguggcugaacaaaaacccacaaggcaagcugugccaaccaccggucccacauucaagaaaccgaccaucuacugggacaacaggacaaaccuaggggcugcuuucccaggggcaugauauugccucugcaugacaaggaacagccaaaggaauaaauguccccuugcaacugagccccagcacauagacuucaugugcccucaaggccugugguaaccagacccaccgagaccucauuuauucauuccacaaauauuuacucaaugcuaauacgugccagccuauguucuaaacacugaaacauaguaaggagcaaaacagaaaaaucccugcccugaugcaucuuacauuuuccuauuccuucuucuccaaugaaaauguuagagaaagcauaagggaacuuuguacauucccuaauuuauuaccccaagaaugugaaugcaaauuagggauucccaaaguuauuucugccauuugucauacauuuugaaaagauuauucuuuucaugacagacagaaccaugugccuuuggcaguuacucugagacuugcuauucuuuaagugcaaaagugauucagauugaacuuucuauagcuuuucuaucucauaugagggaauagaaaugauacuaaauuaaaagauuuugagguacccaauuaaaaugcuggauauccuucugauucuuggaaaaccaaauuggaauagagacagaaguaauaacacuaaucacagauuauucguuucucacauacugucuuagaaaccugcucuaggcuuuuccuuuugggaaaucaugcaucaggaggauuaggucaacuaugcuaaguagaaaacuucaaacaacaguggcuuaaauacaagagaaguuuauuucaccuucauauuuaaaaagcuccaaacaucuuaacuguagucaaagcagccagaagaaaaaaaauaagaaaggacaaaaggcgacuuuaaggagccuucucagaagucacacaaauauguguguuuacagcucaauggccaggacgccaggacuuagaccaguggucagacugagaggcgaaggauaagagauacgugaucucagcuggaggcauugcuggcucaaauaaaacgaaccuucccuuaugaaggaaaaaauauacuggaaggcaacuagagucucuagcacauggagaaaaccaucaucagguucuuauauguaaacaaacaccuucuaauauccauuuuaacaagcggaccauccuccuuuaaaaguuacaugcacuuucuuaaauggauucaaaaaaugaaaaauuaauaaaaauaugggcuuauuucaguugaaacucauuucuuaccuuugaugaaaaauaacaaacuaaaagugaaugugaagcucuaaaagauuuguggauuuauagauacagccucaauggugaaaaacucaacguuuuccaucuaagaccaggaagaagcaaggauauccauucaccacuuuuauuuaauauucuauuagagguccuagcuaguauaauaaagaaaaauaaaagguacaaauugggaaagaagaagcauauaaacacauaaaacuuauuucuggaugacacagaccaccuauguugaaaacucuaaggaauccacagaaaagcuaccagaaauaauaaacacauuuagaaaaguugcaggacacaagaacgaaauacagaaaucaacuguauuucuuuuuuuuuuuuuuuuuugagaugacgucucacucugucacccaggcuggagugcaguggcaugaucucagcucacuacaaccucggcgucccagguucaagcgauucuccugccucagccuccugaauagcugggauuacaggcauccgccaccaagccuggcuaauuuuuguauuuuuaguagagaugggguuucaccauguuggucaggcuggucucgaacuccugaccucaugaucagcccaccuuggccucccaaagugcugggauuacagcugugagccaccacacccagccaaucagcuguauuucuacacacuagugacaaacaauugggaaaacauuuauaaaaccaauuccacuuauaauagcaucaacauaccagaauuacuuagaaauacaucuaaugaaagaugugcaagaccuguacauugaaaauuuaaaaauugcaaaggggaauuaaagaagagcuaaauaaacguagagacuuaucacguucgugcauuggagaacucaauacuguuaagauuguuguaguagcuguugauuacugagcaacaaauuaccuaagacucaguggcuugaaacaauaagcaucuauuauccaauuucugugggggcaggaaugugggaguaacuuagcugagugguuauggcucaaggucucucaugaggcuguagucagucaaggugucagccuaucugcacucaucucaagaccugacuggcacuggaggauaaccuuccaagguggcucaaaaacacaccuagcaaguuagugcugacuguuggcaggaggccacgauuguuggccauguggaccucuccacaggucugcuuaagaguccucauggcaugguagaugggcuccccaagggcaagagauccaggagagaguaaagacacaggacuagcugugucuuuuaugaucugcucuugggagucacauuccaucauuuuugccacauucuauucauuauaaguaucaccaaguacagcucaaaugcuagcagaggaaaaauaagcuccaccucuugauguguaaaagaaucuguggaaacauuuaaaaaccaucaccauggcaauccuucccaaguugaucuaaaguuucaacgcaauuacaagcaaaaucuuaacucuuuuccccuuuuuuugaagaaauuacaggcugauuguagaguguauauuaaaagucaguguccuaaaauaagcaaaccaguuuuaaaaaagaaaaacaaggugggaggacuuauauugccugauugcaagacuuaccauaaagcuguagucaucagugcagugugguauuggcguaaggacagacauauagauaacugggaaagaaaagagucaagaaauaaaccuauacuggucaacugaguuuuggugccaaggucaugcaaugagaaaagggucuuuucaauaacugguaauggaacaaaugaguaucuguguggaaaagaauaaaucuuacccuuuaccucaaaagaauuauacucaaacuggaucacagaccuaaauguaauagcagaaacuauuaaauucuugaagaacauauaggagaaaaucuuugugacauuggauuagcaaagauuucuuaaauagaacaucaaaagcacaaacuauuuuaaaaaccaguuaacaaugaauuaaucaagauuuuaaaauuuugcuuuuugguaacagacaagccacaaauuagaauacaauuuucauaaaacauguccaacaaagagcuuauaucuagaauauauaaagaauuauuuuaagucaguuagaagauaaauagcccaaugaacaaaauggauaaaagauuugaacagauauuucacaaaagauaugaaaaugaccacuaagcacaugaaaaaaaaugcucaacaucacuaaucauuagagaaaugcaaauuaaaaccacaagauaccacuacacacccaauagagcggcuaaagcuaaaacaacugacaauaccaaguguugacaaggguguagagaauuuggaaguuucaaacaucgaugguggaaaugcaaaaugguagagccacuuuguaaaauaacaugguaguauuuccuaaugucaaauauacacuuaccauaugacccagcaauuccguuccuaaagaaggaaaacauauguccacacacaaauguguacacagauguucacagcagcauuauucauaauaauccaaaccuggaagcaacucaaauguccaccaauuggugaauggauaaacaaaguauggugcauccauacuauagauuaauacuuaaucuauuaauuguuacuuaauacaauaauaaaugaaaaauuaauuuuaaaaauuggugaaauuuucauguucaagugaaagaaguaaaacacaaaauacuucauauuauacaauacuaaguauaugaaauuccagcaaaggcaaaacuauaauuacaugaagaucagugguuaccugcggcuggcagcuggauguggggaaagagcauggggcaugaagccaccauucauggucaggagacugcuuuccauauugauuaugguggugaguacaugacuguauauaacuaccaaaguucaacgaacuauacacuuaaaauuggugaguucuauuguauguaaauaacaucuuaauaaacaaaaaaagggaaaaagaaucuuuuaauaaaaaagaaugugaagaucuagaaagaucucaaauagauacauaaaucuuuuaaauuuuauaagagguaggauuuuagcagaacaaaaacaagcuuuuaacaacaaaaaacuucugcugcuuugaaaauguucucagcuaucaauauaagcuaacauggaagaccuuugauaacauccuaugcuguuguuuauaaauaauaaauaaauucaaaacgacauguuaauuuuaccauagucccuucccagaggcuaucaucaagacagaaggaaaauaucaacacagucaguccccgaagacaaacacuggacacuuaaacacacacacacacacacagagagagagagaaaaaccaaaaaccaaaacuacauauaguuuaaagagauaaucaaaacugaugaaaaaauuuuaauuuccugauaaaaagacaaugugaagacccaugggaaaauguucuguccugcaacggacaugauaaucuaccaguaaucucuacaauguaaaaguacggguguuucuuggcaaccucuuccuuaucucuacuucuuuuuccuuuauucaguaacacuacuauaccagccuaauauacuuuaaauuauccuuuaaguuuucucugaauguuucuuuacuucagauugaguaugacaaugcaagaaauacaagacagugaguuugcugaaggugagguuuaagcugaguuuuuaaccaagcauggagagaggaccaguuaaauaucuugaugauuuuagaagagaaagcauagcuauaggccacauucuucauauuacgaagaaaauagagucugcuaaugagaaaaaauuuuccuuggcuauuggucagcacacagaaggcugcaaaaaguugucgauuguguuuuucagggccucuggggacuuugaaaaccucuucauacccaagauugcccuccagaaucaugucuccauugcugaugaauggggccucauccuagugguguggcuaagggaaacuuuaagaauaacugugucugugcaucucguggcuggaagagacauggaugagagccuugagaugugcaguguaaggugcuggacucacugggccuggagcagaacaccuggccuuuguccugguucuaccacccaucauucaugcaaccugaaacucagccucccuaucuuuaaaauaggcaguccagguauucuaccacuauagagaacacaucaagaaccuaguaaggcaguacacauuguaagcauccugacaaucauguaguauaauguuuuauaguacagaaauuauuuuuugauaauauuaaguuuuuaaacuaaaaaauuauuuuuagaauguguaucaaguagacauugugcuaggcacugaagauuaugaagaauaacauagaauuccuauaaacuaaaaggacucuccuacaauucaauaccaaaaaacuaauaaccuaguuuuaaaaaugggcuaaggaccuaaacagacauuucuccaaagaagacauacaaauggccaauagguacaugaaaaaaugcucaaugucacuaaucaucagggaaaugcaaaucaaaaccacaaugugguaucaccucacaccugcugggauggcuauuauaaaaaaacaaaaaacaccaaaagacaaguguugguuaggauguggggaaaacuggaaccccugugcacaguuggcagaaaugcaaaugaugcaacuauggaaaacaguauggagguuccucaaaaaauuaaaaauagaacuaauaugauccagcaaucccacuauuggguauacauccaaaagaaaugaaucaggaucucaaagaggucucggcacucucaugucaucaccauguuauuugcaauagccaacauggggaaacaaccuaagugcccaucaacagacaaagggaugaagaaaaugugguccaugcauacaaugcaauacuauucagcccuucaaaaagaagggcauuuuguaauaugcaacaacauggaugaaacaugaggaccuauaugcuaagugaaacaagccagucacggaaagacaaauacugcaugauuccacuuauaugagguauauaagauagucaauuucacagaaucagagaguaaaauggugguugcuaggggcugggggcagagggaaaaggagaguuaaaaaucaacaggcauaaaguuucaguuaagcaagagcgauaagcuccagagauucgcugcacaaccccauaccuauagucaacaauuauaaacugucacuuaaaaauuuaagaggagagcucucauaaauaaagucaggacugacucaggaaaaggguugggccaggacuuaaaugaguaagacuuccuagaagaagggauaugugagugaaauaggggauauaguuggaagaaacugcaugugguuaugcaaagcuaucuuuuaagagcauagacauaggccgggcacuguggcucaugucuguaaucccagcaauuugggaggccgaggcggguggaucacgaggucaggagaucaagaccauccugccuaacacggugaaaccccgucucuacaaaaaacacaaaaaaauuagcugggcauggugacaggcgccuguagucccagcuacuugggaggcugaggcaggagaauggugugaacccgggagguggagcuugcggugaaccaagaucgcgccacagcacuccagccugggugacagugagagacuccguaucaaaaaaaaaaaaaaaaaaaaaagagcauagacacuaaaguuaugcuaccuacauuugaauccugucuccacuacuuuucagcuaccugguguucuuggcaaauuacagucauguguugcuuaaugauaaggacacauucugagaaauguguuaugugaucuggucaucgugugaacauuacagaguguacuuacacaaaccuagaugggauauauauuuucauuuauauauauuuuuucauacagaaaaucaaguguucuggcaccaugacugaauaucagucauuuccccuacuugaucugcagugccaacacugagugccauacaccagguuucuaccuaugcuccauuagaauccacagggccaccacugaauacgcacucuguuguugaucaaaacguuguuacgcagugcaugacuguaguuaauuucccugugccucaguuucuucaucuauaauagggagaauauuccguaguuccucagguuuuuaugagggcuaauuaaaauaauguuuguaaagugcuuagaaaagaguacuauuagucagcuuuuucuaaguuauacugugguaacaaauuaucaaauuucaguagcuuauaacaaagauuucuuuccuguucaugcuacauguugguacagcccugcuccauuugacuucuucauucuggagucugaggagcugccccucuccgggcccugcuuuucucauggcaaaggggacagagcaaugguggaaccaggcaguggcucuucaagcuucugcuuggaugaagcauuugucacugcuguucauauuuuaguggcuaguguaagucaaacaacaaaaccugaugucaacagggcaugcagaggcccuauagggagggcuucaguagagaggggcagaacauauuuugaccaaauauauuugaacaaacaaaaauacuagaguaaaaaaucuaccacaagugucugguacauacuaagugcuguguguuuguuaaagaaaaauacuuguuugcacaaucauacagaauccugaaaguggauguuugggaauggauuguguguaguuggaguguaugguucacagaagugacagggguaggugaggaggucgcauuuugaaaggaggcuagauuuuugccuacagguagaacauaaguugcaauaauaaaauuuuauagcuauuuuuauaaauuuuauaaggcaauucuaucugccagcuuuauuaagacaauggcaucauuucauuuauucugcacugagcauuuaaaaaucacacgucaacuggucgcuaccucccuguguuaacaauggccuaagacaccauuugucauccugggccugaguugcaauugccacaaggaagaauauauuaauagaaggcuucuuccaguuaguccuggcucccuguggucaggagugggaaagguagcauagagagggagggaggaaaaaggagaaaagggaguguauauggaugagucaacgugaaugugagugugugugggguguacauuggacaagcacugacaucacacuugcuauuuuaauuauaaggcacccuccaaauuuggaugcuucuuaagaaccugcuacuugucuucaacuucuacaugugguccuuucacaagucccaucacccucauggcuuuggucagccuugaaauuuuuguuuguuuguuuguuuguuuuuuguagaaacaggguuuugccauguuggccaggcugguguugaacucuugggcucaagcgauccaccugccucagucucccaaagugcugggauuccaggcaugagccacuguaucugguuagccuugauuuuucuuugcaguuccuguccucauuuucaaugaacuacuagaaaauaauccaaaucucuaaaguaaguuuaacugggaggcuugugcaucagaggaguuaucugagcugcuaccuauaccacucuuuggucaauggagaagcaaucuaagggaaaaaagguuaaauaggagaaaaggaagcacggagagaagagagagcugggcacaagcaaaggcggcgcagaggaacucacaccuaccaucccucgcccagaagcaggccagggccucaaaacauacucuaaagaugcuuaugcuuccacagcagguuaugcuguuuccauuuguucacaguuacuuuaagacagugguuuggguuuuuuuguuugucuuuaaaaguacuacagagggaagagagaaaggcaaaucacagcccgcaaaugcgcugucuugacucccuccagauggcucauuuucccuaccccuguccuaugaucuacgaacccugauaaggcuucuguaaucuugcaccaucguaaaguguuucuucuugaagugcuuuaaagauccccacuccuuacagaaaacaauccaaacucagaccacauuugaagucccaaaucuuacuuuuggguguaacagauuguuuuuuuuccacacuaaggcugcuggaucagagauaaucaaagucugauauacuguacaugacaaguaacgaaugcaggaaauggguacagugaagggcugcguugaagggagaagucugaggaauauaggccuguuaauucacucucaaacagcuuaaaagagggucaaguaaagauaaaugugugaacuguaaaaagaaaauuggcaaaagaaggcucuuucuauuuuaaucaugccagaaucagaucaguccugagaccucggcuuuugagaauuagggugcaucccugugguaaugacucaguacuaugauucauaaaacuguagaaaaugaagaaguucugagauguagauggcucaaaagcucucugcagaaccacaagaagaauuuaaaugaaguucaguaaguaagcaaugcuuuaaggaaaaguauuaauguguaagaaaauuaguggaauuaugaauauguaaagacugacuucaauuuuugaaggucucucaccagacaucuagaagaacaguugauacggucacugaaauguugaaguauuuguuuaaacugauauaugucacuuggcuguaauagccaagcuuuccaauuacaauuuugcaacauuucaugaaaaguccuauuuuaaauacuaaauguuugcauuaaaaaucagaacugucaaaugaggaaaaagguaacacaaaaacauuuaucaaugauacaugugaauaaucuuacagucaucuuuaaguacaagagaaucccccucaccuuuccugggcagcagcuggagucucuacuggauaacaaaauaggacugaggucugacagccauccugggcaaacuaacuuacuauugcuccuguaagcuaaaaacugucuucccucaacucagaaaaaugauuuaguuauuuucugugauaucacugaagauaaaaaguggucaacuuaccuaguaaaauacuguacugacauaauuuaucaaccuucuauuuuaaucaguggaauauuuuaaaguuauauauucaaagacaucuauaauuaugcaagaauaagggacaccgaggagagauuaaaaacuagccuaggccagacacgguggcucacgccuauaaucccagcacuuugaggcagauggauccccugacgucaggaguucgagaccagccuggccaacauggugaaaccucgucucuacuaaaaauacaaaaaaaguagccgggcuugguggcgugcaccugcaauuccagcuacuugggaggcugaggcacgagaaucacuugaacccgggaggcagugguugcagugagccaagaucaugccacuacacuccagccugagugacacagcgagccugucuccaaaacaaaaaagcuagccuaaacaaaauaaaucaaccaguaccuagcuaaauaaaauaagcucaauccaaaguuggcagcuuuccagaaaagcaugaguaaaguuuuugguuucuaugacagcaaauaacaaauuacucauguuucauacaaauaucuuuguuuaaaaaauacucuuuuucuuaaaaaccacauuaauugccagaaugaaauaaaaucauugcuuaacacacaugguuaagugaauuacugguuucaauacuaaaaugugaaaucucaucaacagguuuuguaacauuccccaaaacacugaauaucaucuauaauuauaauuaucugugcauuucuuuugcauaguaagaauuuuauuuuguuaguauuuuauuuagcauaaauaucuccccaaaaagggaagucacuugaucuauaaaggaagaggggaagucauguugagcaagagacaucuggaauaggcagacuguggcuuugugaaucucaggcuuggauccuauagucagugguguguaaaucaaacacucacaaauaauacugauauugucuuuuacaaucuuccuuaucuaaaguaugccacaucacaguaaauauuucauaauaaaaaugagaauuuucuagacaaagaaagaaaauguuccuuagguucaaaacaagcaccaacauuuaugguauaggaacauaggaaaacuggccaugauucaugaauauuaauuauuuuaaauaaacagucaucuaauuaugguaaaauaguaauaaagaacaagguuaauaugaagauuuaucagauuuuuugucauaguagaaggccgguaacuuuggcugaaucaaugacuguaaaaggcucagaaauguuuauuauuaguaggguucuuuaaaaugcuacauuaucuuugaauuauauuccaaacacacuguaauucuauucacccuucugaaacaagggauuuuuuuuggucaagaauuuuauuuuaaacgucugauuccuuuuaaaaaguuaaaacagguaccccacuaccuguuaaacauguguaccggaaaagacuauaaucauaacauauaauuuuagauuuuaaaaagacuauaaagagaugaaaaaugcaaccuccaauuuuagugcacugaaugucacacaaugcaacuuucugaggagacagcaggcacuuaaagcuaggagucuaaaaaaagaauaaagaaagaaaauggaauguguuuuaaaaaacugagucacauaagaguuacuaaggaaggggacaaauauggagaguaaaagaauuaauaguaacuaacacaaugaaaucguauacaauaagguacuucaauauuugaaugcuuuuggaaaauauuuaaaacagaacucaaaaccauuacugcuaagugaaacaaauaugccauggaacaaacaguacauccucaggcaucucucaugaucaaagcaaugagcuccuucuuugcuguucucaggcugguuaagucuuccucagucacgcaacaguucuaacugggugagccuagacuugggggagucuggcaccugugucccagagaaucagucuaaccccaggauggcccuaagccaccacaagucucaagaauaccagacggauagcuuagguguuuugaagacuucacaauaggguuuagcucugugguccugaagccaaaucagguaucuggguagaugugaaaauuuuuagggaggagaaaacaaagugacuuggagccccagaauauuggcugcaagcauaucagcuguggggaacaaaggcgugaauuuuaagcaaagaaugaacacagaaaaggaauaauacagagagcuuaaaggaagaagagggguaagcaggcguacaggaugacacacuagccccaaauaccagucauucacccaagaaacaaggauagugauaauuuauuugaaauguguacagugauugcagugaaauguguauuauuaugaauccauucugucauuuaagucuuuucuaagaaagaaauaaaaucuaugcucuauaaccgcuaguuaaaauuuauuuuuauaaaucuggagguuuaaauuuaagucauggaugaagaauaaaacuccacuucaugcucuaauuuuuuuuaauaccucacagagaauuuaggacaaacgcuuauuauuaaaauacaauagcauagacaagaugaaaaaauuccagcaaacauacugagguugcuugguucauucccuucuuccaugaugagacuuuggucagguccaacccaccugacuuuccaguuggcauuauuuuuuucccucgugugacaaugucuuuuuacaaaaugagcagacuaucucuccuuauuuuuaguaaguccaacuucuucauuuucaggcuuuuuuuuuuucuaugauuuaaaaacaacacugacaagcccagcuaaaacuuucaucaaaauuaccuugaaagcacaaacuggccuccuuugucucaauuuucccugugacuggccuuuuuuuuuuuuuuuuuuuugagauggagucucacucugucgcccaggcuggagagcaauggcgccaccucggcucacugcaagcuccaccucucggguuccacgccauucuccugccucagccuccugaguagcugggacuacaggcgccugccaccacgcccagcaaauuuuucuguauuuuuagcagagaugggguuucaucaugucagccaggauggucucgaucuccugaccucaugaucugcccgccucagccucccagagugcugggauuacaggcgugagucacugcgccuggccgugacuggcccuuuuuaaucaccacagaaguaacauugagccagaccugccauggguuaaaagaauguugagagccgggugcagcggcucaugccuguaaucccagcacuuugggaggcugaggcgggcagaacaccugaggucaggaguuugagaccagccugaccaacauggagaaaccccaucucuacuaaaaauacaaaauuauccaggcgugguggcacacaccuguaaucccagcuacucuggaggcuaaggcaggagaaucacucgaauccgggaggcagagguuguggugagcugagaucgagccauugcacuccagccugggcaacaagagugaaauucugucucaaaaaaaaagaauggugagacaguugaauaugacgcacaaucuaaauaggacaauuuuccuaauguuuuuacaggagagagagagaauuggguguaaaaggguagucacacuuacaaguccacuuauggcuacaauccagauguaggaaccagaggugaaaagcuauaaaagaaaaaaaaaaggcaacuaaaaauaaaauucaacugccagucacagcacacuuauuuuuacauaacuauagucaugaccauuuauauaaaguauuaauuauauaugccauaauacagagaagcaaauggaaaauuaguaaauaucaacuguuacuuaaaagaaaauuauauauuaauuuuuuuuauucagacaucagacuuuguauagccuaaaacaaguugaaccuggcccacaccccaugcaaagaaaaauaaaugaaacccaaguaugauguuauuuacaaauuucaacugacuuaaaguaaaauacuacauauaaagaaauuauuagaauuaacaacauacaaaacagguaaucaccaucccaugcuuggcaaugaugugauauuuauguaaauaacuuucucauuuuaauuucuuaacauugucacccuaaauuuagaugggaagaacccugccagccuacuuaggucuauguccaaugguaacuuucucaaguguugauauucucauucuaguucacccaaggaagagcaaacuaaauaacagaacaaaguuaauuaauggcaaaaguaauuagaauuagaucucaugaaauucuucccuuuguuuuccaaaucguuuauaucuuagaguugugcucaggguaauuaaaaaaaaaucauaaggacucugaaaguguuccugcaacaaagaaaugauuuguggguuauuguugguuaauuuuuagaacuucagauuggggguuuacuucugauuguggaagaagaggcaggauacucaggcaggacagcccagguucaucgcuggcauugugcuagaugaaaaccucaaaguucugcacacuuaccaaggacacacagaaagaagacagacacaaaagguaagaguugacacacucagauaaagaggcuggcaagcuuugcucuagugauaggcucaguuagaaaugagcacaggcugcaacuuuaaaucugaaccuuugauguagcacggacguuuguucaguggaaaugacucugauaauaauaaggauggaaccauguagacaaauauuuugcuguaauuuucuucuaaaaauagaaagaauaacagacuagcuaacacuuucuaugugucaggcauugcucucaaggcacuucaguaaaaccgagugguuaagcaauuugccacaggucaacagcuagcagguggugggcuggaguguauccaggacuggcucuacagccaugcucuccacucuuccaggucucauacgcaaguaaaaagagcguaucauuuugucauugaaaaaguaauuuccucuggguucugaagccucucauugccugugugguccccauuaugucugccuaugucuucacaguaucuguguguuuucucauggcugggcuccuugaggacaggggcuacaucucacccagugggugauacugauuuaaguauuggauggcuugagagcccacaacgucauagcccauugcacagggcaugauguuaugggcucucaagucauuggauacuuaaaugagccuuaagcauuuuggcucuuccgauuaugauucaagucuucauucauucauucauucauucauccauucauucauucauucaacaaugucccugguuguaguggggagagacaaaggcacagaaacacaugcaaaggcuuggaggggagggaggcagguggaggacagacauuuuagcacaaaggaguucaguuacacuccuucaaggugggcacagggggaguugacaccagacagucaagaagaacccugcaugccauucaugcuaaggaccuagauuuuaucaaggaggcaaugaggcaucuccaccucuauuuucugaucucaacuucucccucucaaaguuaccggaaauauuacaaaaauauuggaaauuuauauuauuuugaaaaacuauccgugguaguugcaucuaccuuucugcuuucggcagggcuaagggggaucccucauggugagcuguguaacacuguggaaacggcacuagauauuagguugguggaaaaguaacugcaguuuuugccuuacuuuaauggcaaaaaccgcaauuacuuuugcaccaaccuacuacaauggccccgugaugaaggccaugcugugccucuucauccaacuaagacccccuuuccccgagagaugaaacauacuacuugcuuuaugccaaaaacaaaacaagaaauacauuuacaaucucagaaaaaugaauagugguagcuauagagauauaaauuauuaauuaauaguaaccaauugacuuaacucuuauuaucuguucagauuacacuaaacacuucaugcuaucuuuaaaauaccucuguaagguagauauuaucauccccauuugauagauggggaaaugggggcucagaaaaaguaagugacaaagcaaaucauuaccagaccaagucauuaaaccgaaauucaacaaccuggcuccaaagacuuuccacaaugccacacugaacuccuacuccacaauuaauaaaacaguguuuucauucucaaagauucuacauagcuuuagaguuggaagaacuauacagugaaugugaggcucagaggguuuccaugacucaacccaagucucauggcuggagacagccaugcuaggacuagaacuugggucuccugagggaggucuggagugcucuucgaauuccacauggccucugucacaacaacuuuaaaaauauuaaaucugcuauagcaaauccuacucauaagaaucaaaugcagaaacgggcuauuugguuacauggauaucagguaggaucagggggcguguaacgguacggggguugagagauggagaauaaaaagauuucaugagaaacgguuguaaaagugguaagaaaacgccccagaugagccauugauaacacaugacagcagacuggagaagugagaggaaaugcuaaagguuaaaaggggagggaggaaggcauucugaagugacgccaguauccgguuagagugcgugggauaaggaauguuaugaguauuaaucaguggaucaaaaggccaagcgacacauggugacacaggaagcuguagaauaaaacuacaucaaaagccgugagaguaaaagaaaagugacagguaguacagauagaaaacugaaaaucauucuccuaccacagaccuggagcccagcagggagcaauugacauucgcugaggauuggcaaagaagcuuuucaaauguaaccuggacaguaguacucuaguagucuucacagcaaaccauuuagcaaauggugacgcuaccaucacagcuucacaaacaaggaaauaaucaagcugacaaugcuucuugaaaaccccaaagcucggguugguagagcacaccggguuucuucuucagagcuuuauuugcgacacuguauucaauaaauuaauuuugacacugauuuucuacuuucuacuuuuugauuguucucauuuguuuccacuucauacuaugauuguuaaaaaguacgcacaugcaauuguacaaugaaaugaaaauauuuuccacagauacaaauuacagugaaagcucuuaucagauuucuaaagacuaugaaaguauucuaguaucuucuauaccuugauguucuuguucuguaacacuuccuuuaaacauuugauauagaucaugaagccaagauuauggggggaaaaaaaccauuguuuucaaggagaucaaaugagaaaaagaccaaaaaaaaaaaaaaaaaagaucugguuaaagaaaagugaacauaaaaaugcauacuguaccugcagucccaauauauaaaucaaugucuuguuugugauggacaacggacccagaauuugugccacuuggacucuugguauggagcaguaaaaugguacaaacagagcaaacacaggugccaggcuaugcaaacaaauaaaaaaaaaucacuauaauagugaauuuuaaacacaaauggcagauguaucuuugaaguaacacugcuuauaauuuuauuucagucugaaagcauggucuuagauauacauauugauuuucaaauaugauucauguccaaaauaauuuguacuuauagaacacuuuaugaaaacucuaaucauucuauccuuauugacccuccugaaaccacugcaaagaagugguucagcaccuacuaagugugagaaaaguggaggcuauguuuucuucccagguauuacuaaaaucuaaugagagaaacuagacaaaucgaaagcagcaaacauuagaauucuucagucaaauccaaaagccucaucucaagcccuguccagugaucugucgccauggcacuggcacgguucaccucuggcccucccuuccucacauuccuuccucccuuugucugaaacccugcuucucagugguugcccagugauuucuuacaccacucuucuggcuucuccaugguuccauuauagccuuuucuucuugcucucucaucuccucauacaaucucaacccuuucuauagcuugggcuaagaaaaugaagugagaccuaaaacugccugcccaccccucaccugguucugaaugucaauuugacaccuucaccuugacagauucaaaagucuuaugugucuuucuacuuacagucuugcuucucucuaauccauuucuuaacauuguuggcaguacucucuuccuaaaauacaacucugaucacaacacucccuugcuuaaaaacccuuccuuccggccgggcguagugucucacgccuguaaucccagcacuuugggaggccgaggcgggcggaucaugaggucaggagauggagaccauccuggcuaacacggugaaaccccgucucuacuaaaaauacauaaaauuagccgggcuugguggugggcaccuguagucccagcuacuacucgggaggcugaggcaggagaauggcgugaauccaggaggcagagcuugcagugagccaagaucgcgccacugcacuccagccugggcgacagagcgagacuccgucucaaaaaacaaacaaacaaacaaaaacaaaaaaaaauaaaaaacaaaacaaaaaaacccuuccuuccauaggcuccaguauccaaagauaaaaugcuucauaaagaugugauggcaaagcuccccaguucgcuuucaucacuggagucugccaccacuguccuccucucugcuuccccucaucuggcccaacacacacaaggcccucucaaaaauccacacagcugcucccugaacacgcuggcugcuuugacucuccacugacgcagguucugcuuuccacuuuccugccuaggaaacucagcuugugcaacacugcucagcucuucccacaagacuucucugacuccuccuggcagcugguggcucuccucguggcccccaagcuaugucaguuucaccacugcaaugaaucagugaaucaaaugcgugccaaggaugucacgguaagaugcccagcacaggagcuacaacuacguccaagagaaagaagcaguccuugaccucaaggaacucaucacaggacggaaaucuuacauuccuacaagugcuaggcagguaauaugaaugaguagagugguuugggcacaagcuugcaccuguuuuccauuaaacacuuggcuuaauuacucagucuguguuuuauuuucccacuuuugggaaaauggcaccagaaaaaaaagaauuauuucauuaucacgagaaaaaugcaaaacauauguuucacuucuacaaagaacuguccuuggugccauuuuuguggaaacacaggacccuccuggccucuugcgcaauuucucauccuugauagagacuacguuauuuuaaaaaaugcacuguccucucaauucuacuguuaaaaacaaaaccaaaccaaaauacaacacacacaaaacaaaugugauaaauggcagccgcaucaacugcuaucaacacaaacgcagcaaaugcuagaacagggaaaacuccagccaguaaggccuaagugcaggcacugugucaggacuggggacacagagaugugagauacaccuggcuagccauccagugagaaggauggcagggacuggguggcagacggaggugcacggcacagcggguuccuacccccacuugcccagucuagaauuccucacguaucaguccuucuucccaggcugagcaccccaggacagggaagaagaggcaguccugguucuccuagcaccuggcacaaugcuuggcacaguuuaggagcucacuacauuuagggccacaaaauaauccuuauucuagaacaacuguaugacucacauuugaauugacuauacagaguucucaaaaaccucccauuagauuauuaauucugagagaaagcaucauauuuuaucuagguuugccaaaugcagauucuuauacaugauccauauucaauauugguuggauuuuuuaaaauuaacaaagcaguuuuuaaauacuacacagaagaacugcuuuuguccaauuauaaacccaagcacaacugauuaaaacagcugggccuucuuuucauggaaaaguaugaguuagucacuccugggcauaaaucuuccaaugccuccccaccuacagucaugacaaagacgucccaggcccugaaucuccauccccauucugauccugugcuccgcaggacagcaccuucucagagagguccucccugacugccccauuucaaaccgcaccucccgcccucacagccuucccccucugcauucucuacucucuuccugacuguccucccccacagcacuuacagccuucucaucacugccuaucuaucuuaaaaguagaauggaagcuucacauagauggggauuuuggucuguuuuguuuuauucccacugucuagaauugugccuggcauagaguaagguuucaauaaauauuugcagaagaaaugaauuuuccuuuaaaacaguaaaaccauacagcagaacuugccuuuuguuuuaaaaagcccccuuccuuuuuaucauuuuuaaugggauuaaaacacaugguuucauauguagcucaaaauauggccugcucucuuggugauuauagaacccuauuuggggagccaaucgcaccagaggucucuuaccacagaacaugcccuuggaggcgcuuaauucauagaaguucuucuguuuacauuuaguaauaaaguacaaauagugauguuauaacuaaauaaccuaaagcagaguucuuuuuugagguuacauuucaacguaaacuaaaaaaaauacugguagaaauuuuaaugaccacaguuuacauuucacauaccaauagaaguuuaaaaacuccuuuaaaaauauuaaucacuguauaauuuuaaaugaugacuaaauacuaggccacacauacacauuucagaccaaaauuauaugggcuguucugcagaaauuuuccguugcuauuucuacacacacagacuucacaaaauaccauaauguuauuagucacugaccagucuuuuucuuuuccuuauuuuaugacaacaucuguucucuauacugucaacaguaauucaguuugaccuuuuucauacugugaagaacuaccuucuggaagcccuuucuggcuuaagcagaugaggcugguagcacagaaaagagaaagcagguuauaaacauuucauccauccuuucuuuuuuucuugagacaccgguaucugucagucacccaggcuggaguagagugcaguggcauaaucacggcucacuguagccucuaauuccuaggcucaagcaaucuucucgccucagccuccagaguaacagggacuacuggugugugccaccacaccuggcuaauuuuuaaacuuuuuuuagaaacagggucucgcuguguuccccacagugaucucagacuccuggcaucaggcaauccuccugccucagccuucugaauugcugagauuacaggcgugagccauugcuaauucauccuuuaaaaucacuaauauuuacugagcaucuacugcuauauauucaugaucgcacucgauagaaaacauaaaauaacagagacaccuuguuaagguugcaaauguccauuucacuucuucuauagaaaaggucacuggaugugguggcucauaccuguaaucccagcacuuugggaagccaaggugggcagauggcuugaggucaggaguuugagaccagccugggcaacauaaugagaccuugucuccacacacacacacaaaaaaauacaaaaauuagcugggcgugguggcaugugccuguagccccagcuacuuaggaagcugaggugggaggaucacuugagcccaggaggcagagguugcagugagccaagaucgugccacugcacuccagccugggcaacagagugagacccugucuccaaacaaacaaacaaaaaaacuguaaaggccaacucuacuuuuacaguacaaucacaacucaagaaacccugguaacuuucaacagcaauaaaaacaagguuugugagcucaugaaaugaucuaauauacagcuucagcggccucuuacaggauaaugaccccaucaccucuucuucaucugccugacuacucugauaucaaaaaaaaggggcugggcacgguggcucacaccuguaaucccagcacuuugggaggccaaugcaggcagaucaugaggucaagagauugagaccauccuggccaacauggugaaaccuugucucuacuaaaaauacaaaaauuagcugggcaugguggcauaugccuguagucccagcuacucgggaggcugaggcaggagaauugcuugaagccgggagguggagguugcagugagccgacagcacaccccugcacuccagccuggugagagcgagacucugucucaaaaaaaaaaaagaagguugggaggacagauccaguuugucagaggaauuacuugaacuagcugaguccuucacuauauaaaaauguuuuacuuaauauaacuauuucaaaauuaacaggcaaaaccccaccagaauggucuuucaacaaacugaaaaauuuaucaacagugucuucuucaaguacucugcagccuaaguuuuaaaugaacuaguucuagaauaugaugucauguuuauccaccaagucauaaaaucucuguauuacccccucauagaauuuuuguacuaggaauuaccuuggagaucauuuaguucaauaccuuuauuuuauacacagugagguggcggcccaaagaauucagcugacuugcuugaugcucuuucuugugucugacaauguuccuccauacucacagcacuuuagacguuagaagaaccuaaugacaucugugggaggcaaaagcuacucgacuauuuuuacagaauccuggagcagaaaggcuucugagaucacagaguuacaaauuccuaccaaaugauucaauucuguuuacaucaucccucaaaaucaucaaguuuacucaagcaucuaaauaagaaacagcauauuccauuuuucaaaauaaucacaacuuuugggaaugacucucaucuuuugauccaaaagcuauguccaguaacuucuuacugacccucccgcuagucucuggaguuaggaagacugacacaagcaauguaaacacuuuucuaugagaguuuccacaagcauaaggauaaugacccuaugccuacaaagcauacacauccccagcuuauuuaaucaguucuccuaagaccugcuauccaggccccucacugccacagguguuaucuaugucuucguaaaaagcagcacccagaaguggcugggaauggccagaucaguccugacuaaguguaaacaucaccucuccugaucugagugcuacauaucugguaauuuagccuacaaauaaacugcauucugacagacacguuaguugguuuaaacugagucaacuacaacuaugaggugaauggcaugagucucuuucacccugugcugaagaggcuggauuuuaucuauaaugggccucccuucaacuguuucccuguuauucaaguacucacacagccucugacucaggcagccucucgacugaaaacggcgacuaauccaguccacuccacauccuggacugucacucacccccacgccacagaaaccuguuucuuucucauaagcuguggauaagguggaauguguaaacuacucccugauaccaaguuuccagguaaaaagcacugucaaaguugacacuauuuuccuuaaaacauuuaaaaacccauacuuuuacaugcaaaaucaauauaaaaucaucaguaacuuggucuuuuuuuugguuaagguuuauugcuucagucucuuucaaagaauuuuuugauacuuaaaccuuuacagaaaaauuuauaaaguuccacagauaucaacaauucauaaauuccaaggggcuuuuggauaguuuuuuuuaaucacuauaaaaaauuucacuucccauuuaaaacaaaaaaaaacacaaagugcacacacguacacgaggcuaacugcucauuacaugcucagucacagggugacagagaaaaaaaaagucaccaccauaaaaggaggucugcacagccucucuuaaaacaacaugccacaguuaaaacuuacuucaguuuggacaacuacucacagcuacuacacagagacccgaacgagucacugauauguaaguacaagaucuuuugcuuuuucaacaaacuuuuuaaagaaaaacuuuaaaagccuaaguuuuaagguaaaagguaaaaaggaaaacaaucuauuuaagaacaagcuaccaucacuucuaacaaaaauuauauuaauaauguaaguuuacucucucugcugacugguaggucuaguuaguucuuauaaaguugacugaaagcgauggguccaccagaaauaucuuugucaaaaaauagggcucacuucauguacuacuguauaaacucacaaugacaaaagacaguaucaagcaaaacuaugcaaauaaugccaauauuucaggauaacuuaguaugaaggaaaaggaacaaaguuauuuuaauauagaauauuccuaugcuauaggaauuauuagaaauauaagauuauuucucaggauagaaucucagggguagaauuccuagggcaaaggguauauuuucuaaagcuuuagauauaaaacgguacuuuuuggucuacaaaaacauuuuaccaauuuacccucccgccagcaaagaguaccaaucuuugcuuuuuaaaugcuaaauacuacuaauuagauaagugaaaaaaaagucuguugugugguuuauacuuguguuuacuuagacuaaacguaucuuuucuaugugccugaggggaaaaaaucacaaugaauucuaugcagugcuuuggcaacauuuauguccagguugggaauggugguaacagaaacuuggcaaaauagaagcugugaagagacuuccuuuaaagggcagugaggguuuuauauauguguguuuguguguguguugggggaggggggcgugguauuuuguuuuuuuggugucacucugaguacaauauaguguaauaagagcaagggcucugaaaucaggaucaaaugaaauuuacaagcuguguggcccccccacacacaaguuaccuaauaucuggcuucagcugcuuuaccuguaaaauggggaguauuacuacugccaaguccuuacaacauugccucucauuauaagugcuaaaaaacugucucccaucauucuucucccaucucucuggccacugacguaccagagggugaauccaacagauauguuauggauauuuuacauaaagacccugaaucaggcugggugugguggcucacuccuguaaucccagcacuuugggaggccgaggcaggcggaucaccugagaucaggaguucgagaccagccuggccaacauggugaaaccccaucucuacuaaaaauauaaaaguuagccaggcacgguggcacucaccuauaaucccagcuacucaagagggugaggcaggagaaucccuugaaccugggaggcggagguugcagugagccgagauugcgccacugcacucuagccugggcgaccaugcgagacucugucucgauagauaaauaaauaaauaaauaaauggcccugagucuauggaugaucacacaucuaacugugcuuacugguaggacugcacacuucuuauauuuuagcauguuuucucucugcggguucacugcacuuuuuggacauaaaaccacaaagaauaugcuacuccacaaaauguucacucacauguuuauguaucgcguuagugacaaugguaaugaucccuugcauaaauuacuuucaucuggcuuccuagagcuaauuaguaccaugaccagucaguuaauggaauaaauauuaacucagguuucuauaugacuuuaauucauuuauuuauucuauagauauuuacuagauaucuauuguagguugguucuguagcauucuauaggauaaaauguuggaugagaucaagucaucauccucaagaagcuuacauuuaaaagagcuucgcaccuaauaaagccguuuacagggauacuuuucucucugcuaugguuaagaccugcuggaguuguuaggcagcccuggacguggccuguguagaggacgcgugguguucuccagucugggggguuuaucaccuucucaagaagucugggcauuguauaaaaugagauaacacaugugagaauccucugaaagcugugacaguaacacagauggcugugguguuuuggaagcccaaagagaagaauaaaaauauuuuguuaaaucucugcaaauaucuaaaaaguaguuuaaaaaucaauuaacagcauaaaagccuauucuagauauucaccaucuuuuuucaaucgaaauuucagucuaaauuguuuuauuauuaaaauacuguuaaaacaguacucuaaauccauuuauaaaaccuuuacuuacuuuaaaauaugcuacaaauaaacuaauaaacuccuucauuugaaucaacaucucuuccucccugcucccauucccuucccccaguucuccuagucucucuuguucagauagguaugaguuaguguacguuaagguuuugagaugccuuccuauuuuacuuguuuucuacccauaauagcagaucacgucggaaauaggagauaaaauguauuguacugaaugugacuucugaagccaaacugccugggucugaauccuaacauuuaacagcuaggucuuuggucacuuaagugcccuggugccuccguuucaccuucugucaauggacuugugaaaguucugagaggauucaaugaguaaacacacauagagugcccagggcagugccuggaacacagucucugcuuaguaauuuuaauugauuauuauucaucaagggcuuacugggguguaauaaagaaccuuucauuaaggauuaagaaagcugcaauguugcuauucuuuaacuaauggguauuuauugaauaucgaucauacaucaccuagagauacaagaaauuaacaccauaggguccccacucacaguacuucacaggcucaugggagacagggaagaaaaucaaugaugcagacacuaugacagagcacagcacucucacaaauacacccacacugccuuucagaggauggagaacaggaaugcuccugggauacuuagaacuaaggcuugaaggaaaguaagagcuaaggauacaggauaggggccagaggacaucaaacagagggaagaauguuaccgggcacagaguugugagggaacgugggauauccaaagguucuaaguaauuuugcaugccuggagccaggccacgaucaggggaagcugaccagcaacccuccugaagaaggaauggagcucagaucaugagggaacuugugugucaugacacagagcuugugguuugccugggguuggaugggccccguuugagagccuggcgggaagcugcugccguggcugcgggcagaagggcgggaauggcacacaacaggcagacagacagacacggaugugcagcagagcacaaggcugaggcacagggacugcucgcugaccagaggcagcaggugagggagaacacggaguccugggcgccuucacgaccccugccuugaguaccacaguaagaucccugagcgaaugaccgaguugaccuggaauucaguuuauccauaaaauaaugauauuuaauguuccucccuaauuuccaucugauaagagacaaaaacaaaauugaaacuccuugaacuugaaagagaaaagguacauauuauuuccagaaacauucaggacucagaggagaaauauuauagacacagagcuucauuauaaagagccuuuuuauauuaugcaguuuucccacaugcugcauccuacaaaucaugccagauacaaacacagaauaucuuucuuacacuaaaaugaguauuauggugggauucuuaguuucuuaguucucuaaacauaugucaucuucaucuucaauaacuuccauacuuuucaauauaaaagccaccaaaagccacauagguggcuuuuaccagugaaaggugaaagaaaauaacuagaauaugugaaaccccaaaugugcaaguggguguucaaccaaagaauucccgugcucaagcaccuuuccaucauuuccaaggagcgcgucuaugaagccgaagugggucuuugcugcacauccacuggguucaggacacauauaaagcacaaagaggaaacaguagacugcuaaacccuuuuucagucuugaagauguuuuucugucuuuuucugucuugaagaaguucucuguacuugguccuauaaauggccuuucgcagaucuauugggagcuggucugacccaggauaugcaaugggguuggcaggcuggucacagagcuccucaauaaggcugccucuacuaagccccucggcuagucacacuccauaagccagaaagcaagcccccaggaggcaggggaggucccccaaacagacggaccacagucaacucuaugcugaauaucauuguucucaauccuucuaaaaaaugaaucauggacauaaacauagcuaucaauuuaggacucaaaguuggcugggaaaaagucaccuuacaguguacaaagauguauuuaaccaggccacagaggcauguacugacuacugugacaguugguuagcagcguauuauuaauagaauggacaauuugacuuuacuaaugaagcaccaggaggcucugacuaugcuggucacagcuccacagcagugcagguuccucuugcacaccaggaaugcauguuucccacuguccauuuuacaggcaaacaacacccauaaucccucagaugauggcuguuuagucaaugaaaaaggugaugagaaaaaucacuaguugaaugcuaggacccaguaugugugacacugggccaaauuuagaugccccuguuugaacaagaaggcguuuucaaauaauugacaaauacuuaucaaaccagguaaccagaggaagaaguaaugaaugauuucuuucuucccuggagcagguuuguucucaagggagcugaaacagccccagcuugccauccugauacaucugugcuuaucuuuauuuccucaguagaaccauaucuuugaaauuucaauuaacccugagcuuucaucuucccccuccuuuccaaugauuuuauuucucccugcuccagaaauuuuuccucagucuuaaccuuuccucaaaguagccaaggacaguguaucagaucaaacacuccucacuuaacaauauacacauauaauuaguaucuguguggcugcaucuggguggcuccccuggcuguuuuugaaagugagcuucuggaaguuccucuuugguacauccacugugggcacauugauuuaggucaccucucuguauaagcugacucuagagaagacuugaccuacagagaagucaccuccaauuggugaucaucucagcacaacuugacccauuccagucauugcuaguggcuacaauuaaacagaauuccuagguaagccccuuuucauucaagguguugaugauuauuaaaauaaauaaauauuagagggcaaaggugacauuucagcaaaaaccaaaagcuguuauucuagcaccaacuaaauccccgaauaugguaaagguuuuguucuguuucugcccaaauuaaaggcuaagaaaacacuuuaauuacuugaacgaguaaauuaggaccauggaagguacauguccucugugaaaaaucacaaaucccuccaaguggguaucuagggauuuucuuagaugcuaaauaaaugaguuuuggggggccuuuuauuuuuuuuuccuuuugcggcuagaaagaaccugucaguucaugucaacauguccgguuaugcaaaaaugagaugauaauaucucaagaaguguuagcaacucuauuagcaaugaaauacauucuagagaaaaaaacacacaggcucacuucucaaagcauaaguaaaaauacuuuggaagauauuuugcugaggaagaaacuuacuguuuuacacauguuaggauaacaguaaaguuaaaaggaccaaguacugcauuacagaggcaaaacugggauugucuccuuuguuuaccaauaaaaauaagagaauggcauagauggcuuccaggguggcucccagcagaagguacaggagccuugaaggccgacagggcccuguuccacagguggaaccugaauaaggauccaggcuuccuguggcccagucauuauccaugcccuccagggaaaggccucuguccugacuccugucccucagugugggcagcacgaaggacggcugaggggccacgugcaucuuuucauuagaaugcauuaugaggaagcuauaauucugauauuaguguucuaaagaaaaaagauuuagaacuaacauuucuuugggcuuuucccuaggcaauacaaugauaaaugauaauacuuucuaguauaccuuaguuuauauaaauauaucuuaaauaacaugucagaagcugcugccuaauaauuaaaauguaaaauacuuaaaauauacuuaagaauaaauuuucuaccugaaaauaauuaaaagauaacuauacuauccaaauauugacacuggugcacuguaaugcacaaagugagcagaguacugcuguguaugaggaggaacccagcacauacugcuaugcaugugaaaaaauccugaggaacaccucacucagauaacagcacauguucaacgcuauauauucacccuucaguuccagacccucuaauacaaaaagguaccaucucuguauucccagcaucuagcacauggaggcacuaaaaaccauuuuccugcugaaugaaagaauggacuuaauucaaguuucagaaaggaauccuuaagaugauuaaaggaagauauaaaguaauaucucuaagggaagauuauaauaaauugggacuggcugauauaagaaugggauaguaacagucacgcauaugaaaggauuuuccucucaauuugggaucauaaaauuggcuaaaacuaccacauuaauaacacaggauaaauauaagcaagaacuaaagugacauauuagggccagcuagcggaaucauccuucaagagguuacuaaacauccaaauauccaaagcaugcauuuaccuuuaccuaagaucauuuccaagccaucccacuuacacguccacauucugcaaaugccuuucuuuggccaccuccagugcacaacggucgucaguuaaggacccucaacaggcuacccuuggagcucaaugauguguggccacaaguggcuucccauuugggaaggcaccucuccuggaagugggcacccccugcccuuagaaggaguugucccuuugcucuggagcagcugggcaauguugcgcaugugccaugauauaguugaggauggcccuuagagccuagaccacuuugaaaccacaagcccucaguucuuuaagggcagcaugaaacagcugccugugcuaaggacugaacagaggaagaaaccugaagccaggucaucacagagagggaucuagcauggcauuuaagcccagcguggcuuuuaagaaccacuccaauuuuuuuccugugcaaaauauaaaauugauauuuauugucaguuuuaucaccugcgaaguagauaagggguagcaaugcucaagcucauagggcugcugugagguuucuacaugaugacacaaugcaaagguacacaacuaguaagucaaugcagaaaucugaaaaaggaacacugaacagcaagcuuugaaaagcaugucagauaacaagguuuuuacaagaaaaggggaacuaaaauuuuuucccauuaaaauuuuuuuuaccuauuuauucauuccagucacugacuagaaaugaacauucugaauagaaacguucagcauuaaaaaucuagaauauaugaguaaagccccaaaauuacucauacaaaauuauguuuuggcauacagacaucuuucugugugugugugugcguguguguguguauuugcuucccuaccucccaaaaaaguggcauguuguauaaucugcuuuccucacuuaacauaauucccagucaagaaacaggcauuuucauguugccauuuucagagcugcacuguauucacugcauggcuguauuccuguauucuacuguauggcuaugccauaaaauauuuaauccccuaaugaaggauauuugaacuguuuauaaacuauguaaaacauucuugaacuuuuuucugaaacuccugcaaucucuggcucugcuagaugcugcaucuuauuuggugaugcagucagacacgcauuuguauacaaacuggcaagcaauggcaccucugagugucacauaaguguuacuuuccuaauuucuacaauaauaauuauucauauggaggauuugcagacucuacagugaaguauuuuuuuccugccauguauuuuaaaggcaauucccaugaaucugcuuagaaauacucaaaaauauacauuuagauuuuuggaaaaaaauacauuuucaaagaacuuagaaaaaaauacauuuucaaagaacuuagaaaaauauuaauaaaaguuauuguugccuauuccaaagcugcaacccuugccuggaauuuucaccucucucuugugucuaguccuaguuccugaaaagcugcuuuucacaugaagccuuucccaacuaaauggaaaaaucuuuuucuacuuuuauuccacaaugaaaucccuaugauuuucuauuuaagaaccacuccauuuuuuuuccugcacaaaauguaaaacugauauuuauugucuuuuauauuucauuaauuucugcaguuaucucuauuguuuucuuccacuugcuuuggacaaacaguucuuuucuagcuucuugaacuguauauuuaacauauauuuuaaaucuuuccuuuuuuaaauaaaugcauucaaggcuuuauaucuaucucagauugccuuaucugcaucccacaguuuucacagguaguacuuucaucauuuaguucuaagcauuucgaaauuuccacugugauuucuucuuuaacccaugaguuccuuagaaguguauuuuuucauuuccaaacuuauccuuuaucuuuuuaucauugguuuauaauuuagcugcacuguagucaagcaaugugaucagaaaauaacuauuuucugaaagcuuugagucuucuggugaccuagcacauggucaaauuugcauauaugcucaugugucuucaguacaaguucuguuagcuuuuaaaucauguugaguaaauaagucuuuaaucucuuuucuaucuagcacaucauaauagaaauguguuaagaucucccaccaugguugugaauuugccaauuucuccuucaaauuccgucaaauuuugcuguuacaugcaaauuucaugauuauuuuuauauucuuuguagacuguucuuuuuaaccuuugcagugacccucuguauuccuauuaauauugaauuugccuugaauucuauuuuuucugauguuaauacugccauacuaccuuuuuauugguugggauuugccugguauguauuuucucuugccuuuauucucaaccuuucuuuaucacuuugagcuguaucucuucuaagcagcaaacagcuggaauuuuuuuuuuuuuaaucuaaaccgauagucucuguccuguaauaggcaagcucaacccauuuaaguuuguugugacacaucccuacccucuuguguuuucuacuuaccauccucauucuuuguuuuuuucccauugucucuuuucuggauaauaaaauguuuuauuuccauuuuugcucucuuuugcuuuagguuuuauuuccauuuagguuauaaugacuaaccuaucaacacuguacagaaugcauaccucuaacauaacaugaccacaauccucugcuaacccucagugucuaugaacaucucaguuuuaagguuguuagaaugaaguuagcugagauccaagucauuuaauacagcagggagagaagcagauuugcagacagugcuuuugaucaggguagagauagucuuuaaggaaauacuguauaguucuuuaaauauacaguagcaacaucacuagauaugcugaaagugccccuuaauuuuggugacuuccaggugagauuuauguacacacaguucuaucagaggaauuauuuuucuuuuaaaaauaaucacacaggauuuauugcucuguucuuccugcuuuaaucaaaguuuacccucaucuacagaacuuuauuguaggaguuuuccauuuuucaauuuaguacuuaaaauuucugcuuuaacauuauuuauaacaagaaaagaauuggaaagaauccaaaaguucaucaagggaguagcuaagcaaauuaugcauugacacauuggaagacuguagaauaucuaucaaauguuuauauaaaauauacacgacaaauauauacauugcacugacaugaagauguuuggugaauaaagcaagaaacaaaauauaaagugugaugcuugcuacuaugugcaaagguagaaguauagauugcauggauccauggaguacuugcagauugauagaguuuuaaaauuuaauaauuuccccuugaaguagcuuaagucuuuuucucucucauuuucuuuaucuuucuucuuuuuuugucauuuuagucaugguuguugcggucgucgucuucuucuuuuuaaaaagaaaaucuaacuuucaguuccuaacauggacuaagccuauuucucagacuuuuagguuaacacaaaucagaucacugugguaaguucauauuucacuacauaaauguggugacugauuucauuuccuggcagugauaugcauuugguuaaaaaaaaauccaacugaaauuaaauuuaaaagcaaagcuuaaugccugucugaaauguggggugcuuuacuuaaccagacaaugauucaaaaaagggaaggggaauuucugccuaaaaauuuagugcauucccuucugucacaaaagugcguuugcccuauuuaaaugguucuguuuccuuugccagagcuuugccaaagucagcaaauugugagaguaaaaacacaaauuuuauucuguucuuccuguuaucauauauguaaccauauuauaauuauaaacuguuaaaaauugcaugucaugaaauuuuaaaacuuagauauauaaaagacaguuuggauugcuuugauacauuauuuaaacuuuuuuaaaacuaaugaguaaucaaacugaauacauaugcuuuuacuuauaugauccuucuugguuuuuuucuagacaccuggaccaccaccaauggauauacaaauggcaaacaauuuuacuccgcccucugcaacuccucagggaaaugacugugaccucuaugcacaucacagcacggccaggauaguaaugccucugcauuacagccucgucuucaucauugggcucgugggaaacuuacuagccuuggucgucauuguucaaaacaggaaaaaaaucaacucuaccacccucuauucaacaaauuuggugauuucugauauacuuuuuaccaccgcuuugccuacacgaauagccuacuaugcaaugggcuuugacuggagaaucggagaugccuuguguaggauaacugcgcuaguguuuuacaucaacacauaugcaggugugaacuuuaugaccugccugaguauugaccgcuucauugcuguggugcacccucuacgcuacaacaagauaaaaaggauugaacaugcaaaaggcgugugcauauuugucuggauucuaguauuugcucagacacucccacuccucaucaacccuaugucaaagcaggaggcugaaaggauuacaugcauggaguauccaaacuuugaagaaacuaaaucucuucccuggauucugcuuggggcauguuucauaggauauguacuuccacuuauaaucauucucaucugcuauucucagaucugcugcaaacucuucagaacugccaaacaaaacccacucacugagaaaucugguguaaacaaaaaggcucucaacacaauuauucuuauuauuguuguguuuguucucuguuucacaccuuaccauguugcaauuauucaacauaugauuaagaagcuucguuucucuaauuuccuggaauguagccaaagacauucguuccagauuucucugcacuuuacaguaugccugaugaacuucaauugcugcauggacccuuuuaucuacuucuuugcauguaaaggguauaagagaaagguuaugaggaugcugaaacggcaagucaguguaucgauuucuagugcugugaagucagccccugaagaaaauucacgugaaaugacagaaacgcagaugaugauacauuccaagucuucaaauggaaagugaaauggauuguauuuugguuuauagugacguaaacuguaugacaaacuuugcaggacuucccuuauaaagcaaaauaauuguucagcuuccaauuaguauucuuuuauauuucuuucauugggcacuuucccaucuccaacucggaaguaagcccaagagaacaacauaaagcaaacaacauaaagcacaauaaaaaugcaaauaaauauuucauuuuuauuuguaaacgaauacaccaaaaggaggcgcucuuaauaacucccaauguaaaaaguuuuguuuuaauaaaaaauuuaauuauuauuucuugccaacaaauggcuagaaaggacugaauagauuauauauugccagauguuaauacuguaacauacuuuuuaaauaacauauuucuuaaauccaaauuucucucaauguuagauuuaauucccucaauaacaccaauguuuuguuuuguuucguucugggucauaaaacuuuguuaaggaacucuuuuggaauaaagagcaggaugcugcaaaguuaugagucugucccucaaugcucccugucaacuaucagugggagugucagggaaaagauaauuggcaauagacuuugaacugcaacauuauaaaugaugaugaugaugacugaggcaaugaaagcacugagcuuuuccuggagcugccagcacagucuuuuagggccucugcuuagcaauaugaaaaagacuuuauauggaggugcccauugggaggagggucugcuugcuaaauucaucuugagaauaaaagacaugccuauaugauugguuuucuugggaucacuaggggaucauuucucuuuucuucccccaagcuguuaguacucuacaucuguauuucaaugguuugaguuaucaaguaggagaaggguggugcaugaugagcagugaaaaauauagcugcugcuugcuaaauacgauccgaguaaaaugcaaacuuacaaaauuaagcaucuuaggauucuuuacaauauuauauacuugcugaaaugaguaccuuaguaugaguagcaugaccuuuccagguagucaacuggucugccuguucaaauuuguuuuauccccaaaacuaccccaaugcaguauucucuguuggcaaugacaccaauuuuuauaaugguagauaaagaaaauguuaauucugaguuguacuuuaaaaauuuuuuucagaaagggggucucacucuguuacacuuuaaauuuuuauuggacuuuauauccugaaaauauuuuauuuaaaguucucaucuuacccauuuucaacuuuuacucuguaugaaaauuaaucuuaaugguugauucaacaccauuuacuaguauauucagauuuccauuacauuuauuucacaaagagccaccugauuuuaaagccauugucaaaaauaggcacuggucuuuguaacaucuuaugcagacaggugagacaacacggaugaaagcccaaaucuuacugccuuuccuucacuccaccucuaaacuuucccaagugaaggaaaagaaagggcaaaacaacaaauuguauguaaguuggcacuuagguagucaucugaguuggaucucuaaagaggaaccaucgugaagacuacuaaaggaaaaccaaaaagaaagcuuccuccauuucagagcuucucuguggugcccugguucugugacuacacuggaguagagacgccuucugggauguaugagccaacacacugucuuaggguaggcaagaguccucucugggcuaagggagucaauucuuaggauccuacaaacaagagaguaaauaccuauggcauuugacaacagaauaacauucuuuuaucuguucaguuuucugccuccucccuccacuauaccacaaaucuauauaaaugauuuuauccagucaucagcaaccauacugccaaaaagguaaacucuaauccuaucuccaauuaauguuuucuuacaagucuguacuccaaucaaacucagccaauaacuccccuuaaaggcugcccauucuacucaucaagccacuguucauacacggcugugggcauccucucacugucuuguuauuaguuagcuuuacauuuauuuccggggcauucuccuaaccaggaggucaacuuggagaacaggacagggcuguauaauuguuauauucuguuacagaacaugacuuuauuauauaacauacuguuugaaaaucacaacccuauaaguauuuucuccaugaaucgggugauacauuauuaacaauuuuaaauaauaauugggagcuagaaaaacuaaucugggaaaauggaucguuauuauggcaguugaccacauuaaaaaaaaaaacccucaaagcuauuuaguuuggaucaguguaaauaaauucacugacuauucagcgagaggauaguaaaaauagaauagugucagauguuagaaauggcaucauguauaugugaagagcucaauaauuuauaaaacaguccauauauuauguaacaucuuccuuucuacaauccugugaaacagguugagcaaacagugucacccauacuuuauaaagaaaccuaacuucagaacaggcacccugauaaauuaaaggcagcauuaggaauauaaccccagcugggcgcaguggcucaugccuguaaucccugcacuuugggaggccgaggcgggugaaucacgaggucaggagauugagaccauccuggcuaacauggugaaacccggucucuacuaaaaauacaaaaaaaaaaaaauuagcugggcgugguggugggcgccuguagucccagcuacucaggaggcugaggcgggagaauggcgugaaccugggagacggagcuugcagugagcagagauugcaccacugcacuccagucugggugacagugcgagagacugucucaaaaaaaaaagaaaagaaaaaaaaaaggaauguaaccccaauucuguauccuggccauaaagaagacaacucaaucauguggccccugaaaagguguuagaagccucgacugcuuuauuacaugcuagccgacuucauaauccuuaaauaggacaaauaacccaacaauagguauagauuauaaacuuggcuaagcugugggcucggugagggcaagugccucuucucuuauauauacagcauugccauagaaccuacacauugaagguccucaaauaucuauuuaauugauaacguauguuuuguauuauuacuaauaaaauucuaaagcccuacugaaauaucugugaaguucuuaauucucaaugaaaagaaacaacccaaauauucaauuacauaugcuagagcacguguguaacugaaggcaguuacacaauauagagcguaugcccuugaagauccuguaauuuaaauuagacacauuaaaggagagcgcuaauuagccaacaaggcaauuuaaaacuaaauacagaaauaauuuuauauuucaagaggcaagggcagacaguggcuccuaccauugaguacaagguggcaugcgauuuuagaaggggaagcacugaucuuaaauuagcccuuaaaauggucuauuuugguuacuuuuuggaccauuguaauuucuuauucucuucauagcuaaaaaauauuugcucacugacuauuugggugaagaaugagaaaaugaaaagcauguggauuacaagugacccggugacaaggccauuauuuugaacccagggaggacuacaugaguacucauaagaacugcugccaauggaagguuuucauuaaacucagaaaagcagguugcuuaaaagacagcccccaaauuucuauucgauuaagaccuugcugaucacugacuacaugccacuuuccaaguccucuacaggcaucaucuuauuuaacccucacuaccuuaagacaugguaugacuaucauccccaucuugcugaugaggaaacuauagcaacaaggucacaugguguggcagagccgguuuaaucccacacucuccggucccagaaccuguggccugacuuggagcauucaugccaccacuuacugaaacuugguuaguaagagguuccacccuguagccugagcuccauuccucccuguccuauguccuccagggccuuggacaucuccccaucaccacaucugaauucaauucaccuuuccccucaagccccugaauuucucuacaaacucuaccugcauucucugucacccacaucugauacuuuucucucauucaugggauucagguggugaacaaaucccuaccugggugcucuccucuuaaaugcacucuucccuaucuuuucuuuuucuuucuuucuuucuuuuuuuuuuuuuuuugguggugaaacggugucucgcugucacccaggcuggagugcaguggcgcaaucuuggcucacugcaaccuccaccuccuggguuuaaaugauucaccugccucagccuccugagcagcugggauuacaggugcccaccacugcacccagcuaauuuuuguauuuuuaguggagaugaguuucaccauguugaccaggcuggucucaaacuccugaccucaagugauccaccugccucggccucccaaagugcugggauuacaagcguaaaccacugcgcccggccuugccuguuuucuuugcccacuaccaucauccuaguccagacacuggccuuggcacaccuaauuacaaccucuuucccccaggccucuugaugagagucagaaacuuuagccuuucuuuaggaugcuguaccagaagccagcagauuaacaauaauaaauacuugcuaacaauuauauagcauagugcuuuaagcacuuuacauauaaagugcucauucaaaucucacaagaaugcugugaggcuuguucuauuuaucagucgcacuuuccagaugaugaaacuaugcuccagagagguugaguaacuugcccacggucacacagucagcaaguggggagccaggcucuacacucuggggucuggcuccauggucugcacucuucaucaucguauuuucucucuuaaacaaauaaacagauauguuccagguccucagaaagccuuaaaagagacacacacugcucaccaaauauccucaaguuccuuggggguggggaggaagagcaggugacuaccucugaccaauggguugggggcaaaagacgcgugugucacuuccagcccgaggugagagggaguggcauucuccucugccacaguguuuggcaauguucuagaugguggcaccuuugucagccugggucccugaaugaguaagugagaacucccaccccaugccccacccaacugcauuagacaagugugcaaacaagaaacacacuguggauuaagccacugugauuucaggguuauuucguggcugcaacauaagcuaaccuguucugauuaaaacaguguuuaaccuacuuggaaugaaaaaaaaaagaccaauacacagaguguaagaaaagaaaaaugcagacacuauccaguucucuuggcaaacaaucuuccuuaaucccacuuucauugugucauuucaugcucagggauugagaauaguuccccaugaucuaccacaucaaguccaaguuccucucccacacuuucgacucccuccaaccugauuuaucuccauugcccaauaugggccuuucaaguuugucuaguugguuuugucuguccuguggauaaaauguuugguucucucuagugggauucuccugcuuccuccccuucuuguuuacacuuacauccaaaucacaccgccucccuuaauccuucuuugacuacucaaagccauccaucuuccuuuccucaacuuaucuggcuuuuacaguauaugccacauaguuuuaauuuagaucuuacaacaaaggaagaaaaaagacacuggccuggagauggguggccugguucugucagacuccaacccagcuccaucccacuuuguccagucuuugagccuuucuagacuucaauugucuugucagugaaguaaguguuagauaauaggcaagcucuuugccagccaucguacggucuauggucuauuauuucaugugcaauauucuuguaucccucaaaugaaacauaaacuccauuggggaagagacacuagcuuuuccuucuuucuauucuggauagcacugggcaugacacccugaacauagacagugcuccaaaaaauacauguugacuauaggucaucaaauauuagcugaggagauuauaugauuuguaguuuuuaaguaugguaagagguugauauuauuacaugucauaauuuguuaggcagcaacagauaacuaauacuugcuugguacuaaaaugcuaaucauggaaaauauauuaaauuagaaauuagaaugacauuuaaaucagucaggauuuauuuuccaaaaugaaacuuuucuguugagaguauaagaggagcaccacuagcuuuuccauuuccuuccacauguaaaaaagcagcauaugacugcuaugcuacuuuaucucugauaaugcauauccaaauggagagaaauccuggcaauacuguaguuguuagaaagaagaagcuguuuaagagggcaauacaauaaauuauuuccuuuuuguuucaagaguucaccuuccucaaaaauuuuaaagcuguugucuaucugcaugcuaacuguguggcuucucguaguuaguaaugcucuuagacauccuguccacucaacugaaaaccacuccagagcaggggccacguuacuuucugccccacauggcaccuacugcaacugauccaaaacaagaacucaagugcuuuucugauuggcuuuuauccauuuucucagaguguuaaaacauuuauuucugguuucuguacaagaaugacuuuucccaggcagauuuugagaagaaaaaagugugucagaaugaaacuacauggaggcuacaaaagguuugagaccuaaucuaaaaaaaguaacauuuugauacguucuuauugcuugagggcagcagucccacaauuuucccaucaaguccuggcaugaaguaucaaauuuuuuggcaggggcuacauaguaaaaauguauaagguuacugccuauauuagccuauaaaaauaaaugcaaacaguauguuuuagcauaucauauauuauauguucaagagaguaaugaaaguauaugcaagugccauuucauguauuauugcuuauuauuuuccccaguaagggagcaagggcaagaagguccuaaaguugaacauuauugguuuguuaaaagaacagcaguuaaggcugcacgugguggcucacgccuauaaucccagcacuuuggcaggcugagacaggaggcucacuugagcccaggaauuggagaucagccugggcaacauggcgaaaccucgucucuaccaaaaaaaaaaaaaaaaaaaaagaaagaaaaaaaaaagaagaaagaaagauauuuuuccuuacucuuguuacaacaugggguggaggcagaaguucagggauggguucagaaagaacugaggcuggugugggagaaucaccugagcucagcaagucaaggcugcaguuagucaugaucgugccacugcacuucagccugggugagagugagacccugucucaaaauuuaaaaaaaaaagaacagcaguuaagaagacgacauuaucaaaacagacccacaggccugauacacaugugacaagagaucaaggcaauccugguucucagucccaacaaucuccuaugagcucuacuugaaaccugguaccugccugugccugcaccugacacucaggccucuggggaggcccguagagauacuggcaaaucugaggcaagggcaggguugagggacacugcaggcuaacaccaugcagauuuuaggaaccacaugguaaaaugaaaaauggaaaccagugucccauuagggauccaacugucaaauuauuugaaguuuguguguuugaaaaaaugauuaaaaggugauggguacaugguagucauuauaccauucucucuguauuuauguauauuugaaaauuucuguaauaaauuucuaaaaaugguaaguauguucucuaacacaugcccuuacucuuguuacaucggggguagaggcagaaauucagggauggauucagaaagaacugagacacaguuaccagucuccaucuccaaucaguuaagcacagcaauucaaaucauaggagaaugggacgcgcacuggccacauucuaagguuacaugugaggggagucucagcagaccuucaaggaguccuaagaauaacguggcaacagcaaacuaaauucugcauguuuguacguauaagugggagcuaaacauugaauacacauggacacgaagauaggaacaacagaauagacacuggggacugcuuguugggggaguguggggugauggagguugaaaagccacauaugggguacuauggucacuaccugggugaugggcucauuuguaccccaagccugagugacacacaauuuacccauguaauaaaccugcauauguaccccccgaaccuaaaagugggaaaaaaauuaaaaauaaauaaauauuaaaaaaaagaaguccuaauaagagauggcuggugguaacaaagucaccagcaaagaauagguuauaccagaaagccacaugaaaagaucagcaaggcuucauaaacacacacacaauguucuuugaggaacuugaucuccuaacacaaaggaccacaaggaagaacuaugucccaguucaaaucuaaauguuucagauccagguauguugcuuuguauauauacauuugaagucaaauauaaauguuacauucuuuugauuagcaguucugucagccaagguucaguuauagauaacagaaaucuugucagcuauuuugggcagcagauuuaguacacagaauucggugcuuauacaauugcugaaaaggcuagaaggccagauccagcgccuccaggaauagacuccuggaacacauaaggacuggucuaccaggagaacuguuuccucugacacacugaggcagcugggaaaucacaaaaguuaauuacaucaacugugagcuccaaggucaaaccacuuuggcagagucuagggaucagggaguuucagggaguugaacugugaacucuggcaccccguuggauguguagaacugcaccaggaaaauggcuaucucauaugccuuggcucauacugaauucaagagccacacguuuuucugaauaauggaaccuaaaucauauccagaacuccaggcaagggaguuuaagaaauagagcauucagcuuuccaaccucugcuuuaugggaaguacacuaggagaacccuggaacagauaaugagccagcuggccgggcaugguggcucaugccuauaaucccaacacucugggaggccaaggcaggagggucacuugaggccaggaguuugagaccagccugggcaacauaacgagacguugucucuauaaaaaauuaagaauuagcugggcgugguggcacaugccuguaguccuagcuacucaggaggcuaaggcaggaggaucccuugagcccagaaguuugacguuacagugagcuacaaucgcaccacugcacuccagccugggugacagagcaagacaauugucucuuaaaaaaaaaaaaaagaagaaagguaauaauaaauaaugagccaguuaaucuaguauacccaccauaccauucuaauaaaguacaaaaauacucuaccaaagggaggaagaagaggaggaagaggaggagcaggaggagcagcagcagcagcagcagcuacuuaagacacaccacaaucgaaugcaaaagcaaauguaaaagggcauuuccaagcuaauaggauaaauguggaaacaguaguuucaguaguaaauaauauuacagaauuaugaauaauuuuguuagguaagguaacauuaugguuauauaagaaaugccauuuuagagcuuucugaaauaugaaauaugauauuaugaugucuggaaauugcuucaaaauacuuuuaaaaugccagggaauggaaagaggauagcaaaaauguuaauuacugaaucuggguaauagggcucauuuuauucucucugcuugugucacugaaauuuuucaugaaaaaguuauaaaauguuauuccaagagaaauacgaaaacuacacauuauuuucaucuacugcuucaccuucacaaacuuuaauuuuccagcagccuuagaauauguaucguuuucuguaaguccuggcuuacagucuucaaaaaugccaaggucgcccaagacagacugaggaacaguccggauuaaacaguaaggggauguaccaaugaaaugcaacauguaauacugaaccagacgauggacuagaauuuugauuuuccuuuuugccauaaaggacauuauuuggacaauugccagaugugaauaaaguaauacauacucaugguauuuuggagucaaagggacauuaugucuacaacuugcuuucaaaugauucagaaaaaauacuguguagagagaaaaugauaacagcaaaugcggaaaauguuaauaacgggggcaucugguuuuaggguauaugggaguucuuuguuuuauccuugcaacuuuucuauaaaccagaacuauuuuaaaauuuucaaaaaguauaaaacauaaguggcagcauuugguagcuacugaaaagaaacagcaguuucuucagucuauuaaaugaaaauacaaguaauagcuaaauaacuggagugucauauagugcuucuucaggccccauucaugggggcacuuccccccaauuggaacuuuuuuucuuugcauuguguguuuauuuguacuucuuauuuuagcagcaaaguuugaauacaaucauauaaguugucuuuggacauuuacauugcuaaaguugaaauacacagccucagucuggcaaguuaaaaugcucaaguugcuuccugcuauagugaccauuaacuagacuguuuuaccuuuaaaaauaaaguggcauuggccaggcgugguggcucacgccuguuaucccagcacuuugggaggccaaggcagacagaucacgaggucaggaguuugagaccagccugaccuacauggugaaacaccgucucuauuaaaaauacaaaaauuagcugggcgugguggcacacgccuguaauuucagcuacucaggaggcugaggcaggagaauagcuugaacccgggaggcagaggcugcagugagccgagauagcaccacugcacucuggccuggguaaaagagcaagacucagucucaaaaaaaaaaaaaaaaaaaaaaaaaaaaaaaaaaaaaaagguggcauuaaggcauuaaggaaaugucugagccacaauucagacaggcaugaguuuccauccaggcuugccacuuaaguagccgucacuuagugacucaauccucagacccucagcuuucucauguagaacacagcaauagcaacaucuacucuugcaagucugcuuguggcuauucauuuaaaucuggcuauucauuuaaaucaggaacauaugucaaacaaggcucuacgguacaaaauuguucaauauaaauuuauuaagauuucuuaagagaaaggguaaauccugcugucaaaaaaaaaucuccaaauggaaugcguaauguuaacauuucauaauguuacuccauauuuuuccuucauauugucacugauauuaacaaaccuauccuugguauugucauuuauuuauacagcaaauaauuaucaagugucucuaugaaccagcugcuauucuacacacuggaauaacagcugaaaaccacacagaccaaguugcucucugaauccuacauccuagaagccaauauuaaacauuaaguaaguaaacaaaauaauuuuaggagagagaacuguaaaguguugauucuagcucugguguacccaugacugauuauuugccuuccuaaauauucucugagcuacuuuaauaaauucccuuucugcugaaucagccagaauucauucuauuacuucaacuaacaauccagccaaaacagggaugccuauucucuuguaacugacaaagccuuuuuccuuuaguucagauaacaaaagcacauuagauuucaagcacauuagauauuucagaacucaacacauaacauauaccaaaaaauccaacccuaagacagguaugagauuauuuuugugugcuguauauuuugcuauaguuaccaagacaugguuagcauuuugaauuuuuuuucuuagaacaauacaaugaucuaaaucuaaaaucuuucacaaggugcaacuuuccagugauaaacaagaacaggaagugaaucuugaauacaaccagacuucaaguucccuucacuauuaaaguaucuccuuugcugucuguuaccugagucucacuuaaccagcguuaaacuuccaucauucuagcccaacaguuauaaauaucuuuauuucuuuuugaacaaaacauauuuccuauuagacuggaaauuuugacacacucaaauguuugaagucccaagaggaagacagcuaaaauaaaaggaauugagcagcaaagcaacucagaaaagcagaaaugaaaacagauguuaaaccucuuuaaaacaaauuuuuacuaauagccucaaccaaagcuauuucagucaacuacuagaaauauucuaccuagucaaaaguucucaacaagcuuccuaggucaugagcuccucaagggugugggcuaacucuuuccaggguucuaucuaccacccagcaucaugcaugucaugacucuccaucaugggugauuuugccccccaagugucauuuggcauuaucuggagacauuuuuaguugucaugacugggguaagacuggggaaaggagguuuugcuaacagcauacacuggguggaggccagugaugcugccagccacccugcagugcacgggaccgcccccaccgcaaaggguuaugcaacuaaaaugucaaaagugcugagggugaggaaacucuagcuuaggucaaugaugccacugcccuucauguucaaauacaaaaucacuuaucauguggcuucauguagacuucuggcaacagcuuacacgcccuuuuaaacuggauacauuaggucugcucccugguaagacacucuggccacugagaccgcaguuugaaauuccugcaguguuaaaagccugagucuccuuucacaauuagccagcaauccauaagguaaguaccucugcacgccacuuugauucagaaggcacagaucuucaaacauuacuaaaaucuuguuaaaaugauuggcaaucucaguuccuaaucaguccucaggcaaugucaagacauaagugagacaagaaaagccucuuccucuuguuauguaucuucuaacaucaugauuuuucuuuuaucaauuuauagaaaauagcgcugaagguuucugagccuguuuccucaaaguagaugcgaguucucaccuuccagggcuguucuaaggagagaaaguggcacaccugcagagugucugggaugagccuggcgugugcuugcugacuaccaaggugacauaguaccaaguacaaugccggacacaugguauccaacacccaaauacugaacugagcccaaagugugagaacuuuuugguugagaaaggagauaucuugugaauauaagaaugaauggauuauaugcuucucucuuagguaagaugcuggaaaugauuuuauaaguccacauuucaauccuuaaaaaaaaaaaucacugaacccaaaugugaaauucaacuuuuauacuuuuuuguuguugcuguuguuuuuuuuuguuuuguuuuguuuuguuuuuuuugagauggagucucgcucugucacccaggcuggaguaccauggugugaucucaucucacugcaaccuccucugccuccuggguucaagcuauucuccugccucagccucccaaguagcugggauuacaggugcccgccaacacaccuggcuuauuuuuguauuuuuagcagagauggaguuucacuauguuggccacgcuggucucaaacuccugaccucaagugaucugccugccucggccucccaaagugaugggauuacaggcgugagccaccacgcccagccuacauuuuucucuuaaguaacagauuugagguagcuuacugagugagaaagagagagagagagagagagagagggaaagaagaaggaaggaagaagggagggaaggaagaaaggaaaaaggacauuagcagagacacaauaauuuagugcaaaaaaauaacugaagcaacuagcauguggcagaccgaucccagucagcuuucuuugucccuuugguauuaaagaacacucuucacuacuccaugcugagggagcuguaagagagaguaagauccugcucuuucaaaagcauccaguugagagaguggucaauuagguaaauaauuaccaucucaaguaaugaauguuucacauaacuuacaagcacaaaguuaacugggagcaagaaggaaggagagguuaauuccaacucuggcuggagcaggguuucguggagcagagcuacccaaggggacacuugaaguucuccuuguuuucuugguagaaguuugucaagcaaaggggagaagggauguuguaaccacaauugucguaauaaaugaauccagagaaaucuguaaugauguaugcgugacaggcaguagugaguaaugcaauuuagcugacaugcagaguacaaggaaggaaugacagaaaaugaggcugggaagauuggcuggagcucugaggugugucacaagcaaguuaaacuuuauaaaacagcaggaggaagccauaggagauuucucaagguguaaaggaauaagaccagaucuccuuuguagauaaaauuaggggaguggggcagugcagaugauggcauugagauggugacagggagaacaguuaggaggcuacagcaauaguccaaaccaaaggagaugaaaucaaaagaucaaauacuuuucauuaaucuauuugcucuaucaauccauccaucucacaguuguguccacuaugugggagccacuaugcuaaccaagugcuaucaacugaauguuucuguccucuccaaauucacauguuaaaauccuaacccccagugugaugcucuuaggagguggggcuuuugaguggugauuaggucaugaggguagagucuucacaaauaggauuagugcccuuauaaaagggaacccauugaacucucugcuuucugccaugugaggacaccacgaaaagacagccccaaacaccaaaucugccagugccuugauccuggacuucucagccuccagaacugugagaaauaaauuucgguuguuuauaagucacacagucuagggcauuuuguuagaggagccugaacaggcuaaggcagugaggcaucauuagugagacaaacuaacacagucuccuccuggcacaaagucuguauucuaguggagguggcagguaucaaaucauuuguuacaucuuauuuacuaucuauagugaugagugcuauaagaaagaaaaauguucuaagaaagcauaucacaagagacugugaccuagucugaggguggggguagucaaagacagcuucugcaaaaaauuaccuuuaagcuucucuugaaacacuugaaugguggcaguuuauucucucacauccuucauucuagauacaaauuuugaucaacuuuuuauuagucaacuuugcucugugcaaucacauucaagcauuuaaguauuuauuuacuaaaauccccgguagggcuaaccaaaccaguagguacuguugggaggggaagaggaguggggaucagugcaaaagcaggggagauaaagggguaagaaaagggggaaaaggagaaaagagguggcaagccgagagggaggugggaaaaggaaggagaaagggaacagcuuaaaauccaaaggcuuuggcuacacaacagcagacuaaagucuacuuuucucaguauaaauacugaguaacucaugaaggaaagucaacauucacacacauuuguuauaaucaauacucagaaauauaauucucugcaaacugaugaucaugaggaaccauaagccugacaguuucuguugcuuuaccuugacuuggaggcauggcgguuuuagauucaagugauguagguuaaaauuucaacugaguuauauguuccuggacagauuucuuagucucucuaaaaauguuuucguaccaguaaaacagauauaacccuaucaacaaaguuuauuuuuuaaauaggaauuaaaggagagaagauaucuaaaauaucuauccauucaacuuaucuaaucuauuauuccaaacauguuaaugugaucgcuucaaauuuggagauccagguaguccuauuuuuagguugagaaauaucacuuuuuuucacuuuuaaagacacugaucauuuuucaagcuaugaugauuauuuauauguuggcuauuuagcccaaauucaaagcagagacacaauaauuuagaaagcuaacugucacuuauugcuaacuuugcccacaauacccacuucccuuaaaaauacuccaacgguugcaauucgagaugaccacagaugauuguaggugugcugcuacucucugacuagcccucaccuccagacaggcaaucccuucacgcgcccgagaaagugaauaccacugccugguaccaacucuauugccacauguauuaauaaugugguaacaguuaauuaauaauagcauagcccaaaugaaagccacacacaggacuacaaauuuaagaaaaauauuacauaaaauaccuauaauggauucuuuuaaauaggucuaaauaaccaaauuaauccacagaauaauguuggugucaccaucacagcuauuucuuagcuuccgaaauuaucugugccuaguccuggaaagcuuuauccugugcaaugcaagaggcagaacuggaaaacauggagaagguaagaccugugcccuacauuaaucugcucaucgagaacagcaggaaaggcccuucuauggggagaccaugaggaaauuuauccugcagaaacuggguaucugcagauauuagaagaacguuauguuccuacagauggaucccgagacuaagcaaguucccucuugcucauuuaccaccacccaccuccagauuagaggcuugaugaggcuugcggguggugacagaggggauggggcaagagugccugaaauacucaaagccccaguaaguaggcccagaaagugagacaauagagcacagugauuacaaggccuauuuuauuucaaguaagagagugaugcuggaggaugacacaauguaaaauggccuuaauaaaaugucugaaugauuguagagguaacuaucaauggagaaaaaaaugauuucacaacugcaaguauucuuaaaacacacaccuuuuuaaaaaccaauauugccuuuuauuuuauuuuauuuauuuauuuuuugagauggaguuucccucuuguugcccaggcuggaguacaauggugugaucucggcucacuguaaccuccgccucccagguucaagcgauucuccugccucagccucccuaguagcugggauuacaggcaugugccaccaugcucggcuaauuuuguauuuuuaguagagacgggguuucuccauguugguuaggcuggucucgaacuccugaccucaggugaucuaccugccucggccucccaaagugcugggauuacaggcaugagccacugcaccuggccuuaauauugccuuuuaaagaugguaguuugaacauacauauuuaucuccucuguucuuuccuaaaaucucauaagagugacauuaaaaggauuuuuuuuaaagguauaagcccacaaagaugaagaguagaugauccuaaaaauuuuucuaaguuagaaaacagcaacacuauacaggguagcuaucuuggcaaaccugagaaaaccaaauacuaagccaccaguggugaaaucugagaggcaaccugauuaacauuugacuucccaaagguugcagggccagggcuuuccagaagugcuaagaggaaggcagagcacugcacagccacccccugaacucuacccaccugcuggcuggcugugguauucuacaaaaauguauuugguguuuggcucccaaaaaaucuucggcaucaccuaagugacagaagugccuuuucuucuucauaaugagccccuuucaaccacaucugaauuuacccuaauggguuauuuagguagagccccuggauagccucagauggagcuggccgaccagcaggaagaccaagugacuagagggguggaacuuucagcaccacccaccagccuccaggaagugggguggugggagauggagcccuauaaaaacucuucugcagugaaauucagacagcuucuggguuggugaauacauggaagugcugagaggguggggugcccacagaaggcacgagagcuccgugcacucucacccacccucgcaccuugcccuuccauuuggcuguuccugcguuguauccuuuauaauaaaccaauaaacguaaguaaaauacguuccugaguucugugagacguuccugcaaauguaucagaccugguggggguacagaccuugugggaacccccaauuuacagcgggucagucagaagaacagauguccugaaacgugugacuggcaucugaaguggagacagucuucugagacugagcucuuugacuuguaggaucugauacuaacuccagguagaaagugucagaacugaauugaacugcuggacacucagaagaacuggaguacuacuuguuagcguuggaaaacaccccucacugccucuccccaucuuggcagauggcuggagauuuauuauuuagaagcagaaaaacggaaggucuugagacuggagggacucacagacaccacugacaguacaaauacaauacuaaaaaucaaaauuuguccacucaagucaagguuuauuaguaaauguuaagacucccaggcuuacacccuacagguauuagaguggagaguaugaucuggggaaucugaccaacccauugguggugagcagggaagaaacaaaugcacagauccugacacuggcauucccaaacauccucaccaggggaccuuaugacagagcccauggucaucgaggaccucaucccgagacuccaaucagcuuuuaaaaagcuggaucuuaaauccaaacagauaaucaaaggcuuagagauauguaaggaaaacuccugacaucaaaagcagaaaacaaagagguaaaaaggaacucagaagaaacauaaacuguguagagaaauaaaaccugggggguggguagaagaggcagguagugaagaaacuauccucaauaugagagggauaaaaaauaucgcauccacaaaaugaaaacaggaugucaggaaaaaugaauauucaaaaaauaaagagcuaauaaaaauuuaaaauagguuauaaauauuuuuaagaaaaccaaaacaacaaaccaauaaaugaaaaccuacucaaucucauuugucaucaaggaaaugugaacugaaaucacaaaaauauaucaccacacaucugcuagaaugacuaaaauuaaaaggacugcaacauucuuggaccacucaccugggggaagcuguaauagcugcuaugucaggaggcagcuccguggugaggagcugaggcuuccugccaacagcacugugagucuuccaaucccaguaaagccugaagaugacuguggucccugacauccugaguacaaccacaugagagacucuaggccagaaucacccagcuaaacugcucuuaaaugccugacccacaggaaaacuagcaguaucuuccaaaucuaaacauauguauacacuaugauucugcuuuccacuccuagguacauacccagcagaaaugcauacauauaugcaacaaaagacauguucaaagacauucaagcugcaugcaguggcucacaucuauaaucccagcacuuugggagguggaggugggaggacugcuugagcacaggaguuugagaccagccggggcaacauggagaaaccucaucucuacaaagaauacaaaaauuagcugggagugguggugcgcaccuguaaucccagcuacuugggaggcugaggugggaggaucaccugaggccagguaguugaggcugcagugaaccaugacugcgugccaccacacuccagccugggcaacagugaaacccugucucaaaaaaaaaaaaaagaaaagaaaaggaaaaaggauauucauaauaacaguauuuguacuauucccaaauuauaaacaaucccaauguccauuaacauuaacaguauuaugaggccaggcacgugccucaugccuguaauccuaacacuuuggaaggccaaggcaggaggaucacuugagcucaugaauucaagaccugccugggcaacauagcaagaccuuguuucuacuaaaaauaaaaaaaacuagccaguccugguggagugcaucuguagucucagcuacuggggaggcugaggcaggagaauuacuugagcccaggaggucgaggcugcugugaucaugccacugcacuccagccugggcaacagagcaagacccuaucucaagaaaaaaaaaagcaguagaauggauagauggugguauucacacaccaaaauacuauaccaauaauggaaaaaaaauuaacuacagguacauacagcaacacaggugaaacuaaacagaauacugaaaaaaauaagcaagauacagaagaguccacaucucuauuauguaaaguuuaaaaacagacaaaacuagaucaggguguuaaaagucaguguagacuucugggaggaaggaguaacuguaagguagcaaaaguggaccuuuuagggagugggucacauucuguucuucaacuggauggugcuuagaaggugucacuuuguaaaaagucugugagcucuggacucaagauauauacauuuauaccucaauaaaaauuuauuuuaaaauauuaauuagaauaauugcaagguagaacccaggaaaccucccagcaaggagagcaaaaacacagagaaagaaagcaggaaaaaaaaaaaaaaagaugaaaacuggaccuguccaggagacugaacaucuagguaauaggauuuccagaaagaacugagaaaaauggaagaggaggugaucaaaauaauucaggaaaaauucaagaagagaaauacagggaucaccuguuugacagggcccacaccaaguguacaacccaaauggaugaaucugcuuggauucaucacuccaaagcaccucaucaaaacugucacaaaguauuaauaaucagaucaacacuaaauucaucaacagccacacugcaagguaccuaccuuaagagguagguaccuaccaagagauagcauuuccuuaaucauuucuuccucuacaucuuuccuuucccccaggacaggcaaacuaccauauaaagaaaccgcuuacucucaauacugcuaauuucugagaguuuaaaaaugaaucccucacuagccaagacaccucuggaaccucaccaaacaggaguggaucacaaagguccugcaguggcuguggauucucuauccugggugcucacugccccucuuaaccuaaucugacucugccaaagugguuuaacaccuuucagggaaacaugagcuaagaggccaaaaucacuaggcaaccuuagaacacagucgcaacaaaaaagaaacaaacugaauaauauuaccaacuaggaaagcaacauuuuuagaaaagaugaaccucaaguuauaaaauauauuaauagguauacuaauagaagagauaaaagaaaauauuaauaucucaaauuccagcugaauuuuuaaagauaacugauuaacuuacucuaaaauuuauacagaagaauaguuagguuaaucuugaaaagaugaaccaaaaaaaaaaaaagaguaaccuguucuacuagauaucaauacauacuacaaaaacaaaauggcuaaaaauacuagagcaugaacagacacacggaccaauggaauagagaguaaagcagauacacacacagacucacaauguacacauacacacacaauauacaugcugcugugcacugaacuuugucuccccccaccccuaaauucauauguugaagcacuagcccccaauguggugguauuuggagguaggaccuuugggaggcaauuagguuuaggugaggucaugaggguggggcccccaugaugagauuagugcccuuguaagaggaggaagagagaccaaagugagcucucucagccauguaaggacacagcaagaggguggccaucugcaagucaggaagacggcaggcccucaccagaacuugaccaugccaacauccugaucuuggacuucuagccuccaaaacugugagaaaauaaauuucuguguaagccacccacucuaugacagcacgaguuuacuaagacacucauauauccuaugacccuacauuccugcuccuggguuuauaugccaaagagagucugucacaggcccaugagaauggcuuaagauuaaggauauagauaaaacaagguggccaugaguugaucaguguugaaagugggugauguugaaacaugggguucauuacaguguucucuccuuucuuauacaugcuuaaaaauuucucuaaugaacccagauaucagaaacaaagauagaaauuaaaauaugggcugcuuuaguggcccacaaggcacuugaccuagauacaagccccuggaguugagggcugggauuuuuaggucuaguagagcuaaaagaggugaccuuaagcagcucaaggaaagagagcugggacugagcccagaccaucaaagaucacugucuuuuagagagaagacuaaaaauauuccauuuauagucugcugaaacaacaaagaaaguuagcuuacauuaaaagccuuggaaacaaaaagaucaaacaguccuaacaaaaaauuaaaaucuaaggccaacaucauaccugaauuuguggccuagauuuacccccacuugaauggucugggagcucuaagguaagaaaauaauauaaaagcuaauccaggcaacaaaaaccccucaggacccagcaguaguaaacacaaaaucccucaacagagauacuuuugugagcugggggacauggggacucgaagagcaaaugaaaccacugaaaaugaguucacaauaaaaaauuaaaacucuaagaaacaacagacuacccugagggagaauuugauaaccugagaagcagaagugaaaaacaauuuaaaaacucuaaguauguauaaaaugauuaagugcuuuuuuaaaaaagaaugggaaacaaugaaaagaaagcacaggccaacaugacuucaucucccaaagcaucaugcaauggcucccgaaugcccugauuaaaggccaaaauuaguacaauggccugacaggacagugaccacucuuaccucccuggccucaucuccugcuaucuucccacaccccauccccccaucacucugcuccagcuguccacguacgggauggucccaucuccaccugagggccuuggcacuggcagucucugauaucuggaauacuuuccccaauaucuccacauagcucacaccuugaccccuucaggucuuugcucaaauauuaccugauuucugaagcuuuuccuuacuagaauuauuaaaacugcaaucccacucacacccuggcauucccuucccuaguuuauuuaguuuuguacaacacagaucaugaucuggcauauauauauuacaaauuuuuauuuuguuuacugucuuuuacccucaauuacaauguacagucgaugaggacaaagauuuugucugcuuugaucagugcaggauccucagagcccagaacaaggcuuaucauaaaguaggugcucaacaaauaauuuaacaagaggaaaagagaaugcaaaaagauuggggaaaucagaaaagagccgauugcucuuguaaaauaugagguagaauucucucauucauucaugcaugcauaaauacccaaacauuuacuaaguggcuacuuuauacaaggaagugucaagcuauucucuuccucacuuuggaaauucuuucuucuccuaaaacaugacugaaauugacuuccuccauaauuuaccauaaaagauuagcauauuuucuaaguuaauaaaaguacgcaauguacugaaaaucaucuuuuacaguucagcuuccuguuccuuauuuuuauucuucuucagaacucaugugcauguccacaccaucaaccaucaauuucuaucuaacuauguuucuaaguacaaacucucguucccuacuuacuuacuuucuggguuuugaaaauauucuacuuguuguugauaccacuauaaucuuggacauugauauagaaauguaaaaaguaguaauuaaaaucuaacacuugaucugugcccaagaauuagcuaaggagcauuauuuaggaagacaaaagcugaugacuauaaaugugaccauaauauucaccucugcuaaauuccaauuauuuucuuauuaacauuuacauacaugugcauucuagugaaaacagucugugguucauauaagacuucaaagagacacaaaauggcaaacaauauuaccauaugcccuugauaaaaauaucugcuuacaauucucuuugauuagcucaauaauuuucagauaaugauuauuuuuuucuuuaauguuacuauuagggccaaguaguguguugccucaccuuacguaguuaaaauuuggaacugugcugagcugagcccaugaauaaucagaacuaaaaaucauucuuagguuuacaucauaggaguuucacaauugcuauaccagugguguuuaaaauacuuuauuguguuguuuaggaaaaauuaacacacauacacaauaccaguuuuuaauucuaacuacagcacacgccuuuaugaaauagucacaggguaucaaacuguuaaagguguuuguauaaaguauaauaccauucuguuauuuauuacaaaaauguuucaccauaugauccccauuuaauaacuuauuuuagaggaguuaaagcuuuuaucaaguucuauguaacacugccaucuagugcaguguuacugcaggcaaugccuacugaacugcugagcaugcucauuucagaaaggggaaaacagcuuuaacauggaagcuuacagucuagauugaaguucuguaagaauucguaguaauaauaugaaaaauguaauuuauuuugaauauuuuauuuuauaaauguuucaaauaugucacccuaccaacucauuauuuagcucuuaccuuaauggugucaggauuuucucauucuauuccucuuuaaguauuuauaaagacuuucuggaaguacguacuucaaaauuuaaaaauaccccuugcuuauaagaaagcaaaaaaucaaucacuuagauuauauagaaaaaauaucaaaccucuuuguauuacagaauuugagaaauauaauaauaacucuacauugcagugaauuauguccuggaacaaguucugcuguaccaguacuaggcugcacagaacauccugggaaaugcggucccuuggcuggacuccaauuaauuucucuaguucucuaagccuacuuaugaaucucacaauaaagaagagcacagaaucagaauauagcucauuuaaaccacagaaugcucacgguuuaaagggauuucauaggcacuccauuugugguaccuaccaaugaguggacuuccugcaacaccccugccucgcacucucccagccacagccugaguauccucagugucaaauucagcagcucccaagggagaucaccucaucuugagacagugagugcugcaaaguuacuccuuaugccaagcccaaagcuauaucccguagcauguccccguggucuucauucaccacaggccauuccccccuuauuuaacuccucuuucacugggcagcccuuucaacaguggaagacaguucugccccaguuucuucucucugggguaagcaaugccuguucuccaccuguuucucccauggccaaucuccaucuccaccccauccugaugccaaccuggaccaccagcaacauccuuguuucccuguaauccuacaaauggcaucuaggggcauauuagugucaacuggcagucacuccaugaugccauuucacaagccaaacaacucuaucauucagugccucuacagcugauuuuuaagacucaagagaaagaccuaauguucucucucuuaccuucuuuaccuuuuguguuucuuuuuuuuuuuuuuuuuuuuuuugagacagagucucacucuguagcccaggcugaauggagugcagugacaggaucauggcucacugcagccucggcccuccaggcucaggugauccucccaccucagccuccuagguagcugagacuacaggcacaugccaccacgccuggcuaauuuuuuguauuuuauguaaacacaagguuuugcuauguugcccaggauggucuccaggacucaaacgaucugccugccuuggccucccaaaaugccgagauuacaggugagagccaccaugccuggccuccuucuauguuucauauuuugacuauaaagcccaaaacuccagcuugcugaggcagcuaauguguuagagcuauuguucuucugagaagacugcuagcagcuccccgaaaacccacuguucccuuaucuccagggacacaacugcccagguaagauuacaucucccagccucccugugauuagguguggccacgugaccaaguucuugccaaugguuugggagcaggagugacaucugcaaccuugaaggcaccuggggaaaggcaaucccuccuccugcaugccccuucuuucuuccacaccagcuggaagcagaagccauggagccuccuuggaaggcacauguugaggaaagcagaggugcuccaccagaccaggcccuugacgacuuaccgguacagagccugccuaccccacagggugguuacaaaagugaaaugaacaucugcgcucuuugagccacugugucagcgguuuguuacagaagcuuagccuccaccauuacugaaauauccuccuaguuuuuguaauuugcaaaucugaugagcaaacacacuauauuuugguauuuuuuaucacugauaaaauauuaaucagaacagcagggaccaagaaugcuacaaaaagauaaauguuacucuuucaauuucaaaugacuauaauaauaaaggcagauaccuuucagagcauaagaaagcagcaguagcaaguggaaggcucugaagugagcagacucuggaacagagcuaguuucuuccuuccuuacuuauauccuccuggacaaggcaaaggugcugaggacugcaggaaaauacugcuucggcuuaagucaugaggaaagguuccaaaaggacucauugauuuuacucaggauaaccuccccucccuuccccucaccauuuagaaaucuaaagcuaugaaauucauccuuaucaucaaaauaugauaaaugagcaagccuaaaauaugcuccaaaaauugcaucaaaggacacaaucaacaaagaaaagaggcacccuacggaguaagagaaaaaauauuugcaaaucaucugauaagggauuaacaucuagauuacauaaagagcuccuacagcucaacaaccaagaaagauuaacaaaugggcaaagaacuugaauaggcaauucucuaaagaagaaauauauauaaauggccaagaagcccaugaaaagauucuugaagucacucaucaucggaaauggaaaugaaaccacaaugagacaccaccuuaugcccaugaggauggcuacuacaggaaaggaagggagggaggggagggaagggcgagugugagagaggugugccugcgagccaagauagggagaaacugggcauuguguugcuggugcagcugcuggggaaaacgauacagccauuccccaacaaacuaaaaccagaauuaccacacgauccggcaauuucacuuucagggauauaacccaaaagaacugaaaguagggacugaagagauauuugcuguaugauggguacaggcuuucagucugggaagaugaaaauguccuggagguuggcugcacagcagugugaaugaacuuaacacuacugaacugcacauuuaaacaugguuaagacgauaaauugucuaauacauauauauauauauuuaacaugucaaauuuguucuaaggccacauuuauguuuaauaucuuaguauaauaucagauacaaauaagaguuaaaauggaaucuucucaaggcccuagcccaggaauacacauaguccuacagagaaaaacuguuuccuaaaaaagaggaugcuuccaaagagggcagaaauggucuacaagccaaaauguuuuagaguaagcuuguccaaccugcagcccaugggccacaugggcccaggacagcuuugaaugcaguccaacacaaauuaguacacuuucuuaaaauauuaugaguuuuuuccaugauuuuuuuuuugaucaucagcuaucauuaguguuaguguauuuuauguguggcccaagacaguucucccaauguggccaagggaagccagaagauuggccaccuuguuuuagaggaauacauucauaucuauuauauaaagcuacauauuauauaguauuauguaauauaauauagaaauauucauaaaguaacauuaaaauauuuuauaauauucuaccaauuaauagcuuuuaaaaaaaauuauuucaauuucaaagagacuuuagaagggguaaaggugaagagcuccaagacccacuaaucaucuguagguggcaguagaagcacaguauuuaugucaaagcagcccugaacuaucaaucgguauggaaaaccggagaccauacauaagaaaucuggaucuauuucauauucaaauaaacugugugaguacuccuacauucaauaaauugcaacuaacuucucugauacgaaaccuuuuuaacuugcccacuuuuaccuuaaaaccucuacacagccaaucccaaucuaccuauuucuuuuugucucauuauuuuauuugguacgucuuuguaauuguaucuaccuagaaacauuagccauucauuuuuugagacauggcauaaccuuucuuacagaaaaacacaaacaccagucgaauccauaugccuguuaacugagggccugcugggugaagcacuacucuagaugcgcugaaacguuugaagacgcacgugccagguccuuguucacaaggcacacacaaaacgagaacaagaagaagaaaaggggugaaagugcaaucagggaucaguacccacaugacugucaaagagagaugugucacagauacuucaaacuccaguucuaaaaccuguaauuacugauccuaaaucaaauguuccauucauguuagaagagcaaauccuacaccagaggcagaaagauguaagccaacacagucugagaaccuuuuuuccaaagaagcacagcggcagcuggccugugggucucagggugguccugccugccuccuuccuucccuucucaguuaagacucucuuuagacuguggcuugcugagcgcaagaagcuguaugagcugaaagucauaaacuucucauaaagucuacccauacaaaugguauuagcaauaagaagauaacauugcugcaaauauucaacugaauggaguacuaguuuuauuuuauaagcauacaagggagaguucugguaaauaccuugucugaguaaccaaaaucaaugcaguuuuauuaccaagaaaaaaacaacacgucuuccucuaaagguugauuauaaugucuccaagaggucgacuuaaaaauaaauuuaaaauaugguaaaaaacauacacacugaagaacaauuaaaaaaaaaaaaaaaaacagcgauggcaaagaucaggaacuaaugugaccccaucaggggacugagugcuuugcauuuagaguaggcccaaacuucagcagacacauucuugguuuuccucccugggaugaggacuuaggaaaugcauccuggacgcauucaggcuuccaugcagccuccaagcuccuauccugccggcuccuauccacaguccuacagaaauucagaggaagaccaaagguaaaauacucucugcaaugcaaagaguuggggagaggaaugccuucaaaucacacaaggccggaaguggaugaccccucacagaaggccucacccaacugccccuggggagagugaccaucagagaaaugagcuaacaugguuaagacaaccuggucaguuaguggcacaugcugggcuccugcacagcuauccagucccagucuaaagacaggaaaaauuuaaauaagcuacaaagaaaaaaaggggacaaacgaagccaagagaacuagugcuuagugucuacagcaugcacuuuacacaagcuauaaggcaguuuuuaaauaggaaagguaacacauauacagaaaaguacagcaugccagaaaauccauuugcuucuuuucccuucccuagccuguucucugucccagaggcugguggguccaaacucuaugcaaaggcucaugggccccuggcuuccugcuaacaggagccucaggggagauuuaggccaagaggaaccugaggucacaguguacauuucccugguuccuuccuguaagggaaccucaagcuuaccgucucucaaaagaaaagcacugcuccaagacagcugacuugacuggggucucuccuuccaaguucuaguaaccucucccuuccuugaucucuuugggccuaaguguggugaggguaagaaaagcaacagcuccaggauccugccauacagaugaugggggacccuuccuuauuauuacacaugcccacaccccacccaaaagguuuaccaccuaagcaugaaauccuaagcacuguauuuucauuucaucugcuuuuugaaauuuauacaaauggaaucauaugauaugaauuccuucaugucuggcuuuuucaacuuaacacuagauucaugagauucauccauguuguucuaucugcccuguguaucaucaauugugauugugacuugcacuccacucuaugccuacaccacaagugacuuauucaugcuauaguugaacauucagguuguuccuaauuuggaguuguuguaaauaauguuaccgugaacauucuuguccaugucuccugguacgcagcauguguuuuuacugguuauagaccuaggaguggacucugagucauggaguguugguaucuucauuuuaauacuuaaacuguuuuccauauuuaaacucccaccagcaauguuccuuguuacucgauacccucaucacucaacauccuugccagcacuuugcacuguccgucuuuuucaucguaggcauucuggcgaauggauaauacccugcugugguuuuaauuuucauuuucccaauuauuaauaaaaaguugagcagauuuacauguugcugaccauuuggaucuacucauucuuaagugcuuguucaagucuuuuggccauggaauggcagagaucccagacaccacaauuacauguacgagcugccaggauccagcuauaaaaccuuuccuugagaauaucaacucauuagcaagaaacagggagauaaaaagauggucuauucccucaggagauuguuugcuauaagucaaauuaccauuuaugaugauucucuauuaaguagggccaacuucaacaaaaauuacuaaaacgaaguauaauauuauaaugcaaaauacagaaagaacauacaaucugagagucaugaguaaauauuucugggucacaccauguaaacuacauacuuugcagucagcaugaagguuaaguuagcucaagcaugugaggcucucagaaucaugccugacagucaccucugauuaccuuucauaauuuaguuaagaauaauggcagauauaauaaaaaauccuaaguaacuugucuuaaaccaacaacccucaaccuuauagauacauguuuacuuuuacuauacaaauggcuguguacuaaaauccucaaccacacacacuauuauauagguuuauguuuaaauaaccugauaacacaucucuuguuccuuuaccuuccacaaguccuuuuuuuuuuuuuuuuuuuuuuuuuuuuuugagagggaguucugcucuguugcccaggcuggaguucagccucagcucacugcauucuuggcucacugcaaccuccaucucccggguucaagcgauucuccugccucagccuccugaguagcugggauuauaggcacgcaccaccaugcccagcuaauuuuuguauuuuuaguagagacaggguuuugccauguuggccaggcuagucucgaacuccugaccucaggugauccacccgccucagccucccaaagugcugggauuacaggcaugagccaccgugcccagcccuccucuuucuucugaaaugcacuuccucauauuacuagguguuaacuauacagugguucccccuuauucucagaggauacauuccaagacccccaguggaugccugaaacugcagauaguaccaaacccuauacuuacuauuuuuuuccuguacauacauaccuaugauaaaguuuaacuuauacauuaggcucaguaccuuuguguuuugggaccauuauuaauuaaauaaggguuacuggaacacaagcacugugacacugugacaguaaaccugaucaccaagguggcuaugaaagugacuaaugagugggaaugucuacaguguggagacacugggcaaagggaggacucauguccuggggaggaaggagcgggacagugagagauuucauccugcugcucagaauggcaugcaacagaaaacuuaugaauuguuuauuucuggaauuuuuccauuuaauauuuucagaccauauuugacugaagguaacugaagguaacugaagccucagacagcaaaauugcggauaaggggacuacuguauacccaucuccauuugcaccucugguaacugugagaucagaaugugcagcagaaggcugugugccucacaauaaccauggaguucugcucaaucugcugccuuggcgacucuggaucucucuuccaauaguaaaaugucacacugcaaacucugggccuggggucccaugggacuucagugguuccaggacugauuucacugccaucacuuauauaugguuagauauggauucaacuuguuugcugugagguuaagugucugaaugucuacaugucuauacaucuuuaaaacuacacacaaaaauugcuaaagacaagaaauuugggaauauuaaauuuacaauacaauuuaggaaaccaaacagaaaggagguauacuaacuggguuagaagauuauagcuguaaauuguugggacuuaagaaaaaccacacauuuagacaaauaguuucucaaucuucuuuaugcagaaacucuuacuauucaacauaucuccccuacacccacacccaaagagcagucaguuuagauacaaguuugagaaacagaaaggaggggacaaagguuggaggaugucaaggccaaaggauaggccucuccucuaguucagaggacucuuugucugccucacacccucuucucccuggggacuggcugugugcugacugucccccugcugggauacaugaacaguaacaacaguggaccccugguccccgcacugaugggaggcaacaaggauaagcugcccucacacuugcuaugcuaacagaacaggaaauauuauuuuaccuguggcauagacaaaugucuaacauagaagcauauuuuauagugggaauuugcuauacagaucuauuaacuacauucuuucucauuaaaaacuggcuuaacugaauuauauucacucaaaaacugguuuauagggcuaaaaucaaaauucacuuauggcuuuuaauaucaaaaccaaaacccaaaacugcagcuaaaacacacuauuugauaaagcaaagggaaucuugcagucucugggaauaaguaaaaucccucuuuugcaagugaaacauuucuccuucacucauauuccaaaguaagugaagaaauuaaagcugcaugaauggucccugaauaaguuccucuguuuggggaaaaaaaaaaauucauuagguucaaguauuaaagaaacuugugucuacauuauacaaguugaauccuugacccauuguuuacuugcugucaaaugacugggcaguuucuuuucacuauaauucccugccaacacaaaaccaucgcgaagauccaggagcacagcgaacgggggucaaugcuauagggcucauggguugcaggggaggacgacagaccucaggcccuugccuaagucuccccaucucauaagcuggucaaagugucccugccugcugacucaaggcccagacauuuauccauuccucccccaaccucuccauuucuucaccuacuuguucagucagaaauucaaccaauauuaaaugccucuucucuacacacauaugcaacacaugccaacucucaaggaaugcaauuuaguggaggagaaaaagcaaguaaauaugcaguaacaaugcaaacaugugccacuacagggauagguaccaagugcuaaggaaaccugcagggaugaacaaccagcccagcuucggagggcagagaaaccagcccagcuucggauggcagagaaagcuuccugaaaaagguagcuacaagaacaaagagcagcaggccaugccaucaggugggagacaguggugaggaaugccacaguggguggaacagcaugugagaggcaggaagagcaaauguagccaguccagagggcuggaauggagagcaagaugaggaaaaagugagagcucaccccaaccugaagccaggccuauggagagcccucaggugcuccuggaugccuccucuaagagucuggcaauucagaaacaagaaugccccugugcaccgugaagaauucaagucuugaugaaaggacucuucuagacacaugccaucaauguaucuguugauuuuagcagcaauggggaagcuaaucaauacuuaauuuuagaaaaguccuaagcuaugugaauaaggcaaaggacagauuaggucugcaugcaggcagauuucuguccagcugaaacaucaaacuccugugugaugaaugaaauauaacaucacauauaaaaaacugaugaaugugauucagccauaagaaguccuaucuaguggacagaucaauauaauuaccucauaagaaguuauuacagcgggagaaacuggaccuggcuuuaccuugaguucuuaagcaaguaacuggccuucaauuucuucauccacacaagaaauaguugcuaugguugucuccaacacuucuaaaacccaucauucuggcagguuguaacaaucaaaaguauuuuaucaccaaaggcaaggauuuaaguaacuuuucuaagccacagauuuacuaugguuuugucugagaaaaaaaaaaaaaaggauggaccccaaacugucuaaaauucaaaaaaacaaauacauuuaaguucaugaacccuuuaaaaaguugacaaaccaugcauaaccaaacauaaagauaauuaaaauuuuaggauaagcaaaugagagauaauuuuuuuuaagaaaugagaaaguaaaacaaaauuaaccuaacaaggcaggcagcgauucguugcucacuucccuuucugcugguuucauuucccuucuuaggugaaaacacucuuaauauguaaaucaguccacuaaagacuucagaguccuuucugcuaagauuugcagaaauuuuuaugcaaaagaaauuauuucuagacuuccacgcacuagaaaagcagacuuacaaaauacagcaaacuaaaguggauaaauguauguggcaaagcagaagcaauuaaucaaggauccuacuuuuaagcauuuagaaauguuuaaauaguaaaaaguggaaauguggauauucuaugauuuuuaauaacuugguaguaaaaagugagacuccauuuaggaguaccuacuaagugccagguacuauuaagcacuugggaucuuucugguuuagggccccuacaauccuacuggauauaguauuaucucuauuucaacuguacagaaaugaaguaggaacaaaggguuagucagaguggguagguaacuagacaaagucacauagcuuauaaagcaaagaagcuagacuuuaaacccccuuuuacucaauaucaaaucuucucuuuccauagaugaugcagacuucaagcaucaaaguacacaaacugaagaaacuuuauccuuuguauauaauuaucuuaaauauaugccaucauuucaaggggagcuuaugcuaagugugacuucauaaacaaaucauuugugaaagagaaaaaccacauccaggguaaagucauaaggugaaaaagccuauuucagagagcacuuccugaaagagacaaagcagcaauuaaagucagcccagcaccaacuccgacgccaagcguuacacuggaaacuacuuuuuaaagcaacaaaagagucuaaaacaaaauacaacauuucuuaaauacacuguuuccagaaagagcuauuuuaacagaagcaacucaaagauaucccuucgacagaaguggaagugcugaaaaaugcucaucucucacacagacuuuugauggacaggagguaagcagcauuuaauuaacuucaugauuauugucaaaaguaaugcuuuauguacugcauuucaaaaaucauuucauuuuaauaauacaggcugggcgcaauggcccacgccuguaacuccaacacuuugggaggccaaggcaggaggaucaguugugcccaggagcaccauagugagaccccgucucuauuaaaaaaauauauuuaauuaaaaaaauaaacauaacaaacuauguuggugaaagaccuugaaauaggcuauauaaucaucuuuccacauuaauaugauuuuacauuuauuuucaauauugcuuuacauuaauacuaaauguaauuuuuuucaacuuaaggaaagaaaauguuuaugguaaaucauauguauauuuaggaauguucaucacauguuuucaauuacauuguuucaugaaauaacuuaaugguuuuuaagaaaagaaaagcuacagauaaucaugguaucuauagcuuuuaaaaagcugacuuuaaagucaaucacuuuucaauauuuauccaaaaauuucuguguuugcagagcacaaucaauacuauaaugccuuuaaaacacaugcaucacucauuuuuuuucaaacgucagcaaaugaauauaaguauuggugacaagcuacauaaaaacagcuugagcauaacgugggaaaaaagacucaagaugguuuguaaguacaggacuuaugucacaaaauugaaggaugaggauaggugaagggaguccugaugcaauacuaaaaaaagaaaaacaaauacaaaauuucauuuauauuauaauugcuacuauuuaauaagaaugcauuccaguuaaaaauaagauuuaagccuccaagauuacucuccuuugaaugacacuagagauauaauuuuucucuguagcacuuuccucauuugauagaaauuaauauucuagucacaccaauauuuggaaaauuuaauauguuuuuaaauauauagaauuaugcuccuaaaucauauuuaaccuaaauauuugagaaggaaagaaggagaagaagggaagaaagggaagggaagggaagggaaaggaaggaaggcagacaggcacguuucuuguguuuaaccacagcaauugcucaaguuaauucuuaauuaucaauagcccgugaugccacugaccacagacagcaaaucucccccauaguuuuccuuaaagagaaauucugggcugauuucaagacagcccacucugcaaagugacauuuuugaaggaaacuuuucauccaccuccauauuacaaggggaugccacagauuccaucucauugcagcaaagucuauuuuugaagucuguuguugguguugcaucaugggggaaugaaguuucacacugaggagucaaugauauuugcaaccccaaauaaccuccuuuccauuuaaaauggacgguuuuuuuuuuuuuggugauggaaauuuauaaguuucuacauacacaucaaguuacugaaugacuucuuauuaauaucuacuugucuuagauacuccuuuuuuggauuuacuuugaaaauuguuaaaauuuaaauaauauugaagcuucugaaucuagauggaaugaggauaugaaaguuacuaacggcacuagcuuuuuucaaggugcugcuuucugugaaccacugaaguagagcagcugaaaucacaaaaccuggaagacuuggcuuuacguacucccaauugugcacuagaaaacagcucaucuauugcucuaacagucuaguucuugaucugcugaccaugacacaaaacauugcuguuucucaaccuaugauaauuuaaagagaacauaagguaauaaauauuaugaaguguuuccacuuuaaaaaaaacaaaaaguuuaauagccagcuacacaagucuucauuuucaaacuagagaauuacaaacuagaguuuuuuagcaaaguagaguugcugugaaucaucucaucaaaaguuccuucauuuauucaucaauucaguaaauauuuauuuauugaguaccuauuacaugcucaauagacaguggggcuauagcuguaacaaaggaaaaguucccauucucucucaaaugagaauuacugugaauguucaguaguuaaccaguugaaucguuccuugauuaaaugcucucgaacuuaaaauucacuggcagucaagcugagugggagaauguuaagcauuuauuuuuuaaccaacgauuuuauucuuauuuuucuuaacuauuuuuacaguuucuaaguaucaugccuaccaacaagcuguaaaaugaucacccugaacaaucaagaucaaccugucccuuuuaacagcucacauccagaugaauacaaaauugcagcccuugucuucuauagcuguaucuucauaauuggauuauuuguuaacaucacugcauuauggguuuucaguuguaccaccaagaagagaaccacgguaaccaucuauaugaugaauguggcauuaguggacuugauauuuauaaugacuuuacccuuucgaauguuuuauuaugcaaaagaugaauggccauuuggagaguacuucugccagauucuuggagcucucacaguguuuuacccaagcauugcuuuauggcuucuugccuuuauuagugcugacagauacauggccauuguacagccgaaguacgccaaagaacuuaaaaacacgugcaaagccgugcuggcgugugugggagucuggauaaugacccugaccacgaccaccccucugcuacugcucuauaaagacccagauaaagacuccacucccgccaccugccucaagauuucugacaucaucuaucuaaaagcugugaacgugcugaaccucacucgacugacauuuuuuuucuugauuccuuuguucaucaugauugggugcuacuuggucauuauucauaaucuccuucacggcaggacgucuaagcugaaacccaaagucaaggagaaguccauaaggaucaucaucacgcugcuggugcaggugcucgucugcuuuaugcccuuccacaucuguuucgcuuuccugaugcugggaacgggggagaacaguuacaaucccuggggagccuuuaccaccuuccucaugaaccucagcacgugucuggaugugauucucuacuacaucguuucaaaacaauuucaggcucgagucauuagugucaugcuauaccguaauuaccuucgaagcaugcgcagaaaaaguuuccgaucugguagucuacggucacuaagcaauauaaacagugaaauguuaugaauaauaagguucuuucauuucaaucccaucaaaauucacuucacuaacuacucuggcgucaauggauauucuguauaauacuaucaagucccuuuucucuugaaaaaauaaauucauuaucuucauuuuaaaaacuuauauaaaacauuuuugugaauuauucagagaaaagcaucugauuuuucuuuccuagucaagccuuguucacacagauaauuaacuuuuugcauuucuaugugcaagcgacacauguguguuaaucaagucaguaggggggaaaucgagcuaccauacaaaauaauuugauuaaauuauuuucuaucuagaugcagcucccuuaggucuaauuugcacuaggaauggaauuauaaauccaauacuuuaugucccaaacacugacuuccagaauuccuauauaagaaauuauguugaacucauuacuguuacuuacuacaaggcaaaauuaauagcaacaagaacccaaggggccuguuacagccauccccaucagcccuucccuacucugaauucauucuuuuaaaaacagagaauagucauucaacaaacacugagagccuacuaugcaccaaacccuauuuaggacuaaugaugaaaaucuaaccugagaugcuauuucuauccaauaauccaaguucauuucuaucauuugagguuucuacuauauggugaaaugccauucuccaauacaaacaguuugcucuucuuaugugguugaagauaccauuuuuacaaaagaaguuaauugauuuuuuuucccaggccauaugucacaguauaaauaguacuaguaggaaccuuggauuucuuagccuugccauuuaauuucuccuaauaaaguaacaaaccaaguaacuuauccaucuaaaagaaaaaaacugaacuauaaucuguaaagccccuauuauccugaauacuuauggaaguaaaauaaaugauucaacuauaacuuccucucugcuaaauuaccuuuaucacucuuaacaugaucauauccuacuggggcuuagaaccaaauacaugcauugguuagaaauuuauuucuggcugggcgugguggcucacgccuguaaucccagcacuuugggaggcugagguggacggaucacuugaggucaggaguucgagaccagccuggccaauauggugaaaccucaucucuacuaaaaauacaaaaauuagccaggcaugauggcagguuccuguaaucccagcuacucgggaagcugaggcaggagaauagcuugaacccaggaggcggaggcugcagugagccgagauugcgccauugcacuccagccugggugacaaagcgagacuccgucucaaaaaaaaaagaaauuaauuucuggaaauaacauagguaaauucauauuccuuaaaaaaaaagauaaacacaaaaagucuaauaauaaaauggcauuuuugcacuagaaggucccuuagacaaucuucuuaguacaauucuucuguucgaaauauaaaaaacugaggucugaagagguuaugugacuugcucagcucaagaaccacaccuagaaaccaaggucaguucuuucaugucaaacaccaauuuuucaauaauaaaaagcaaacaugcuuaaagaauguaaacauucucagagcuacauaaggugguacugagaugcaguuucucaauaaagagaaaaacacaguuuuuaguuucaauagucaaaugaguaaaauauauauauuuuuauauuuuauauacauaaaguaccuuuauagauauuauaucuuuauauauuauuuguauaucuuacauauauuuaacauauaauuauuucuaaaacaagaaaaacaacucuuguauuggauauguagguuuauuauacacauauacauagucagagccuacucucaaccauacagaugaaucuacucuuaaauuuauuagauggaaaaguucucugccauagcuugucuugauaagaagaguuuagucucagagcaaaaagcacaacaaaagauucuauugauacaaaaucaagaaagugaaaauguaugcugugauucucacaguaaaacuguaaauaauuuaaauuauaauuuaauuguagaucacuuaaaaguuauuuuuuaaauaauuuacuuagcauuauaaccaaauacauuuaaacauaauauguaaaaauucaaaauuucacuguauucuggaaaacgauguaacauccacauauaaauacuaacaaaaaauaauagguauauaaggccagauguguggcaggaaugaguuacuagaaaugccuaacacauauggcuuuuaauaauggaguuauuucuacuuucaaaaccuaaugguuacauuuucugaguuuaaaucauagucaugagcaucuaucaugucagcuacaauuucuaagcaaagcacuagaaaaagaaaugaacaggucugugguucaaaggccuucccuuacagucuuacuggggcuacacuguaaucaaggcuugcuugcucuucaacauuacuaaauguagggcaaagaguacauaaaguaaaacuugguucccccucaaacagccaguggguagccuagaaggcacagaccaugacaacguaauauaauaaauacuaacagagauaauuaacacauguguuguaauacacauauaaggacaauuaauccugccaaagggcaagaggaagcagaaagcaagccaaguaggcaugagaaugcaaaugcguagcaagcgaagaaagcuggaugaccaguugggaagugguuugagagacuagcugguggucagaugaggaggacucugaaaggaaagaagaguugggcaugguagcacgugccuauaaucccagcuacucaggaggcugaggugggaggacugggcuugagcuuaggaguucaaggccagccuggauaacauggcaagaccuugucucuuaagaaaagcaauacauggaagggguauacgcuugcuccuagaagcuuggcguaagagaccuucuuuaauucucggugcuacccuuugaagcacagaauacccacaguugacaugugagggucaucuagaaacugagcucaggaaauggagcuugagagaagcaacuugcucaagauuucacauaacuaguaagaggcagagcuggaaucucaaaucuggucugauggcaaagaccaugcuauuuccacuauuccagacugccuagauagcaucuuggaggaaucugacuuuuauucugauggaaaugagaauuugaggguuuuuaaaagaacuagugugguuaagccugcauuuuagaaagauaacuucugacagcauuguauggaaugcuuucaaauucacagggaaacuaguuaagagaauuacuguaaaaaaguagacaagaaaagauuuaagaguuuagacugggauaauaaugacaguagaaguagagaagaagggaugaauauucauuuaggacuuugaauuacuaagacucagugccagaaguccuagccagagcaacuaggcaagagaaagaaagaaaagguauucaaauaggaaagcccaaacuaucucucuuuacugacaauaugauucuauaccuagaaaacccuaaagacucugccaaaaggcuccaggaaucgagaaacaacuucacuagaguuucgggaugccaaaucaauguagaaagaucaguaguagcauuucuauacaccaauaacuuaguucaagcugagagucaaaccaagaacacaacacacacaaaaagauaccuaggaauacaucuaaccacgaagguaaaagaucucuacaagaacuacaaaacacugcugaaaaaaaucaaagauggccaggcuugguggcucaugccuauaaucccagccagcacuuugggaggccgaggcaggcugaucacgaggucaggagaucgagaccauccuggcuaaugcagugaaaccccgucucuacuaaaaaauacaaaagaaaguagccaggcaugguggugggcgccuguaaucccagcuacucgggaggcugaggcaggagaauugcuugaaccugggaggcggaggcugcagugagccaagaucacaccacuucacuccagccugggugacagagugagacuccgucucaaaaaaaaagaaaaaagaaaaaaaucaaagaugauacaaacaaauggaaaaagcauuccauucucauggucugaaacaaucaauaucauuaaaauggccauacugaccaaagcaaucuacagauuuaaggcuauuccuagcaaaccacaaugucauuuuucacagaauuagaaaaaauuauucuaaaauucauauagaaccaaaaaaagagccccaaauagccaaagcaauccuaagggaaaaaaaagaaaaggaaaaaacaaagccagaggcaucacauuaccugacuucagauuauaaggcuacaguaagcaaaacagcaugguacugguacaaaaacagacauacagaccaguggaacagaauagagaacccagaaauaaagccucauaacuacagccaucugauauucaacaaaguucacaaaacuaaacaguggugaaaggauuccuuauucaauaaauggugcuaggauagcuggcuagucauaugcagaaaaugaaacuguaccccuaccuugcaccacauacaaaaauuaauucaagauggauuaaagauauaaauguaagacuucaaacuauaagaauccuagaagaaaaccuaggaaacaccauucuggacaucggccuuggggaagaauuugugacuaaguccucaaaagcaauugcaaugaaaacaaaaauugacaaaugggacccauuuaaacuaaagagcuucugcacagcaaaauaaacuaucaacagaguaaacaaacaaccuauaaaaugggagaaaauacucacaaacugcaucugacaaaggucuaauguccagaaucuguaaggaacuugauucaacaagcacaaaacaaccccauuaaaaagugggcaaaagacaugaacagauacuuuucaaaagaagacacgcaagcggccaacacacaagaaaaaaugcucaaagguaaucaucaagaaaugcaaaucaaaaccacaaugagauaccaucucacaccagucagaauggcuacuaaaaagccaaaaaacaacagaugcuggugagaucugggaagaaaagggaaacuuauacacuguuguauauaagugagaaaagggaacacuuauacacuguuggugggaauguaaauuaguucagccacuauagaaagcaguuuggagauuucucaaagaacuuaaaacaggacuaccauuccacucagcaaucccacuacugaguacguagccaaaagaaaauaaaucauucuaccaaaaagacacacgcacucacauguucauuccagaacuauucacaauagcaaagacauggaaucaaccuaagugcccaucagcaauggacuggauaaagaaaauaugguacauacacaccauggaauauuaugcagccauaaaaaagaaugaaaucauguccuuugcaggaacauggaugcagcuggaggccauuauccuaaauaaauuaaugcaggaacagaaaaucaaaugccacaugaacucacuuaaaagugggagcuaaacacuggguacacauggacauaaagauggcagcaacagacacggaagacuauuagagggggaagaagggagggggaaggacggaggggagcaaggguugaaaaacuaacuacuggauaccacgcucacuaccugggugacaggaucaucuguaccccaaaccucagcaucaugcaauauacucauaaaacaaaccuucacauguacccccugaaucugaaaguugaaauuucaaaaaauaaaaacuaagacucagugaccuaccccacugacaagcaaaaugaaagauuuccagcuugcaugacucugaguagaugcuacuaauuaaaauaagaagaaagagggaaagaagacagagaggaggccagaagagaagagagcuucugaacaugaguuuucuuugagucuauaaaucaucaggaaaugagacucuggaccagacaugguggucacgccuauaaucccagcccuuugggaggccaaggcaggaggaucgcuggaggccaggaguuugagaccagccugggcaaaauaacaagaccccaucucuacaaaaacaaacaaacaaacaaaaaauggccggauacaguggcucacgccuguaaucccagcacuuugggaggccaaggcaggucgaucaccugaggucaggaguuugugaccagccugaccaauacggugaaacccuguccuauuaaaaauacaaaaaaaauagccaggcaugguggcaaacccagccacuuaggagacuaaggcagaagaaucgcuugaaccagggaggcagagguugcagugagcagaaaucacgccauugcacugcagccugggcggcaagagugaaaaucugucucaaaaaaaaaaaaaaaaaaaauuaggugggcaugguggcacaucuauagucacagcuacucaggaggcugagcugggaggacugcuugaacccaggaguuugaggugacagugagcuaugaucucaccacuguacucuaggccugggcaacugaauaagaccucauuucuaaaaauaaaauaaaagaaagaaaggaaauaagacucaagaaauaucaggagaguaguguggguuggaaauagacagcugggaagcaaacaauacacguucacuguaguugaaaucaagaaagugggcaagauagcccaaaaagcuugagaaaagagcugcacgcaguaacuaagucagaaagaauuaggagggaguagugugugggacucaagagagcaggugguuucaugaaacaacgagagguuaaaagcauuuaauuugcuacugaaagguuaaagaggauggccaguggcuuuagaaauuagguggccacuggugaccuuuauaagagaaguuccuauauaguggugagguaaaaaaaaaaagagagagagagaauuaaauaggaaguaaagaacuauagagagugcagauaaauuugguacugaugggaaagaaaaauauuagauguuaggugcaaaacacugaaagcuguaaagcacauauuuuuauuuuaaguuccggggauacaugugcagaacgugcagguuuguuacagagguauauaugugccauggugguuugcugcacguaucgacccaucaucuagguuuuaagccucauaugcauuagguauuuguccuaaugcucucccuccccuugccccuuacccauagacagccccagugugugacguuccccucccuguguccaugaaguacauugauuuaaaaaaaaacaacacaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaaccggggaggcggagcuugcagugagccgagaucgcgccacugcacuccagccugggcgacagagcgagacuccgucucaagaaaaacaaaacaaaacaaaacaaaaaaaaaaaaacaguaguuuucucucuuuaguuuuugaagcuuugcuaccaucaauaaaagauauauuuguggcugggugcaguggcucacaccugcaauuccagcacuuugggaggccaagaaaggaggaucacuugagcccaggaauucaagaccagccuagacaacauagcaaaaccuuuucucuaccaaaaauaauaauaaaaauguuuuuaagagauauauuuacauuacacaaaguuuacuuguugaacuaauuguguuccaaaaagucuauguuugagaaagccugaagauuuaaaaaagucauacuauauaauguuuugugacuugaaaaggaagagaaauauauuuucauucaggagauggcugaauuaacauuuauagugucuuucaaaggggaugcuacaacuuuucaauuuauucaaguuuguaacucuugcuacaaacugagauuuaaauagguaaaucccuucccucuucugagaguaagcaaaaguauucccaccaacuucaaaauugaaucaaucuuuuuauguacuaguuaaugggauuccaaaauuaaauaaaugaauaugaaaguucuacugucauucgauuccaugugcagcaggaaaaagaagacaaggagacaguguaaauaagaauaaugcuaaguuacuauccaucuccaaaguucauucuaacacagacacacauaccucccaucacucaguaggcuauacaggaaccaaaaagaacuggccugauaggagauguuuuggggaaaacugaugauuuggcaaugcugcugcuuuccugagucaauguggaaucauuccugaugacuacacuauuuuccccaauaacagaauacucaacuuuaacuucucagucuaauuacaaugaccaccuguggaauucaaacugcaugcuaauuaugacacagaacuuuaugccuccauucaaacauuauucagaaucauacauuauuaaaagagcuaaaggucaacauucauggauauucacaccaacuauaauucacaaaaggcagcuacacuguaaacauuaacaaugcagguacgaaagcuauuagaacacuaacuauaauuuuaaaauagggauccaaagugaauuugaaucaagauacauacaguagcuuaauaguucucaaaacauauauuuaaaauuaaaaggagacugaagauaguacacacagaauuuuaaauaucugguaucuauauuucauacuaucucauuucccaaauagugucucagauacuucauucagaugcuuggaggucauuuacaugugcuaacaacucugcuccuagauucuaauuauuucacacacuaauacaugguuuuuuggggguauuuuguuuguuuuuugaggcggagucucacucugucacccaggcugaagugcaguggagcgaucuccgcucacugcaaccucugccucccggguucaagugauucuucugccucagccuccugagcagcugggacuacgugccaccacgcccaacuaauuuuuguauuucuaguagagaugggguuucaccauauugaccaggcuggucuugaacuccugaccucgugauccgcccaccucggccucccaaagguggcaugagccaccgcgcccggccuguuuuuuuguuuguuuguuugagauggagucucguucugucaacucuacuccuagauucuaguuauuucacacacuaauacaugguuuuuguuuuuuuuaaagaagaucaacgcaauaugaaagcauacaaauucugagugggguuggccacggcagguugucuacaaaguuauaaccuauacaccggcuuuguuuuauguuugauggaaguguuuaaacauuaucagcuuuuaaaaaauuauucuucagaagcuuaacuucguacaaauuaauuuuguuuccuaaucuaauuaaacuauauuuuuguguuuaguucauaaaauuacaaagacaaauuucacuauaaaaacacacaaaacuaauucuaucaggaucagaauaggaaauucacuuaaaauucucuaaaacacaaacuuucaaagcuaaaaaaagaaggugccugggcaagguggcucacacaguggcucaagcacuuugggaggccgaggcggguggaucaccugaggucaggaguucaagaccagccuggccaacauggugaaacccugucucuacuaaaaaauacaaaaauuagccaggcaugguggcacgugccuguagucccagcuacuugggaggcugaggcaggagaaucgcuugaacccgggaggcggagguuguagugagccgagaucgugccaaugcacuccagccugggugacagagcgagacuccgucucaaaaaaaaaaaaaguaaaauaaauuuuaaagaaagaauauaaaauugauucuauuucaagaacauaauaaaaauguaggcauagauuagacuuuuuacauauaaaaucaauuuaacuauaucuagaaguuuaaaauauuauuuuacugacuuucacauaauaauaauaacacuuuaaaucagauucaaguaguucuaaauuaagucaaucuuuaagugcuacuuacaauccagaaggcaaauuacuagcugcagugaugccaaagaaauacugcauagcuucaaugaggagaaagucaaauaaggcugacaaaacccaggaacccagcaaaaaggacuacaaaauaaaacagcagaaaaaugauagagaugagucuccuaaaaauaaacuaacauuuauucagcuagaaucagcucagagguguguauucauauguauguguguguguguauauacacacaugcauauguguguauauauauuugaaauuauuuguuuuuauuaaaauagacuuuagaaaaugggcgggguaaacccauauugcucaaauguauuaacagccauaauuuuuaaguauguugaagauauauuuuuaacaaguaaaacacaaaccacuaagcaaaauaaauuauaauuuuauuaaagucaaaguauuaaaauuuguauuaguguucacaacuaauacuacauauuaucauuaucacuauuauuauuaugcuaaugucuuacauuuuaaaauuuucuuugguuaauguccaugugccucaaaucagauacagaauaguguaauuaaaaagauaacuguaaauaacaacaccaaguuuaacaaaauaaaauccauuuaaacaaaauuuuuuucuacagccuaaguagcaaagacaaaauacauaaaaacuuacugcaaauuuucugcuuccauaucuucuuucaaauauccuaaaauuauaaauaagcagacuacugcagaaaguaucuuucaaaucaaggcaaauuauucuuccacauaucaaccuccaaaucuagauggggauuuaaaaaagaacaauaaacaagaguaaaauuuguucgggucucuuccuuagcaaauuuguuauguuuacacugccuauuuuuaauguccuaaacaaaaucauaaugcacacaccaaaggaaaacuauauauguauguucucugagcucaagucucucauaguaaaaauuccucccaacaguggcacgaaagguacuugaauuuuuuugugcuuauaagaaaacauauucucauuaagauaacagaaaacugccuauaagaaauuucaggaucacguuuaguaagauuuuuuaaaauuauauacguaaacuagaaugaaaggcuaacaaauguucauuuuuauguuauugaauaagacaaaguuguaacugaaaaacaacuuagguauaaacucaaaaauaugcauuucugagcuuaauuuuaaucaucaacuuacuucauagcaacuaugcaaaguaauuuauggcaacugcugcuaaauaugacuagguuugaaauauuaguuuauuuaaaucauuguuucacccaacuucuggcugcauaaaaaacauauaaggggacauacaaaaaaaaaaaaaaaaaaaaaagagcuacucaaaggccuauuuuugagucugcuuaaacauuuuucagauuuuuaaagauaaucccaaugacaucucaaacauccuaaucuuauuuccccuucacaaugaccuuaugagauagguaaaacaaauauuaauuccaacuuuucuuuguauuuuuauugugguaaaacagauauaaaaguuaaaauuuugcuggcugcccagucuggaaagugaggagcgucucugcccggccgccaucccaucuaggaagugaggagcgccucuucccggccgccaucccaucuaggaagugaggagcgucucuacccggccgcccaucgucugagauguggggagcaccucugccccgccgccccgucugggaggugaggagcgucucugcccggccgccccgucugagaagugaggagccccuccgcccggcagccaccccgucugggaagugaggagcgucuccgcccggcagccaccccguccgggagagaggugggggucagccccggccaggccagccgccccgucggggagggagguggggggggucagccccccgcccggccagccgccccguccgggagggaggugggggggucagccccccgccuggccagccaccccgucugggaggugaggggcgccucugcccggccgccccuacugggaagugaggagccccucugcccggacagccgccccguccgggagggagguggggggggcagccccccgcccggccagccgccccgucggggagggaggugggggggucagccccccgcccggccagccgccccgucugggaggugaggggcgccucugcccggccgccccuacugggaagugaggagccccucugcccggacagccgccccguccgggagggaggugggggggucagccccccgcccggccagccgccccguccgggaggugaggggcaccucugcccggccaccaccccgucugggaggugugcccagcagcucauugagaacgggccaugaugacaauggcgguuuuguggaauagaagggggggaaagguggggaaaagauugagaaaucggaugguugccgucucuguguagaaagaaguagacaugggagacuuuucauuuuguucuguacuaagaaaaauucuucugccuugggauccuguugaucugugaccuuacccccaacccugugcucucugaaacaugugcuguguccacucaggguuaaauggauuaagggcggugcaagaugugcuuuguuaaacagaugcuugaaggcagcaugcuccuuaagagucaucaccacucccuaaucucaaguacccagggacacaaacacugcggaaggccgcaggguccucugccuaggaaaaccagagaccuuuguucacuuguuuaucugcugaccuucccuccacuauuguccuaugacccugccaaaucccccugugcgagaaacacccaagaaugaucaauaaaaaaaaaaaaaguugaaaaaaaaaaaaaguuaaaauuuuaacuauugaguauacaauucagugguauuaagcaaauucacaauauuguacacccaucaccacuaucuauuuccagaacucuucaucauccuagacagaaaugccaugcuaacuuccuguucccucuccccuuagccccaggaaacacuauucuacuuaaugucucuaugaauuugcuuauauuagauaccucauguaaguaagaucauuuauuuguccuuuugcauuugcucauuucacuuugcauaauauuuucaagguucaugguaaagcauguaucaaucucauucucauuuauaguugaauaauauucuaugguauguauacaccacauuuuguuuauccauguaucuguuaauagacauuuggguuucugccuuuuugcuauugugaauaaugcugcugcgaacauugguaauaguaacucuuuucuuuuuuuuuuuuuuuuuuugagacagggucucacucuguugcccaggcuguagugcagugaugugaucacaucucacugcaggcucaacccucugagacugaaucaauacucgcagcucagccuccugaguagcugggacuacaggugugcaccaccacacccgucuaauuuuuguauuuuuuguagagaugguguuuugccauguugcccaggcuggucuugaacuccugggcucaagcaauccauccacaaacguuggccucccaaggugcugaaaugacaggugugagccaccacacccagccaacugucuuaaggaaaaagaggcacagagaaacuaaaguuuguaaagucauacaaccugugcucuugccaacagaaauaagaauacaaaugagaagucugagcauaucaacugucaaaaccugucacauaugucucuacuccaagcaagacaccaggcagagucuuugucaugacuguacuggccaccagaguucaccucaccugccagcccagcugaacugggauggcugccucuaaggcuguguugaggccauagcugggcucaaggagaaacaguaccggagucacacugaaacuuuaggcagcauauaccuccaucaauaugaucaaugaggcaguacacgagagcacauaggaaacugccaaggacuuuaccaauguccgaugaugaugacugucaucuccucagaacaccagauucaaaaaccauaagaggcagcuccaaguccucuauccccacauuuaauauuacaaugaaaauacucuacucagggauaagcucugagagccacuaagaaaaucugaggauuaaggaaauggagaguuuguaauuacuaagauauaacaaacugcauuucuagaaccccauuuuuucaguuaaugaaaauaaagcugcuagcuacaguuuuaaauaauuuauguguugcaaucauacucaaggacacaaaacuaugagagcugguauaagaauaaaccacugcauauuauuauacaggugaauguccccuaaagacugguaacuggcuaccggcuugcacucagcaaagcacugcuucugcaacucaaccuaaagaaaacugacuguaccucugcauucacugccaaaaucuggagguucagaacuuacaaaauaaagcccuucaucaacugagcccuccuggacuucuccaaucuaagccuggguuugccucaaagcacgcuuccuguaccacacuccuaagggucugaaauucauguuacuuccugaaguaaaaugcccuucccucucuucauugcuaauuaacagucaucccuucuuuuuggaccaaacugaaggcucacaccccuaagacucuccagagguaggcccccaauacuggucccuauuuccuugaucaccccccaaggaugucauguacaccugugaccuacagaucacguucuuauguguaugcguguguuuagauuucccaaggcagaacugcaacucccauaucucucaugaauacacacugagagccucuuagguguuuuaaguguuaaucuggauguggcuauucccauuccuggacagaagaguggucuucuuccauccaagcaggucaccaccuuuaaagcacagaugcccacagagugggcuuagccaaacgaaccaaauuaacuccagaaauuaggaagguaucaacccaaggcccgggggcccuuacauuagugguccucaaagccagccauacacuagaauccccuagggguuguuuuuaaauguacagcaaugcccaggcgccaccaccagacucugugacucaguuguucuggggcgagauacuguguuuauauaaaucuagguauaaauuauaccuucacguaaguauagauauggagacagaucuuugaaguuuuuucaggugauucuaauguguguccgggguugagaaggacugcauuauagcaacugaaauaauacagaagcuacacuaucuucugacaaaucaguaauacggauaaauaacuaaaagaccugcacaguaaguuggugaagccaaucugagcaaugguauuaauuauaucacuaugaagaaaaggugucaguguucaagaaauggauuauuaugcuuaaaaugggcuaaccaagugcuuagcaaagaaaggguagcagucauauaccagaauuugcaugaacacuccaauucauagacaagaacccaguacuagcauuuucaacaagaucaguccagaaaccuugaaaagcacuucugcucuuucccacagcagaaacucaagagaaauuucuuacuucguuuaaccaccacuguaaaaguuaucaaaaauucauaaucugauacagcugacagagccuagcuccucuaaucaaauauucaaauugagacaagguuuuggcaaagcuaaguaugccuacugggcauuaaaaaaagauuaaacauuguuuuuaauucccuugaaguuauaaauuacacuucucugaguaaaaagugaaacugaaaacaaaugugccuaauaaaaggaaauacugccauugcuucauuauuaucuguuuugcugaaaaaucaauaacuagaaaaguuacuuaaugaaauauuaauaauaaauauuucuuacaaauugggggcuuugagggacuaacagcaggaagaaaaagcaaaucuagaaagaaaaaaaaaaaacuguccgcucuccucucaggggccaaugaggcagagcuuaccuggaagucguucuugacugcgugaaggucauacacaaagagcuucuggcagugaggcaggaggagggcgagcaggagggagagggcacuggggaccagcagaaggcucuucgacagaggcgccuugucuggagggaaaaaggaaagcacuuucagaaugauuguuccuaagauuuaaaaaaccacaugcgugaaaagcaagagaauucacuucuuuuaaaucagaaugaagacaaaguccagaaacucugaaauuugguucuaauauccacuuucaaaacaucgaccuggggauguaagugaucaaaagacacuggaaacaagcagaaugcccuagcagggcuucauugccaguuggcucuuaaaugagaccaaguuuacagccagaacuuccauagaacaccuuucagaaaauggcuacccaaguguaaagaaauagagaaguguguuucuaucaaaucagccaguuagcuccugagcaugcacaaaacucauacauauauaaaaauacauuuuuaauuucauuuuuuaauugauacauauuagggaacacauuuugggaguacauaugauaaucugauacauucauauaaucauauccagagagagucucacuuugucgcccaaacuggagugcaguggcgcaaucucggcucacugcaaccuccaccucccagguucaagcgauucuccugccucagccuccugaguagcugggauuacaggcacgugccaccaugccuggcuaauuuuuguauucuuaguagagaccauguuucaccauguuggccagacuggucucaaacuccugggcucaagcgauccuucugccuuggccucccaaagugcugggauuacaggcaugggccacggcacccagcccggguaauuaucuuaaauaucucucuuuucuuuaggcugaauuauucucuucuagcuauuuugaaacguacgauagauuagugucaacuacagacacgcuccugaccuacugaacaccgucuuauuucuucuaaguguauauuuguacccauuaaucaaccucuuuuuaucccccucucccuccuacccuucccagccucugauaaccaccaaccuacucucugucuucaugagauccacuauuuuagcuuccacgugugagaacaugcaaucuuugucuuuuuguucuuauuucacuuacaugucuucuaguuccauccauguggcugcaaaugacaggauuucauucuuuuuauagcugaauaauauuccacuguguguguguguguguguguguguguauauauauauauauauacgcauaaaauuuucuuuaucuaucauccauuuuuuucccauucauuggaaacucaaaagagggaacuagucaauaaagauggaaguauacaacaaagaaggccgggccugauggcucacaucugcauugauggacacuucaguugauuccacauuuuggcuauugugaauagugcugcaauaagcauggaagugcagauauguccuugaaauacugauuuccuuucuuuugaauauauauccaguaguggaucauaugguaguuuuauuuuuuuuuuuuaagaaccuccauacuguuuuccaucgugacuguacuaauuuacauucccaccaacaguguaccaggguucuccuuucuccacauccuggccagccucuguuuuguuugguaguuguugccguuuuugagacagaguuuugcucuuucgcccaggcuggagugaaguggugccaucucggcucacugcaaccucugccccccggauucaagugauucuccugccucagccuaccaaguaccugggauuacaggcacccaccaccaugcccagcuaauuucuguauuuuuaguagagacgggguuucaccaaguuggccaggcuggucuugaacuccugaccucaggugauacccaccucggccucccaaaguacuaggauuacaggcaugagccaccgugcccagcagccagccucuguuauuccugucuuuuugauaaaagccauucuaacucgggugaaguaucucauugugguuuugauuugcauuucucugaugaucaauaauguugagcacauuuucauaugccuguuggccauuuguaugucuucuuuugagaaugucuauucagaucuuuugcccacuuuuaaaauggacuauuuggguuuuugcuauugaguuguuugagcuccuuacaaauucugguuacuaaucccuugucagauggauuaaucugcaaguauugcaaguauuuucucccauucuguggguuaucucuuuguugacuguuucuuuugcugugcaacuggagcuuuuuaguuugauuuaaucccacuugucuauuuuuccuuuggcugucugugcuuuugagaucuuacacaaaaagucuuugcccagaccaacguccuggagcauuucuccaacauuuucugcuaguaguuucauaguuucaggucuuagacuuaagucuuuaauccauuucgauuugauuuuuauguauaguaagaaauaugggucuuucauuuuugugcauaugguuaacccguuuuaccagcacaauuuuuuuuuugagacagggucucacucuauugcccaagcuggaguccagcagcaugaucacagcucacugcagccuugaacuccugggcucaagugauccucccaccucagccucccuaguagcugggacuacaggcacaagccaccacaccuggcuaauuuuuuuuuggagaaauagucuugccauguugaucaggcuggucucaaacuccuagccucaagugauccucucgccucagccucccaaaggguuaggaugauaggcaugagccacugcacccggccccagcacaauuuuuuugaagggacugucguuucuccauuguauguucuugccaccuuuuuuggcugcaaaugcauggauuuguaucuuggucuucuaaucugcuccacuggucuaugugucuguuuuuaugugaguauccugcugauuugguuacucuguaguauauuuugaagucaggcaguaugauacuucaccuuguucuuuuugcucaggauuauuuuggcuacucagaaucuuuuguguuuccauauaaaucuuaggauuuuuuuuucuauuucugugaagaaugucauugauauuuugagaggauugcauugaaucuguaaauugcuuuggguaguauugccauuuuaacaauacugauucuuccaaaccauaagcauggaauacccuuucauuuuuuuauguccucuucaaguucuuucaucaguguuugauaguuuuccuugcacauauauugcacaucuuugguuaauugauuccuggguguuuuguuuuuaaaaaauuaaaagaggcuaaaaguguuaacacugcugacuguaguggcccccugagauuuuccaccaugaguacaacuggagcccaggucaguuuuccaggagagacuagugugaccucugccuuguacuaaaagcagucacgccccucuuccuccuugaucuagucauuuacauauuaaguaugacagaauuauacuacugaggguauuuuagaaacuauaaaugucuucucucuucccucugauaugagagaaaaaaagaagcaaauuauguuuucuucaagcucacuuuuuuucccaauagaacaaaauaucagcuuucaccuacucaggaacauuucccccaaguaugucauuuaaucaaaaugcacacuauugugagacaucuagguagccucuucucucccucuggucuuccuugguuccaccuuuguguuuucaugccuuccucucucauagauccugaaaacaagccccugaagcuacuugcugagcuaauccaugggaaagaacaagagcuaugagaagggaaaggaccuggggcccagaagacuuggccuugaaccuucauuuucacacuuacugaugcuugucauuggacacaguaucugaccucucugagcuucagucacuucaucugaccuaauucucaggguuaugcuaagaaugaagugagguaaugcauguagaaauggcuagcacaggcagggcgcaguggcucacgccuguaaucccagcacuuugggaggcugaggcgggcggaucaccugaggucaggaguuugagaccagccuggccaacauggcgaaaccccaucucuacuaaaaauacaaaaaaauuacccgggcgugguggcaagcgccuauaaucccacuugggaagcugaggcgggagaaucacuugaaucgcuugaaccuggaagguggugguugcagugagccgagauugugccacugcacuccagccugggcgacagagugagacuccaucucaaaaaaaaaaaaaaaaaaaaaaaaaaaaagaaacggcuagcacaauguccggcccaugauggagacucagaaaaauaaagugcaucucaaucuaggaaaaccgcugaaauaacaugcuuuccuuggaaauaauuacuuuauauaauaacccuguaccucccuuuguaugggagcucuguuuucacucuauuaaaucuugcaacugaaaauaagaauaauaauaauaauaaaauaauaacccuguaauauucauaguaucaaaagacuagucuugagaacucaagugguaccagcagauuugguuacaaaaacauggcugagauuuccaucaaauaaugaaauacuuacgcuucaucgggaaccaaaaacacugccuuuuuuuuucucccauccuuuuaccgugaaaaaguuuacaauuaagacuuacacuaggguuuacauaaugauaauuuugauaauucugucauuacuuuucuauuucuuagcuggccuucugucuucauucuccuuguaucucgguaucacucuacacucauggauuuuuacuuagucaaugugucacaaucaguugcauucuuuuuccaacguucagaugguccagguggaagcccucugaccagcuccugcggccuuucaaccagggcccucaacgccugcucuggcugcuccaccuacccacucaucuuccuugcuuuaggcucaccuauacccgcccugcccaagaccuagaauuucucuaaggaucccuguuagggaauguugggaaauggucuuuagaaaccaaaucugaggccgggugcaguggcucaugccuauaaucccagcacuuugggagaccgaggagagcagaucaugaggucaggaguucaagaccagccuggccaacauagugaaacccugucucuacuaaaaauacaaaaauuagcugggcaugguggugcgugccugcagucccagcuacuugggaggcugaggcaggagaaucacuugaacccggguaguggagguugcagugagccgagaucacgccacugcacuccagcuggggcaacagaguaagacuucgucucagaaaaaaaaaaaaagaaaccaaaucugggcauuagaugugcucacuguaauuuucugggucccaaugcuucuagcucuuucaguaaucagagcuagaaaauauauuuuugaaaucaugauucauaaugauauuuccaauucaaauuuaacaauuuaacacuacagugcuauuuuucuuuucuuuuuuugagacagggucuccuuguguugcccaggcuagagugcaguggcgugaucucagcugacugcaaccuccaccuccuaggcucaagcaauccuccugcuucagccucccaaguagcugggauuacaggggcaaggccccaugaccggccagguuuuuuuuucguuguuuuuguuuuuuuguguguguagagacaggguuuugccauguggcccaggcuggucuugaacuccugagcucaagcgaucugcccgccucggccucccaaagugcugggauuacagcugugagccaccaugccuggccuacagugcuuuuuccuaaggacuuugcauuucugucguuucucucuuaaauauuaauaguuagcugcuugcuuuauccuagguuauacauaaaauuuuaauauuacaguaucaguaucauuacaaacaauaaacuacuuauuaagcccacugggcgaaguuuaagauaccuuugaagauuuuuuuuuuucuuuugguccuuagaguaugugugugugaauauauauauauauaucuauaucucucaacuaaggauggacagggucuuguguucaaaagcuacuugaaagaauuauuuucccuagugguuauaacacagagauuuguuuauuucuguuuacauucaauauuaaaguuugcuccuuucucaguuaaaauuuuugaauauguuaaauauuuacauuguucaaaaaccaaaaccaggaaaaacaaagguuuacuuucacuucaguuauuuauccccucuaucccauacccccaaacccacucccauagauacacacuucuaauaguuucuagcuuaacucccaauuuucuuuuuuaaaaaacaaguaacacacauuaaccuauauaaauacacauguagacaugguacaaaaauacacacacuggcaguuccucauuucugcauagcucugauaggcacagacuucaguuaccaugauuugguaaaacaacaccagcucuucaguacauagaucauuaugucaguaagacgugcauuaugaucagcaaccaaucauguaugucacuucuuucuaagucugucagugacuggucacugggcagcuguuauuccauucaugcacagacaguaaaguauguaguuguguugccucaucuuccaaugauaaauucaugugacauuuuacaaaaauagaucaucaaaagagggaacuagucaauacacaugaaaguauacaaaaagagagccaggcgugguggcucacaucuauaaucccagcacuuugggaggccgagacggguagaucacuuaaggucaggaguuugagaccagccuggucaacauggcaaaaccccgucucuacuaaaaauauaaaaaguagcugggcgugguggcacgccuguagucccagcuacucgggaggcugaggugggagacucacuugaacccaggagacagagacugcagugagccgagaucacaccauuguacuccagccuggacgacagggagaaacuccaucucaaaaaaaaaaaaaaaaaaaaaaaauguauacagcaaagcaacaaaaaguaauagugcuggaagugaaaugugaaucaaauguuaucagguuauaaaagaaauaucaaaccacaggaauguugacacugccaccauucaaggugggcagcuagagaaacucagugaaggugaacuuaucaacaggaaggugacugugauagaauacuggcuccccaaggagguccacguccuaauccccagaaccugugacuauguuggguuacacagcaagggggaguuaagguugcagacagaauugagguugcuaaucagauguccuugagaugagacuaccuaagauauccagcuggauucuaugcaaucacaagaguccuuuuuuuuuugagacggagucucccucugucgcccaggcuggaguacaguggcacaaucucagcucacugcaaccuccgccuaccggguuuagcgauucuccugccucagcccccugaguagcugggacuacaggcacgugccaccacauccagcuaauuuuuguauuuuuacuagaaaugggauuucaccauauuggccaggcuggucucagacuccugaccucaugauccacccgccucggccucccaaagcgcuaggauuacaagcgugagccgcugcaaccggcccacaagaguccuuuuaagugcaagagggaggcaggagaguaaguuucagagugacaauguguaagaaagaguccaccagucacccuuggcuucgaagauaaaauugggucaugagucaagaaaugugagcugccucagaaagcuacaaaaggcgaagaaacagauuccuucucagagcuuccaaaagaaaugcagcccugcugacaccuugauuuuaucccagugagauccauuuuggacuucuggccuccaaacuguaggauaauaaauuuauuuuguuuuauuuauuuauuuauugaggagacagagucuugcucuguugcccaggcuggagugcaguggcgugaucucagcucacugcaaccucugacgccucccagguucaagcaauucucgucccucagccucccaagcagcugggacuacaggcgcuugccaccaugcccagcucauguuuuuguauuuuuaguaaagacaggguuuugccauguugcccaggcuggucucgaacuccugagaucaggcaaucugcccaccucagccucccaaagugcuaugauuacaggcaugagccacugugccuggccauauuucuuuuguuuuaaaccaccacguuugugauaauuuguuagagaagcaacaguacacuaaaauagugauuaucaugucccugaggaagugaugcuggcaaaaaucuacauauuaaggaaacucucagggauauuuugucacauugaaagcagagagaauaaaauaauggaaacucagccaaacucagaaagguguaugacaauucacaagguuuaagauagauacuccccauaaguuacacaacaggaagaaggcaaacacuguucaaacugcuccugguaaguuucuuacaaagaaauaaaacccuuuaauucucaaugucgcugaaguuuuuaauaaauuacaguauacuguuuuacuauuuuuucauuucccuaugcauuuauaacuauacauuuauaagagaaagucuaaaguuuuaacaaagcauucuuucaacgaagauuuuuaaaagucacagaacaauccaaauuuuccccauugauuauuaaaauagcuuugcccgguuucaacuugcacggucauuuuuacgguccugcaucaccuugcaaagcaaggacuaucuguguguguuuguauauacucuuuccuaaaacgaggcugcaauguggucacuuugguaugaccuucaagcucaaaugacaagucacugucccugguuguccagaccucccuacauucugggccuccugccucuccagcacaacauccauugcuuuguucucaggagccuuugcugcaaucaaaccgcacagcucacuaccuccugaacauguugcuuucuguuucaaugccuuuggaaaauuuuuccagacuuaaauccccaaauaucaucaaugccuuccuuauuagcacagauacucccuuaucuaaaucuuaugcagccuucaaauuacaguuguuucuacuuuccuccaucagccugagugaaccauuuuagccugaagggcuuuucccccacucugcacccucguucccacacacuacuaugagcagccaggguuuguacaguuuugcuaucccaaccacaauaaagauuccugaagggaggccacaugccuuacccuucgcuacauccaccauaaagccuagcaccgucccuugcacagaugaaacguccagaucauuaacagccaagaucacagaaaagccucacugauggggacauucucagauucugugagaugcaccuucaucuuauucauaagaaauucccugggggcgaauuuaccaguuacaguugacacugugguuauuguacuugucuaagcauauaaaaauagcccaacuauuuccucucugguaaggucuugugagcaucuaaacuagaaccauuaguaaagugguugcauacuuucuucaugaccaaaaugcaaacaaggcuccacggaaucuaaaaucuaaccgaguuccucauugccucguaauucaaaaguagaggagagcaccaugacuauaagccuaaccaaccuaaauccuuucucgagccauuucagccucaauuuuccucaccuguaaaauggagaugagaaccuaccucaaaaguguuacgagaagaaaaugaaauaaaagaauaaauauaggggcugggcacaguggcucaugccuauaaucccagcacuuugagaggccaagucgggcagaucgcuugaggucaggaguuugagacuagccuggccaacaucgugaagccccgucacuacuaaaaauacaaaaauuagccgggcgugguggggugcgggggagccuguaaucccagcuauucaggaggcugaggcaggagaaucgcuugaacccaggagguggagguugcagugagccgagauugugccauugcacuccagccugggcaacaaagcgagauuccguaucaaaaaaaaaaaaaaugaaugaauauagagaauauugcuccuaccaccagcaccaucacaacaccccgggcuucccccauuaaaggcaagcuccuuugugacucugacaggacugcagauggagcaggggugauguaagugcaacgggcagcuugauccauguuuccuucaacuuggguuuccaccuguccuugugcaaugggccccgucaguccuuccucuuccuugccagcuucugagcaacucaacaugacucaaaaaagucacccaucugagcuacaagauuucaccauaaauucuuggucucaagucucaaggugacacucuccacugaccagcauuuccacugauuuucucuaguauaucugcucuacaacuucuuaccucacacuaucucuuccucucuccucaaaccucccuaauucacacucccaacuugaauaccaaacucccaacacaugcaccaaaugaauaaaugaacgguuugcuuugguauucucaaucauucucuaaauaugaguaggcauccacgcuguaccaugcauuauucuagguccugaggcacagcaauaaacuguggacaaagucccuagccuugugguuuggaguguagacaggacagaaaaacaacaacaaacaaaacaagguagauauacauuaugucagauggaaauaaauccuaugagaaaugaacuagggaaaauaaaaccuguggcuuuguuauucaccacauauuucccgucucuucccaaacacaugguaggacugcuccccacccccacucccaaaugaagugaggcauggcagugugacuugcucuggccaaguaaaugaaagcuaugucacuuccaggaggacccuuuaagagccagggaaucauucuuguucuuuucaccugccaacgugcaagauggugguuacucuaucagccagcucccggggcugacgacaguguggaguggaccccuccuagguaacuugcaguggagauggaacaccagugagaugcaagccuugucucggguuccugauauuucagaguuguuugcuacugcagcauaaccggggaaggaggggugccgucuuuuuuuguuguuuuuuuuuuuuugagauggaguuucgcucuuguuguccgggcuggagugcaauggcacaaucucggcucauugcaaccucugccuccuggguucaagcgauucuccugucucagccucccgaguagcugggauuacaggcaugcaccaccacaacuggcuaauuuuguauuuuuauuagagacugaguuucuccauguuggucaggcuggucuugaacuccuggccucaggugauccacccuccuuggccucccaaagugcugggauuacaggcaugagccaccgcgcccagccaaggggugccggucuuauccaaccugguuagggaaaaccuucuuguaauguggauuugagcagagaccugaagauguaggccuugcagauaucugagggaagggugauucuggaggaaaaaaaagcaaguacacaugcuuugagaugaaaacaugcucaacaugauuaagagaugauaaggcugccaacuggcaaaagcagaaugagcacaaggcagacagggagggagcuaacgucaaacaaguggugaugaggggaaugguccagagcccuacaggccauuaugaggacuuuaaccuuuccucuggaugugacagggugcuuuggggaggucuaaguagaggaauaacaugauuggacauguuuuugaaugaucacuuugguugcuaaauugagaagaaauuacaguaaggcaaugguggaagauaguaaaccaguuagaaggcuguuagggaauccagggaagaaaggaggauguucaaaccagcaggguggagguguagaugaagagggagguugaaacugggauauguugugaagguacugcaggcaggauaugcugacuaaccgggugcaugggcagauggagaagucaagaauaaaauuaaguuuuguucuggacaacuggaagaacuguuggcaguuacugagauggcccugacuaaguuuacugacauguugucuuuccuaccuacaagaucugggcccaucuugcaauaugcucccccaagccuucaccugccaggucucucucuccucucuaccagugccacucaaaauaaccagucugcaaagugcuaccagcucacaguggggucagaguuugugccaaaugugaaucaacauacugccuccuucagggaugaaguccugcuaugaaaacauaucaacuaaacaugugcugugcucaaauguuaccuuauccuuuguccugcuuuuuucauagcacuuaacaguggauuuaauagugauccaucaacucuaugauucaaacugauacaccauuauuuuuagugccacuaaaaaauaaacgcugccaaauauaauucuaagacgucaucaauuacaaggcacguuccaauuuuagaaucauuaaaacgugggaccuaaugcauuuuagaaucaaggaaauauguuuauuggucuauuguccauccgcccaucuucagucuccacuagaacacaagcuuacuuagggcaucagcuuugucugguacauuccuuguugcagcaucccucaugccuccaauaggaccugacacauaaaggcagucaagaguguuuguuaaacaaaaggggagugaugugaaggaggugcucacauacuggcgggaggaacccaaguguccacuggcagaugaaugcauaaacggguaaacaaaauguggcauacacauauaauggaauuuaauucagccuuaaaaaggaaggaaacuggcacauggaacaacaugcaugaaccuugaggacauuaugcuaugugaaauaagccggucacaaaaagauaaauauuauaugauuccacuuauuugcaguaccuagaguaguaaaauucacagaggcagaaaguagaaaagugguugccagaggcaggguacagugggcggaggaagggggaaaugggaaguuguuuaauggauacagaguuucauuucugcaagaugagaagaguuauagacaucgguugcacaauaugaacguacuuaauacuacuggacuauacacaaaaauaguuaagauuguacauuuuauauuauguacauuuuaccacaauuaaaaauuaaaacuaaauauaagcaaauauuuacugaacuaauaacugacccuauuuacacagccauuuuaauucuguccaggaccaaacaaaccccuaaaaauacagaucugauaauuaccauuaaguauuccucucaaaaugagcaaaaaucacaucucagaaaccuauguggaaagcaauaauacacaaauauccaaacaguugcacaucacaggauaaguauauaguaucauuauagacaacaagauucgcucaucaacucaagauuuguacuuuuacuacguaaaaauuuuaacucaaaaaccuuuaaauaguuauuauuaaacucuagggaauaacaaugcacauuuaaguguuuagagaaaaugugacuauaaucuacuuugaaaugcauuuuuaaaaaucauaugguacugaucaaauaaauaaagggauugauauuugcuaaagccaacauaguaaaauguuaauuguguagaaucuaggugguggguauauggguguucaguguaccccucuuucuacuuuguggcauguuugaaauuuuucauaauuaaaacauugggugggaggugcacagugaaucauagaaucugagagcugagaaaggauuucaaugaagcaaaaauuaauagaacugaaaugggacguagauaaauccacaaauauaguuggagaauucagcacucuucucacaguaaucgauaauacaagcaaacagaaaaucacuguuauggacugaacguuuccuccuaaaauuuguauguugaagcucuaugcugacuaaguuuggagauaggcccuuuaaagagguaauuaagguuaagugaggucauaaggauagauggagcccuaauucaaugugacaugucuuuuaagaaaagggagggacccagggaugcuugcacacacaaaggaaagaccaugugaugacacagcuagaagccagcaggcuccugcaaggccccaggagaaaccaaacccgccaaaacccugagcuuggacuucuagcuucugggucuguaagaaaauuaauuucuguuccuuaagccacccagucugugguauuuuguuauggcagcccaagcugaccaguaaaaucaguaaggauacacaagaccugaaaaacauuaucaaccaauuuggccugauugacauuuauagaacacuccacccaacaacggcaaguuacacauuuuuucaagugcauauggagcauucaccaaaauagacuauauucugggcauaaaagaguccucaaaaaaauuuaaaggaauuaaaaucauauaaagcauguuccuuggccacaaaaaaaucagaagccaacagcagaaagauggaaaaucccccaaauaugugaaaacucaacaacacauuucuaaacaauaucugggucaaagaggaagucacaaaggaaauuagaguauauuuaaaacagaauaaaaaaaugaagcacaaccaagcaaaauuuguggacugcagauagagcaaugcuuagaggggaaaauguagcauaaaaaugcuuauauuaggaagaaaaaaggucucacauaaugguguagguuacaaucuuaaaaaaaaaaaaaaaaaaaaaaaacagaaaaagagaaagaagagcaaauuaaaaccuaagcaagcagauauaaagaaauaauuaagaguagaaaucaaugaaauggaaaaaacaaacuauaauagagacaaaucaaugaaacucaaagcugguucuugagaucaauaaaacugauacacuucuagcagaaaugaucaggacaaaaagagagaagacacaauuaucaguaucaggaauaaagaggaggcaucacuacugaccccagagacauuaaaaggauaguaagaaguugcacaacaaugugaauguacuuaaugucacugaacuguacacuuaaaaauaguuaaaacaguaaguuuuauguuauguauuucuuaucacuacuaaaaugucuuaucacaacuaaauuuuuuuuugaaagggaauguuaggaaauacuuuacgcccauaaauuugauaacuuagaugaaacaggcaaacuccuuggaagacacaaccuaccaaagcucauucaagaagaaauggguaacuuaaauaguccuacagauauuaugaaauugaauuuauaguuaaaagacuuccaacaaagaaaacuccaagucugauggcuucaggggagaauucuaccaagcauuuaaauaccaauucuauacaaacucuguuacaacacagaaaaauagagaacacuuuccaacucauguuaugaagccaguguuacacuguuagcaaagccaugcaaagauauuaaaaggcaaaaaauagaccaauauacuuuaugaacguauuaacagaugcaaaauucucaacaaaacaucaguaaaucaaaccuagcauuauauaaaaagaauacaucaugaccaaauaaugcuuauccugggaaugcaaagcaaaucaauguaauuuaccauaucaacaaguuaaaguauacuaugaaaccauucucauccugcccaauuacugcuuauucuaugaaaccaauuugucaucaauccauaaggcuaaacugaccacuuacugcuauguaauuaccaaugggcuaccccuuugaucuaaccucaauuauuaauuacuaauauaaccaacuaguaacuacuaauaccaaccaacauuuauuaagcacuuaggaaguggagguauuagcaucacacuuuaugugugcuacuuugcuccugccacucccacuacagggccuaugugccuguuacucucucuacccaaaauguucuucccacguccagcuuauucucaccauugaguccucauuucuaagagcaccuccucagaguggccuuccaucgugauuuuuugcuuuugagugcaucauccugguuaauuuacucuguggcauucuuuacuacuugaaauucuuuguuugcuucuuuguccgucuccuucaucagaauguaaacccugugaagacaggguccuaguugucuugcucacugccauauccccauagccagaaugccaccacuuagcacacaguugccuuucaguaacuauguggugaaugaauuacuuacacgguuuaaaccucaaaauaacccuaugaggcagacaucacucuucucagauuuauacagaagacaaaacugugacucggagaguacauuaccuauccaugacuagaaaaugucuuagccgggguuccucuaagaguaaaaggugagacaaaggcuuccaggcagggacuuuauuuuggaaugugaucccagggagcaguagugaaggacacggggagcgaaacagaggaagaguccaaagaagggcacugucaaguaggcgaucaccaugagugacagauguuucugacaggugcuggaaccugcaggacuuuccgagaagccuugugaaugugucucaacuaccaucccagguggaacagggcagcauuuuuauccaucagcuuccauccucaauggucuagaguggccauagaaaagaagccccaugggaggaacacagaaauaggaacaaaaaaccagcuuacacaccaaaugggacucuguagaaauaaaauaaaaggugaggcugaguacacugaaacagugugcaagaagaagcuagugagcagcagaaccagaauucaagcucugauaauccggacuacaaacacaacugacuacacugcacugccauauagugccacgguucaaacaaauuuucaccuucaugguggauuucaagugaaagacauacacaaucacaaacagcacuaauagaaaucaaaguagugcccuguguaacaaaaguaaauguaauugugaacgaaauauaaaaagacugcaguuuguggagguugcaacacagauccaagaaauccauuucuaggaauuuagcccaaaguaauuaucauaaaugugcacaaagauucugcuacaacaauguucaucgcagcacuguuuauaauagugaaaagaccagaaacaauaugaauaucuaauugggaaauggguaaauuauguucuauccauaaaaaugggauaauauucaacauuaagcaauagguuguagaaaaauauuuuguaccuuggaaagauguuccuaaauaguaagcgcaaaauauucuagugguauuauuauacaaaaauaauauauaaauacuuuuuuuaaaaaagcaucuaccaaaauauuaacagagauaaucucuggucuguucaugggagaucuuaauuuuuuaccaaaaaaaaaucgauuuugacaauuagaaaaaauaauuuguaacuaguuacuaauucaagaaaaagauccauauggugaauccuuaugcacugagauggggcaagucacuaguaaucuucggccucucugugagcagagccaggaagugguucauacgcacagaacccaagcagagaucaaacagaagguuaagaaaaagucacuucucugcaggagauccuuuuaccuuugaaaacagggaugcuacaaauuuugagaauaacagacaacgcauuaaucuaaaaguaaaaaugcaaaauaccucucuggcaaagauaauauaaaaauauaaaguuuaagaauuccuuuugggucugauuucucuuugguuugaccuaaguacauagucauuucuuugaggcaauaaauacuaaucaggcuugggugacuacguauuauccuaaaauaaauauuacaguauauguggauuauuuuaugccaggcacugugcuaauaaaagcacuuuacauguaauaccaucucagugaauuacuauaauagcccugaagcacgaauuaauuaucagcauucucuaggugaagaaauaaacuaagaaaggcuaaauaacucacugaaggucacagcuaguuaguagaggggcugggauuugaacuugguucugccugacuauaaagaaaccauuucuuucuaauauauaagaaggaacuaugauaacuuuauauguguacuauuuuaauacuuaagauauaucuuuuugguuccacaaaacgucaagcacagaauuaugacaugaccuagcaauuccacucugaggaauauacccaagaaaacugaaaacacaggauuuuuuuuuccacaaaaaccuacauacaaauguucauaguagcauuaucauaacacaaaaaguggauacaaaccaauguccaucaacaaaugaacaaaauguauauccauacaauagaauauuauucagucauaagaggaauggauccugauacaugcuacaacauagaugaaccucaaaaacauuaugcuaagugaaaaaaagccagucauauaaaguuauguacuauaugacuccacuuauaugaaauguccagaauuuaaaaauccauacagacugaaagcagauuaguguuugucagggacaguugggagaagguaauagggcaugacggcuuaauacagggaugucuaaucuuuugguuucccugggccacacuggaaaagaagaauuaucuugggccacacauaaaguacacuaacacuaacaauaguugauaagcuuaaaaaaauugaaaaaaaucucagaauguuuuaagaaaguuuacaaauuuguguugggcugcauucaaagcugucuugggucgcauauggcccaugggcugcaggguggacaagccuggcuuaaugggcacuccguuucuuucuggcgugauaaaauguucugcaauuaaauugugguugcuguuaauugcacaacaauguaaauguacuggaagucaauaagugaacauuuuuaaaugguuaaaauggccaauuuuaacugaauaaaaauauguaucuuuuggguacuggagacacuaaccacaggccuugcaaagcuuaguccugugggcuguuacagaagcauucuagcugaagacagacagguaggggagcaacccagaaacucugccugccuccacaagucacgcauguaaaaauacacacaucaaaaagcccuguaugguucacacccuugagaggaggagccgccauauccuaccacaacauugguuuuccuaugucugacuacuuaacuauuugguaaacuucucaggguucucacaagaauggggugacuuggugucucauaaaguaacuuucucauaaaguuuuucaucagaaaggagcuaaaccaaaacuaagggcagaaauccacaaaagcacaguaaacccaugccuugcaagagacaccuugcacuuccacuaugauuuauuccucaagucucuggacuuccuaaaagaaaacuuaaugaaacuuagauucggugaccacguuaaggaggaaugagugccuccuggugaucgucucaacaaagacuguccagggaucaaaagguuccagguuuauuuuuguuacagcuguuucccuacaguguuuagaaguaaaacacuggaagccauccaucaaucagcuccugucccuaaugcauugaggagaauucaaugacacuggacaccugccacacugaccgcuccucauacagguccccagacaaccgggcagagugccuggcucaggacagcagccaauaaacacuuguuaucgaagcaagaguuauacaguuuaucaggaaaauaagcaggagaaagugcuaagaaguuuccagggaaaaaaaaaaaaaggucaggaaagagaaggacuuacccucuagauacaaaaaaugugcuccacaucuaaaauacuuaaacagugugaauuagaggggaggaaagagugagcuguaaaauuuaaaauccuaguccugaaacagcaccaaacacagaggccugcaugccagagaaaaguguuucaaaucugcaagucagcaaaggcacugggcaccuaaauguucauuuuggucccaccacugugguggccaccaguuggguuuauacuucuuagggagauuuuauacaaacauuaacacuaugauuaaauguaaaaagcaguaauuacuaaaaguacuaauuagacaagaaauguaauuauaaugaaauaauaauuuuaaaagccaaaauaaguuuaaaaaauuaugacuguaacacacaaauaugggauaaaucaguuaacaguuggaauaacucuaaauaaaguaaaucaggacgcuuacagaaaguucuggaccaugugauaaacuguaagagagaagaaauaauacuuuucaaguggggaaaugcgugguuaguggcaagaaaacguguuguaaauucaagugccuacagaggccaggcaggcagugaaaugggggagucgauggcaagaaggugggcacgagcucgguggacgcugccacccaccuaacaacucggcccugaggcugccagaucauccgccucaggacaucacagacaccuugaauuuaggucugaaauaagccaauuuuaaagugcuggcaaguaacucuccucuccaaccugccccccacaaccuccacagagaccaaaggaaacgccuggggccuggagaagcaccgcggggugggcacccaucagcgcagcugagacaccagagggcugcaugccagggcgagcgcggguaacagcuggccccaagccggggugccucccuguguucaaggacccaagaagucggacucaaccaaacagggugacaaguaaggcugcccgagcuacaaagauggugcuggaacguccccaggccacacaagagggucugccuccacagaguuucagcauagccuacgugggucuggguuggagaaagagggcaggcagaacacacgccugcaugguggagaaacccaagucugguuuuuaaagcucugaugagccacgggaccucucccugggagaaaagcguaagagauccgagcagaaaaacccuugcaaguuugggcuucugaguggcccuucagcaccuaauggauggagggacugacucugccaacaucuccagccacugacgcugagcaacggccuagcugaaguggggaacaagccccacuaaaaccccaaacacuaaaauuaauucgaaaacgaggaaagaggccaggcgccguggcucacgccugugaucccagcacuuugggaggccgaggcaggcagaucacccaaggucagguguucgagaccagccuggccaacauggugaaaccccguuucuacuaaaaauacaaaaauuagccggucaugguggcaggcgccuguaaucccagcuacucgggaggcugaggcaggagaaucacuugaacccaagaggcagaguuugcagugagccaagaucgcaccacugcacuccagccugggggacaagggcaagacuucgucucaaaaaaaaaaaaagaaaaaagaaaagaguccaacaaaaacgacaaaaccaagaagaccaccagguaaaauuccagucuaagacagcagacccaggacaccuguccacguucccgcccuuccaaaguuguuucaaaauaaaagaacccucaaaacaccagcgaaauguguccuuucaacugaguccagagaaagaaucaacaaauaccaagaccuggggaggaauaugaacaaucuucgggagaauugagggcauuucucaaacugcaggcauuaccacuacagcaccaguuucugccugcccugauccuguuauuaauauuuuucuuuaaaucaccuaugauuuacauaaauauuuuaaacgaaauuugauaucacuacgguaaauggaaaacaaguguugcuuucucauuaauaggugguaacuauaaaaauaaacacacugggccgggcacgguggcucacaccuguaaucccagcacuuugggaggccaaggugagcggaucaccugaguucaggaguuugagaccagccuggccaacauggugaaaaccuguuucuacuaaaaauacaaaaauuagccaggugugguggcgggcaucuauaauccuagcuacuacuucggaggcugaggaaugagaaccccuugaaccagggaggcagagguugcagugagccgagauugcaccacugcacuccagcugaggcgucagagugagacugugucucaaaaauacacacacacacacacacacacacacacacaaauauagguugguacaaaaguaauugccauuuuaccuuuaauggcaaaaaccgcaauuacuuuugcaccaaccuauaacaaaacaaaguuauuaaagacuaauauuacuuccugcucuuuuuguuacaauaggaaaauagccuuuauuagagaggucuuucagacuagcaccacaucaagauuuucucuuugauccgaucaggaauaguaagaacugaaaagggcaguuugaaucacggugcgaugaaggaguagauggugggaucucaccacgggucugauuagcccuuucucugccuugcuugagcuucagcagaacucgaaauggcugacgguaaggcugggaaggacuccggaaaggccaagacaaaggcgguuucccgcucgcagagagccggcuugcaguucccagagggcuguauucaucaacaccugaaaucuaggacgacgggucacagacaugugggugcaacugccgcuguguacagcgcagccauccuggaguaccucaccgcagagggacuugaacuggcaggaaaugcaucaaaagacuuaaagguaaaguguauauuaccccucgucacuugcaacuugcuauucgugcagaugaagaauuggauucucaucaaggcuacaauugcuggugguggugucauuccacacauccacaaaucucugauugggaagaaaggacaacagaagacugucuaauguaugccuggauuccuuguuaucucaggacucuaaauaaaagaacagcuguccaguguuggugaugccaguggacuauauuucugugaaaaacacaauuuugucuuuuuguaauucuauuugggcaaguuggaaguuuaauuagcuuuccaaccaaauuucugcauuugagucuuaaccauauuuaagugauacuguggcuucaaggaagcuauugauucugaaguacugggcuuugauugagcugacuguuuuuaaaaaacuguuuggauuuuaauuguaaugcagaaguuauaguaacaaacauuuggcuuuguacagacauuauuuccacugugguggauaagcucaauaaaggucauaucccccaagaaaaaaaaaaaacaaaaagaaaagaacugaaaagggagucaugaccugacuucuauuucaaugauguuuacugcugggcugacacccugucuaaaaucaucuccaguggugcaaaugccaccgaacaagcaugacagcaguggggccucaaacccuuccccacccacagucuacaaacagccuuuucaccaccaucccaguuggaaagaaauuuauuuauucccccaaaauaaaauccuagaaacucuccaaaaaggguggggugggggacaaucugcuuaaggagaacaaugaggggguuggaggucugcaaaaaaguagaagagagcuugggguaacuucaaacuuccaaaccagaucacagcacaggugacggggaacggacaaggaggguaauaagaaaggcagcuucacucaggaguaaaagccacagaaagcaaugagccacccuuugacgacugcaggggguucucacaguccugcuucccccaccaccaccuacuccccaccucugcaaccuauaugcaaaccagccuauucauauuccuugcauacuagaagagaaccuagagucagcccugccauuucaaguuugagccucuugcgggaaaaggcuguacccacaaacaaagaggaaacccacacuagguacuuaggaauccagucauucaggacugcacaagaacggccaagcaagauccagaaguucaccacucguguccuuacacgaaaaaaauuuacuccaggagggauuccaggaaaaaaaaaaaaaaaaacaaaccaaagaugccaaggcaaaaaaugauacaagauugaagaaacagcaggacagguuuucugaccuaaguucuaacccuggcucuacaauaaauacacaaucaggccaggugcgguggcucacgccuguaaucccagcacuuugggaggaugaggcaggcagaucacuugagguugggaguucgagaccagccuggccaacauggugaaaccccaucucuauuaaaaauacaaaaauuagccaggugugguggugcacaccuguaaucccagcuacuagaaggcugagacaggagaaucgcuugaaccugggaggcagagcuugcagugagcugagaucacgccacuauacuccagccugagcgacaaagcaagacucugucuacaauaaaauaaaauaaaauauucuuaucuuuugauucuauaauucaacauuuaugauuauuucuuuaaaaugggguuaaagaugcaaucaauaacuuaguuacaaagauguucuaaguguuucuaacgggaaaauacugcaaaaaaaacuuauuuuaguacgauaaaauguuauaaucgaccgggugcagugacuaaugccuguaaucccagcacucugggaggcugagucgugcggaucaccugaggucagaaguucaagaccagccuggccaacaugguaaaacccugucucuacaaaaauacaaaaauuagcugggcaugauggcaggugccuguaaucccaacuacucgggaggcugaggcaggagaaucacuugaacccgggaggcagcaguugcaguaagccgagaucacaccauugcacuccaggcuggacgacagagcaagaccuugucucaaaaaaaacaaaaaaaaaguuauggauagggcgugguggcucaugccuauaaucccagcaacuugggaggccaagaaaggcagaucaccugagguuaggaguucgagaccagccuggcccaaauggcgaaaucccaucuuaaauaaaaaaaaaaaauugaaaaaaaaaguuauaaucauucuaacucacguuuuuuaauaucugagauguuggaagaacaucaaauguguauuugaaugccauuucuguauaaaaucaaauguauagguauauguauauguauauacaugcgucagaaaaaaaaagaaugcauagauaagcagguacacagaaaaagucuaaaagaaugaccacuagacuaccaacaaugguuacgugggcgugggaaucauuaugugggacuaaucccuucuacacuacauaaaauauuuguauaauuuuugaacuuuuucagcauguuucaguuuuguaauaaggcaaaacaaagauaaugguaaaaguuggcuuugaagauuacuuaaugacauggagugaauucauucaagaagaguaaaugaaaaaagcagaauaugaaacuguagauaggcugaccuuuccuuuaaaaauguguauuuauaugcacacauaaaggagaaaaaaauuuauacaagagcaauauagaaauaaugaucaaaucugggcaguauaaugaaauggaaauuuauguuuuuuucccuauauuuuaugucccccaauaaaucuuagaaacagaguuaauaaagucaaacagauuucucuguuguacggcugcaaaggaucuuugaaguguuaaucugcaucgucaaugucaaaaaacaauauggccaacaacauucccaaccuaacuuggcuacagaacccuuuccaaagauuagugucaugcucuucccauuguaucacguccacugaagggacuaaauucugggaaaugacugaaacaauggcaauguaacuuagaaagccuuagggaaaaaucuggggggaaaaucaugauuuaaauaaggauuacuuuauaauucucauuuacacucauaauuuaaaugaggguuaaaacuucaggagcuccucauaguaccauuucacaaagcacacuucaaaaaugcuaaauuauugaugagauaugcuuuagcaaguuuugcuuauuaaaaugcuauaaaaaugccaauuuuaaaauugcuugauguaagauagguuccaccuauauuacuaaaacugauauugagacagguugagaacggaaaaaguuggaaaaggaagaugacuugguaagggaagagaaaaacagaggauacacaaauaaaaacaacuguagagcacuaacugcuacaaaagauccuaaucaggacauaaaacaugucuaccaaagguaaacuggaucuugguucugauguggggagaggcagacuugugcacuggcagccaggagaaggagcaugguagaacccaggaaggaggcugccauggucccaaggggaugagggaaaagcacacugccaggacacaaugaugcaguuuccaaugaccagggcucaagcucuacacuaaccugagcuacuaacaucacucgccugagacgaucccagugguugggagacacacggagauaaacuucuuuaaggcugagaagcaguagugagcaacacagaacaggcagccagaccaucuggguucaaauccuagaccugcuccucagcaggaaaguuacuuaagugucugugccucagucuccucaucugcaaauugggaagaguaacugugccuaccuaacagggcuguuaugagaauuaagugagucaauauagguaaacugcuuagaacagugccuaacacguaguauuuuaucauuaaaaccaauaauaacucacacuuauuagucguugauugaaaagguguaagaaccauauagacauguagcacccuuguuuaaauaaugauucuuuuucccagauguuuguccuagcacuuaacaagucauauugccauugccauuuuccacuaaagggacuaaauuuucauuguaugauacaguagaaaguacaggcuuuggacgcaggcaaaucggagucaaaucucagcucuuccacauacuacuagcuauguggucuucgacaaaucauuuucugagcgugaaaagacucguuuguggaggggaaaaauaacaauaccuauccucauagggcugcugugaauacgaaauguaauaacuuaagaaaagcaaucuuuucucccuuaaauugcugguggaguuuaaauugguacuacccuuugggauuggaauuuggcaguacguacuaaaaguuauacgagaauacacuucauuuaaccuucuuucacuucuaugaauaucugaaaguuaagaugcucuuggcauuacuaaaauaaaggaggggagaaacaaccuaauucugcagcauccuaggggaaugcuuaugacaaagggaaaaagcggggcccagcaugguggcucacaccuguaaucccagcacuuugugaggccgagguggguggaucaccugaggucaagaguucaagaccagccuggccaacacggugaaaccccgucucuacuacaaguauaaaaauaggucaggcguggugguucaagccuguaaucccagcacuuuaggaggccaaggcaggcagaucaccagaggucgggaguuugagaccagccugaccaaaauggagaaaccccgucucuacuaaaaacacaaaauuagccggacgugguggugcaugccuauaaucccagcuacucaggaggcugaggcagaagaaucacuugaacccaggaggcggagguugcagcaagccgagaucacaccauugcacuccagcaugggcaacaagagcgaaacuccaucucaaaaaaaaaaaaaaaagaaaagaaaaagaaaaaagcggagcauauacaugcucauuaugauuacauuuuaaaagauucucuuggguggaaaaaaggcaagaaaauaguauugagauaaauuuauuuuuaccuauuauuuagauauucauuuuuguacuggaaaaacagcagaaacaccaaaauaucaauaaaugccauuuuauuucuuccuagugcuuuccuacauugcacugaacuccuuuccugcaucacagaauugucucugaugaacacguacucauuuuauaacaaagucaguuauuucaaaacaagaacauaaguguauagaaaaagaaaagacgaauaaauuaaaugaaaugcuaggaccguuuuuuuucuauuuuccaaacuuccuauagugugguuaacguuacuuuuacgaugaaaagaaacauuuucuaaaagcauccucucuuaagcuugucccucccuaguuaaugccuagcuuuccuuuuuagcuaaauuuguuuuuuguuuuguuuuuugagacagucucgcacccaggcuggagugcaguggaauggcaugaucucggcucacugcaaccuccgccuccuggguucaacugauucucccugccucagccucccgaguagcugggauuacaggcgccaaccaccacgcccaguuaauuuuguauuuuuaguagagauaggguuucaccauguuggccaggcuggucucgaacuccuggccucagaugauccacccgccuuggccucccaaagugcugggauuacaggcgugagccacuaugcccagccgcuaaaauuuaugaagaguauauuccuuggaaguuucaauaauacagcccccaaaaacuuaagacugguggggaagaguguguccccaagaguaaacgagcuguucagguuugggcaacccaggccugguuacagcagaaaaguauaaacacuaaagccugccuuaaagaagagagccaaacaguuccuggcccacaaacagaaaaccaaccaaaacaagaugaucaaacaggaauuuccacuaagguaccaaaagagaagggcugcugccaccaaagggaggcuccauagcagaaugcagaacuuuccaagagugauugcaaggcaguccccugauucccacaguccucucagccaggucagggcuacagacaguggaaugugaggguucccucccgugaagacaggacaggaggagggggcuuugugaagugaauccuugaggggcugugaguacagccacaccuucauaccaagcugagguaggggcucgauggccuauuucaugugcuaaaucugugaccagcaaggguacaguggaucuccaaccugggaaaucuagagagcuggaaaagccgugcugagcacugggacccacaugcacagccagggcaaggaacacgcagucccagccaggcugugcgcgagagccagcagagggucuuagguucaaacaacagugcccccaggcaggccaaaaggacuccagcaggaggaaacuauagggggaucuaaguuccuaggugcugaggagucaccaaaauaaacuggccaaaauaaaucgaccaaaauaaagaugcaaacccccaggucaaggaggcaaaagggauagaagucgggagucucugaagagcccacugaagcaccugcaggacacagggucagcuuuaacuacgugcgaggcucagggagccacagaagaacaaucugagagccucaccucuccuuccuccuccuauuccacucaauccagaaacuagugaagucagacacaagaaaucugagggacagagaggagccgaacgcaccagaagccugucacaccgcuuuuucggacagagaugguugccaacuacaagucuuaacugggaaaaaaaggggggaaagucuaaucuuugaaugaagacugaaguguuaauauauugaacuggacacuuuuaauuuuuaaauggagccuacauuucaagacuucuaucaccuaagaucaucaccuuauguggccuuuuacuuccuauugaauccugagaaccuaggagaccggcuggcccacaggagugcucaguaaguaucugcugaaucaguuaauuaaagcauaaaggguaagucacaaggccugacagcuuuucauaaaagcaaacagcuccccaacugaguguauuuuaaagagacagugaagguggggcaugguggcucaugccuguaaucccaagacuuugggaggcagaggagggcggaucaccugaggucaggaguucaagaccagccugaccaacauggagaaaccccgucucuacuaaaaauacaaaauuagccaggcguggugguacacgccuguaaucccagcuacuuggggggcugaggcaggagaauugcucaaacccaggaggcagaggcugcagugagccaagaucacgccauugcacuccagccugggcaacaagagcgaaacuccaccucaaaaaaaaaaaaaaaaaaaaagagacgaugagaggcaaaaauaaagauuuauuugcaucaucucccacacacugaaugcauacuuaagaaagaaugucaguaggaacacgguuugcuccuucaugagaacacaaaaaaaagagccucaggagucaauguugguguccauuuuagcaguaugcaggggacaggguauucagguuccgaaggcaggauccuaagcuggaacgaagguggagagugcaggccucaaaugaccccaccaguccugagggcucacccagcucuacagugagacaaauguccacaccacaggcugacaccaguggaccuuaggcucaucaaacuucucuaacugcaucuggcccaaggcucccuaccaaauguuuuggaucaaacaagaguuucacucagaguagcucaaugguauagcgggacggaagcaggccacaaugagcccagaacagggccccgccaucgaagaguagcagacuaauugcacaaggcuaaaaagugaagggagaugagaacagggaaaaaauaagggaagaucaccuuuuaagagcuggaaagaagguggucagcaguugggaagguacaugauagaguuguuggauggguuauacuuuugcauuuuuaagaauaggcucagaagaaggauccaguuaauacuacuuaaaccugaguaguuacuauggcaaaauucuaggagcuccacacauacuaacuuuucugaucuuccuucccaucaagaaagcaucugaaguacagguagucucacuuccaggccugugugcuacaccucuauacucugcccucucaccaaauaaggaugcaacccccaggucaacgcagcagcagguaaagacucccaacucagggaggggugccacuaaggcacccgcaggagaaagcaucagcuguaaccacgugccaggcucauuccugcaggagagagaaugaagguaaagaaaaagcaagaguggugcuagaaaagacagggaagaaagaguucagaaucgguggagggugggccucaggagaaggcugcuucauucuucuggauuggaggaaaggaacaaagcugaguguggacagaaacaagucagagagagggagcaggaagcggaaggagcacccaggugauggccccgauuuuuuggaugggugaagagugagauggugggugaagagauggggagagacugagaauagccuugagccgaagacaaaauagagguagcauagggagaugacugaaucccagaaacuuagcugagaaaugaauaccagaaacuuagcugagaaacggugccaagggcccagacuugaccccauaaaucaaugcaaaguuaggguuuugcucgaugagcaccacagaacagacgugccaggucuccgagagucuggaugagaccauggcuccaguaaugaacuacagguuccagacuggauaugaagaaagagaugccacaaaugggcugauacacuggagacaaggagggaucagaggcuggugagcauagccaugguggugagcaaagccagggaagcggcugcgggacgcgugauuccguggaagaaggcacauccauccgcuggacuaggggaagagacgcaacuccuccuacagaagcccccagcucugccuacuuucugccuccucuuucucuauccaucccuuacaugcuggaaugggcugaaggucuguccucagcuuccaacuguccccccaccucuggaguccucacucacacccacaaccuaacucucaccuacucauguccaauccaguccagcucuggauuucuuuccccaagugucccgaguaccucugaccggacucugcaaaccccucaacacugcacagguccaaagcugaacucaucuucuccugaaaugagcuccugcuucucugcauucccucucuagugacugggaacguuaccuauccacccagcugcccaggcaguaaagcagagucagcuucaacuccucccucgccgcagauccaaucagcuuuauugacacaaccuaccagaauacacaucuuuagaauccuucuaucuugagagcuuguuuggagguucuagcaggggagcgcagcuacucguauacccuugaccaaagaccgguccuccucuaucggggauggucguccucuucgaccgagcacgcagcuucgggagggacgcacauggaacggugagggaggaaggggacacccgccuagccagccagaucagccgaaucaacucuggcgaucaauggggugacagaugucacagccagaucgcccucacauccaagaauccuucuaucuucuaucuucucucaucagcgcaccagacuccguucucucugcccugccuguggcugcccuccugccuccaucucaaucuguuuguccauuaaaauguccugggguggggggauguggagacuuuaaaaauacacauuucuuaaaacaaaaaauaacagguuucugacacucaugcuagcucuucugaaucugacccucuggggaggagacccaggaagguguacauucagaaaacaccgugauugauuuuuuugcagcugggacaggagcagcguuugacaaccaccgcuccgugaccaagaguaaccccuccucuucccuccuacagcaaugagaagcauaccugcccugggccccggauccucaccuccucacaacucaguccuaucacucauuccugucuguaucuucaaccacacccuucccacuggguuuuucccaacaccuuuuaaacaagcuaagccuccucuccacuuaaagaaacucccccaaccgggcacaguggcucacgccuauaaucccagcacucugggaggccgaggcgggcggaucacgaggucaggagaucaagaccaaccuggccaauauggugaaacccugucucuagcaaaaauacaaaaauuagccggguguggcaucacacaccuauagucccugcuacucaggaugcugaggcagaagaauugcuugaacccaggaggcagagguugcagugagcugagaucacaccgcugcacuccagccuggcgacagagcaagacuccgucgcaaaaaaaaaaaaaaaaaaaaaggaaacgaaacucccccuuacaccugcggccaccucuaaccacaacucacucucuugauucucagaaccgagaucuugaaagcacuuuccaagcucacugucuccauuuaugucccacucacuccucacucauuccucagcuaauuauaaucucacuucucuccccaacuacuggaugagcuuuucuggaaagguucugggggggccucuuucuuucccacaggucgcgcuucaggcccguuuugaaaaucucugcagcguguaaugccaucagccacucuccccugaaauugucuccucccgggugucccccuacuuccuuggccauuccucaguuuucuucccuggcaccuacucuucucccucuuuaaaguuuaaaauguucacaaguucugucccuaguucuugucucaccuuccacuguccucugaaagacuucaccacacaucucuuacgaacugcucacuccagccauaaccaccccuaauucauugcuuccugccucucugccaagcccuguccaggcucugucccucccagaggccuucuccacacuaugaugccugccaaacucucaaaagucagcccaaauauugcuacauugggaagucuuccuuaacugugccuccccacaaccagccuacccccugcaauaaacccacagcaccgaggacaaacguucuuuuuuaaaaaguuuugccccaauagacagugaacuccuugagggugggaacuauaccuggaaaauauuaggcaugcaauuaauguugacugaguccaucauuacacaguaaacauacugugagguaaauaggagcuuauuaauaaaugcagugaaugauacacauauuacucaacguagagcugagugacagcauuggucuacaaguaaggaaccuaaaauaagucaugaucacuaauccuacgcacuuuuacccggucauaauugcagacagcaauauaguuucaagcacuugaaacaggcauggcaggguguuuucaacugcauugugucugaaacuguauugcuguccccuuucuucaaaaugaagaguuuucaacaaacucugauauggcuugcuccuucacaccaucugagccucagcucaaugucaccuucccggcuacccuccgugaccaugcaugcuaaagugguccuccaccauaacuucggucuuugcaguuacccucucauugucuucaugucacuuaucacuaugugaaucauacugacuuguuagccuguuugaugcuggucuccuugauccugcuuauuacuuuauccucuguauaucaacaguguguggcugauauggguacccaacagacacuuauugaauggaugagagagaaaggcaaguuuaacacuaaaauacuauuaucuacuaaccacaaaacgugggaaacaugcaggugguagaaaauggcagggauuuaucccuggaaagggacuguuauucaccacccauggggguagggcuagguacacgugucguccuucuuucagauucuugcucaggaucagaauuuugauuugcuaaagggucccucaacuuaucuaaaggaaaucauaggcaguggcucacgccuguaaucccagcacuuuuggaggccgaggcgggaggaccacuugaggucaggagcucaagaccagccuggucaacauggcaaaaccccgucucuacuaaaaauacaaaaauagccaggugugauggugggcaccuguaaucccagcuacuugggaggcugaggcgggagaaucgcuugaacucgggaggcggagguugcagugagcggagauccaccacugcacuccagccugggcaacagugagacuccaucucaauaaauaaauaaauaaauaaauaaauaaauaaaauaaaacaaaggaaaucacuucucccucaguggguagcuucuccagagaaaaauguuaaagcugacacacagccuuuucuaaugaccaguccuggaaaacugugccuaagcuccgucagcacuguaagcacugagaccaggaccuguucguugcugcauucccagcaccuagcccaguucaucgcccagaggagaugcccaaaauguuuguaaaaugagcauguaagacacagccuucugaggaacggccaucccaacaacucuuacacugcagaagcacuuaauuuuagaaacaggccaagacagcugcagaggggcuccagaccuacgccucucccugggcaacaguuugguuccuagaauucaacacucaccaccaugugccauagauaacaaaauauuaucuuccccacaguugcccuguaucaaauuugaauacacuuggccaauauaaucucauggcuaauacaguacagcaaccaauaagauuucucuugcccuuuauuuuuuuauauguacuuuggccagcaaggauagaucaaaaugcuaaagaacaauugaaauugaagaauuccaccauuaauuucauaaccaguaguuccuggcucacugugugaucccaggaaaaccacauugccuucuugaacugucagcuucagcuacaguccuaaugcucuuuaucuaaaggguaguuuggggaagauuacuuaguaguuguaacauacuccgggaccaauccaugaaagaugccauaaaucaaauuaauuaugaaacaaaggaaaucauaaauauugaaaccacuucaaaaccugagaaguugagaagugaggaagauuuaaaauuaugccuguggcgcugauacuaacucacugucagacuauaagacgagacacacauucucagaagauucaugacauucccaacagaucuuuuuuuuuuuuuuuuuuuuuugagauggagucucgcuuugucgcccaggccaaagugcaguggcgcaaucucggcucgcugcaagcuccgccucccggguucacgccauucuccugccucagccucccgaguagcugggaauacaggcacccgccaccacgcccagcuaauuuuuuguguuuuuaguagagagacgggguuucaccguguuagccaggauggucucgaucuccugaccucgugauccgcccaccucggccucccaaagugcugggauuacaggcgugagccaccgcgcccggccaacagaucuuuaauauuuggaaaugucagauguuucuguccuccagcagcauuaacuucacauggaguaugaacagugacaagcaauugcaaaauuagagcuguucuccguugcuguacccgugccuaacuguuaacacgcagucuaccuuaccgaaagucaauuccacacacucagugagaaaagccguuuaacuggcuguaaaaauacuccgcccccuaccugcugaccaccgcuaacacgccaggaaaacagcaacauccagcagcacagcugcgcucccucgccacgacuuccuaacuucccuccacuugaaagcacucucaucaguguguguuugucuaaaaacucuucuuggagacugaagaagaaacacauccaagugaaacugagaggucagcuucuaaagcggaggcugaacuuugcaagugggggcggggggaguuaguucggucccccaagccuaaaagaauggggcaugguaagggggacggccccuuccuucagcgcggcacacgcuccgcaaagggccuggggccggcccacgagaacaccagggcaccugcccacuugcagcggccccaagagacuccugggcagagcaccuggggauaccagguggggucggggcgggcggcggggcuuuguccccauucgccccuccaggccgaaaugggggcgguuuccgcugacccccaagaccgggaacuagcaggguucggacgcgggucuggagggucggccccaccaccuccggcaaacccgaggguccccgcugccccagccuccucaaagaggugccuaggguggcguguagggggcagccaggauggcggaggccgguacucacagagcccacuggagccggugcuggugaacauggucccgccgggcucggagccccagagggcgccgggggaggggaagcugaagugcgagccccagcgaccgcgcaggcgcacucuuggcggagcgacgaauccggcgccgcgaggccacucgccgcugacgaacggcgcacccggcgcaugcgcagucaggggcgugcgcccgcugggucagcgcccuccuuccugccggggaagggaagugcgucgguaggggagggcucaccucuccagguugaaacgauggcggucagaaccgccugagguaaaaacggguggcacuggggaagcggaggcguagcucccgagagccucacacuugugcucagugccgccucaccccugguggauccgcgauggccgcggauuccccuggauugccggcgcugggcaggagcgccacuucuaaucucucccgagacuggacgcccggcgccuuccacgcgcguugugucuuuccgggcggucccucgaagcu

SEQ ID NO: 192526 - RNA, 362684 nt, Homo sapiens
cgcgcugccugagcugagccgccguaggugaggggcccgcguccccgcccgcccugggcgccgcgccuggcacugauccugccggucgcccacugucgccgccgccgccgcccgcgggcaccaugacagcucugagcgcugggguuacagguuggucaccgccgccggugcccgggaggcugcggcgcggccggcuccgugcccugcgcccgaggcccgcgaugcgcgcucguuaguuccuuggccgguccgggccaggacggcucaggggcgcuggggcugcgagaggggcugcuagaggggcugcgggcgggggccccgcgcgggggagggguggggaggggcgccuccacccgagagcggggcggugggguccuugccggccuggccggggcgcgggagccgcgaugcgcccucccuauuccugcgcgugggugucgggggcgccugccgcgggaugccccugggcuggcuugggaagcccagggccggcgacaccucgggccugccccgccugggcaucuagcagguguuggggggcagguggcugaggacgaggccacugggcaucacuacagcgcugcaccugcccccucggcaccagggccgcugccuggguaaaccucugggccaacgcgcggguggggaggugggggugggcagccuggcuccagcaggucuccgcgggggcuccgcggccuugccccacccccaugcuccuguggauugcuccuugcuaaaugucccuuaugauauucauuggccuuguuaagcagccgucauuaggguggcuacaccgaacgcaaaacaguguccugccaagcaacaccauuuugucacugaaucuuuaagacaccagcaaggauggccuggcugggaucccucugggggcccagaucgcagucauuuugcugacuuaauguuccucuuucaggauggugugagaaugcugaacucagacccuuagugcuugaaauaccuuagaauaaaucuuucaguuucagguacaauuuuucagacacuguauuauuaaggaugugugaauacacgcucacuuucaggccucagaagguuuuacucuuaaucugguguucguguggucaucagcuaggcccgacugcccugguggugaaauguggguugaggaccagugaccuucguguuaguaguugguggauaacaccucuaauaggggaucaaaaauuaacagguggcgauuuugaaauauauauguauguauauauauauauauaugugugugauuuguauguucauaacuacaacugugauuugauauggccugggagaggagcgguuucacuaugguaguuaccccugaggcagaugcaucucaggacuggcuuuuuaaauucaaagauaagguuuccacaguucuaaauaaaaaucauggcuucccaaacaucugcaacgagaaacauuuacucccuaacugguuggcugucauucugcgugcuuuucuagagucgauuuuucguucuucuguaguauacuuugaccuagccacugcuaaaaccagacagugugaagacaaaauccagcuuuggagaaaaacuuaaaaagugaaaagguucaguuggauccucuucuguguucauagaagacauaaucuguuugcagaauaaaugugccgucacugauaaggacuaugcuaaaaucucuacagaacucuaggagaaagcaugucuuauaaaauagugguuguacacuuauaacuuuggauaggacuugcaagauauucaaaggagaaauguacuuaaaaaauguacuuaaaaaaagucuacucaaaauagugucauuuaguugcaauuuagugaacugaagauuugaguagcauuuucuucuucuuggguauggcauuucuuugaaaugguuuccaggugauuuuaucauuccggcaugcuuugugugugcauguauguguauacacaaauguacacauuuguuuuaucauuuaucgaugauguucagauaauuucagaauuuccauagcuguauaaauuuaucccaggucagagucacauguggauuucaaguuugugaaugaaaauucacaucuacaccucuauauccuaagauaagcuaagcacugggccagaagcuggguggugagugagaaaaagagauaaacugagagccuaagaauccuucaggaaagacaaauauguaagcagguggauauacagugagaugucuuauuuucuaguuuugcuguggaaacuaugauagugagcuuaaacauauuaagaaugguccccaaggccacacacgguggcucaugccuauaaucccagcacuuugggaggccaaggcaggccuauugcuugaacccaagaguccagaccagccugggcaacauggugaaaccccgucucuacaaaaaaaaaaaaaauucaccaaguguagugguguacaccuguagccccaguuacuugggaggcugagguggaaggaucgcgugagcccagagaugucaaggcugcagcaggcuaugauggcaccacuguacucuagaaugggcgacugggcacagagugagacucuguuuaaaaauaaaaaaagaaugccccugucccaaaauguuaucaacauuuuagagcuucacucauguuauacaauucucgccugucucaaggaccagcacagauuuucauaccuucaaacucuaugcaaaugcuuaaauuuuuuuaauugauuuuuugaauuuuaaaguaaccaaaguugauagagaugauagaaugauagagaaaaaagaguaaacagcuaguuuuaauaaccgaagacagaugaccacaauaucuguguguuuuuuguagucuuuuuaagggcuugacuucagguaguugucaucguggcauuggacaacuuuuauacuguuuuuaccacugaauauuuauuauaaauauuuaaaauauuucuauauaauuuucuuacuuaaaaauuguaaauggcuguauaacaccauacccaguaaauacagccucauauauuuaaccauaccucuaucauuggacauuugcuguuuccaguuuuucaucauuauaaacaguguccugauaguuauaauguagagauuuauuucuauuuuauguuuuucaguauaaauauccaaauauguccauaucugucaccuauuuuuccauaucuucaaauugguuuccugaaaaauucagauuauaauuuauuuaugauaaauuuccaguaauuaugucuuugaaaaaagaaguaucugaauuauuauagagauauauuguaugucuuuaaauugauuuccuaaagaauucagauuauaauuuugaauaaauugcuuaaucugcuuuugagguaaaucuacccuuuuacaaaaaguguugguggaucacauucccucuuuuacagaaauaaaagaagguaacauaauaauuuggauguuugaccuuugugcuauauaaaaacuugaccuuuacaaaaaucaccugaaaaccagaugcuaaaauauaccucuuagaguaaagccaaaauaggaauacuauaaaaguucaaagcuggaaaaagaaaaaaaucaaugcaaguuccuuuagaaaauuggcuguuguauucaggagucuaauucugcuuuuugcuuuccuacucagacuucaaguaaaugaucaaaagggcuuacauagugagaaaucuguacccccacagguaaaggaagaagaggaucuuucuuuccuaggcugcagaauccaaggcuuuucugguagauucaguauagauggaacaggacugauaggaaaagcuaaaguucaguucacaauuuccuuucuaagaucaguguacaaaaaauacggaagagagacccuggaagagccccuuaguaugaaggagcgaaguugaaaguuggaagcaggcuuuuguaaaacagaauugcuuguuucuccaugagaucccagggcaaggcagccauaccggaauauguucugaagacagggacugaccccacagguccagggugggggcagggguaggccuccgcagcaggaguggaagaauuagaaguaggauagaccagaacacugaagccaagagaaucauuuaugaagagaucaagagugagaauuauuuccaauuaugcaaagaaaagagaugaaaagaggauguuguuuggagagagaaugauauagauggaagacagccaacagagacacaccaauaaauguuuuuccugacagaggggaucacagugcauggaacacagccauguuuuaaagugagauaagauucuuuuuuucuuuuagauuaaaaacaauccaaaucuucagaugaaaauaaguuaucauguaccaaaacaauuaauaaaacuuagccaacaucuacauauagccugauaaaaacuuuggauuugaaaaccaauaaaaagaaaaauauuucaccaucauugugaucaaaugcuucagaaauuacuuauccacaaagagaaaauuuagauuaauguuauacuuccucucuaaaauuaucagcaaacauaaaauaacguccugaaaaucuguaguccugaaaaauaucaguagacaauucucuuacguuguaaaugagucaaaagugaaaaauaaauaggugaagaaauacauacuaggcaagugauaucaguaaaaaaaaaugagguagaaguguguaaauaucagaaaacaguucaaaaaauuguuugauuaaaugagaaaaaagaccguaaagucauaaaaguugcuaucuuuaauacauuuauaacuacaggcuucccauauauaccaacgaucagagcauuauaguaugcacagucaaaagcauaaugcuggccgggcgcgguggcucacgccuguaaucccagcacuuugggaggccgagauggguggaucacgaggucaggaguuugagaccagcguggccaacauggugaaaccccgucccugcuaaaaauacaaaaaaauuagcuaggugugauggugggcaccuguaaucucagcuacucgggaggggaggcugaggcaggcgaaucauuugaacccaggaggcagagguugcagcgagccgagaucacgcauuacacuccagccugggcgacagggcaagacuccgucucaaaaaaaaaaaaaaaagucugaugcuuauuuuaggggaaauggaagcggaagcaugcccacagacucaauaucuuuuuaaagaguuuugugaccuaaaaugguauugggagucagcauuucaucuuaagaaguacaaaaaaaaaggaaaaaaaagaaagaggauaaaguuuuaagaaugaaaacaugaaugaauucacuaugacauagauaaacucuaaaucugauagcaaaaacugagagcuacagcauuccaaucugggaggaauauugaucuacagguauauuuaagguaaauuagaaugccaacaaauuggaaugaugacaaggagguuagugaagaaaugcacuggagaaauuggauauacaauuccaagauugaagaacuggaaucagauugcaguaauggaaaugaagagguggaugguaaagauauauccacaaaaacuaaugcuaccacgucuuagugauggaaggaagagaaugaaagggaguccuagguuaaaaauaauuuccgaucaucgagcuugggugauugugcuauuguauucuauuaagucuaguuaaaagaaauuguuacggcuuuaucuuucaguuaauaguaucuacaggguaaauccuuugcuucauucccuuuucuaguuguuuuauuguuauuuugaaauucacaugagauuacuuccagaggcaauaucguuuugcuuccuuucuuugaaggcauugaauggcaauuuaaagguguagucuagacuagaaaaucauaacagaaaccccaacaaaaacucaaauaucuuaguuauccuuuuauaaaacaaaaauuuaauuccuguauacaaugcaaguuaguuauuuuaaaaguaaauucugaagauuucugaggaaagaauagaauauacuguauauacauacaauuauaaaucaaaauuuuugucucagacauauuuugccuguguugcuuauaauuagacucucuuauucuuuuccacacagagccaugacuaugcaaugugaacucucuaaguguucucuucugagcaucuaggcuagugaugccucauuaauuuggaaacagugaugggagaggugugcagggaucaccugaagauguuuuuaaaaaaauacaauguccuguuuuccacccuuaaagauucugauuuaguaugucugaggugaaggaggccucagcuugagugucuuaguuagcuugggcugcuguaacaaauagcacagacuagguggcuuaaacuccagacuuugguuuuauacagucuggagacuaagaaguccaagaucaaggugcuggcugauuccugugagggcugucuuccugguccacagaccauucagcugccuccguucuucuuauagauucgcuagucccauucauggggucuccaccuucauggccucaugaccucccaaaggccccaccuccaaauacauuagagauaagagcuucaacauaugacuugaggaaggcagaaccauucgguuuauaguguugagaauguuucugaaccucccuugauaauucauauguuaagcagucuuuaggaauuacuauuuuaaaccauccccuuuugagcaaauuuguggauucauauugcaaaauuuaacaaacacaaaaacauaaucucccuuugaucuucuguuauguuuaaauauaguagcaaauuuugaaaaccacuguuuuaaaccauccaccuucuuuaucuaaccuuuacagauucauauuauaagauuaaacaaccacaaucaaaauaaguauccccuuucugguuuuucauaauauauaaaugauaguagcagcucaucaaaauaaaauauccaacacuggauaauuaauauagaguaggauauauacucagcacaggguaggacggugguggccaggggcugggaggaggggaaaauggggaguuguuaauuacuggguagaacguuucaguuaugcaagaugagugagcucgagagaucuguguuaugacauugugccuguaguuaacauuuuauagugaauguaaaaaucuguuaagacaguucucguguuaaaugcuccuacuacaaugaaacaaaaauaaaaauuacugugauguaggugacaaaaauacgacccaguucccucucauacugcuugacaguuuuaguuugggcauguaggugcaaugacaguuuuaguuugggcgugcagggugcaaugacaaaagggcauuggggcauugugguguguacugaaucccuuuagcaaacccaaucacuuuaaaggccagagaaaauucaauuuucacaauuaaaaaauaaaacaaaacagaauccuuggagaaguaaugacaguuuuggaguuuuucuagaaauaaccagagaaaaauaaccugcuguuuuacuuugggauuuaagaaauagacucauaaaaaguggggaaccauuuuuuauuucuaaucaguaccuugacaaaaggaaaacagaagagucuguuuuuggagaugguucuuugaaacauuugccuuccccuauguggucaccaccuuggguagcccuugaagucugcugggacuggaccaugcaugcaaaauucuguuuuuugcagagcuacauuauuuagugagggccaagacacagaugaaugaguaccccaaaagaaaaguggcagguggcauuuggaggagagagagagaaggagagaggcagaaagaaaaagagaaggaagaacaaagaaaaccaggcagccaaaucagggucuugacuuuuguacaaaauuagauugaaaaucaaccacaacaauccacuaccugcaggggcaggggagugggccgcuguucuguuguggagacacgcauugccgcugugaugcccagggugucaguuuuuugaugcugucuuaguucuccugcuaacauguucucugcuguguugcugggggagacgcaggacuccaggcuaaguuuaagagagaaaacauagagcugcugccuuuccucugagcagaggccagauuacagggaaugaugcauccagcucauugaaguucacaagcuaaggauacgcggaggagaggcuugcuugagagggcccggaaggacuggcauuguaagucuaguggcaggcaugcucuaauuugguuuuauuacuuagacguggaauaggcaggaacuuggagauucccgucucuguucucugggaaagaagacuguucuauuuacaaagacuugaaagggucagacugaaagaagacauggacagcaaaguauuccugggguggcaaucagaaagaccuggcucccucgugguuuaucacagcuaaccaugugaccucagacaaggcacuuaucuucuccaaaacucaguuucaccuguaaaaucagaauaacagagagagagacacuuaccucauugaggcauggugagaaauagguaacaauuagccucacacuuaauaaacccucagcaaauguuagguguaacuuguuuaaacugaaaauuuuuuuaauguuuuacuuguuucaaagaaauuauaaauaaaacacaucaucuuugugaacauguacagaaguucguguuugugaaauguacaaaaguucuuaagguuaaaaagugaaagucaaaugcuucaccauuucucucccucccucuguucucccgacaaauagacuacuuggauucuaaacuugcuuccaauucaugugggucugggcauguuugccuccaauuuuuaaucucuguagugggaauaauacuaaaaacuacuucagagaggugucaaaugcuuagaauagugccuggcauggaguaagcuuucaauaauauuuguucucaucuuucaaguuaaaaaaaugaguacauaaugucuaagcuugcuucuauucuauaauuaugcacaguaguuuauggacuuucauucuacccugagaaaugaucaaaugcauaaaaaucugagcagugucaagaguauuaaucacuuuuaucauuggaagucacuuuggauaucaucuauugcaaagucccagacagaggagaaaucuuuucugcaaacucuaaaauguguagucauucccucugagaguauccauaaaggaguuuaccaccuuuugggauauuccaacauauuaugauuggaaacuuauagaguagauguucuuuuuaucaaauaaacagucaccucuugauaaacuuuuguuagagaauuucuauuuugucugcauuuuccuugcuagaagaacagagagcacuacaaaacaaaucauaacaacuguguucugggcuuuggauuuuggguaugacagaaaaacuuucucaauacauaccuuuuaauugcucuugcacaaucucuguaaaaaauuacauacauucuuuuagccauguaucauagguggaaucuauuuuuuaguuuucauauucuuagccuagucagucaagaaauuacgagacuaaaacuaacucuaggaagugaagaaaucugucauuuuaggaaauggagagaucugucucuucacuacauggggugagauuaucaaaugggaguuaguaaauauguuuuucucauucuuuaccaaauuuagagaaaaaaauaaugaagguauaauagaauauuucuaggauucauccucaaggaaaaaggaauaauaaauggauaauaccuucagaaacuugaaaggguuauuuagauagauuuaaugagagguuugaugauuucuaccagaaaaaaauugacauuuuuauaaguguguggugagaaaaaucauaaagugagucagauaauaaaaauggauucaauuucaggagaugagaaaugucuguacuauuugcacaaaaaauaauugaugccaagaguuuguaaacaccaggcuauaugauuuaaauauauugaaaaagucauuuucucauuuccuguccauucuguaauauacuuaauuuuugauucaauaguucugucaggcacauugucccgucuugucucugugccuaaguuuccucaucuguaaaaugguucuugugaaaauggaaugacauagugcauauucuuuuuucuuuuuuucuuuuugagacagagucucacucugucacccaggcugaggggcaguaguaugaucuuggcucauugcagccucuacuucccaggcucaagugagccucccaccucagacuccugaguagcugggacuacaggugcaugccaguacucccagcuaauuuuuuguauuuuuuuuuuuuuuuuguagagauggguuuucuccauguugcccaggcuggucucgaacuccuggacucaagcgauccacugccucagcuucccuaaaugcuaggauuacaagugggagccaccacacauggccugaaaauguaugauauuauuaaacagacuggcacauaauaaccccucaaccaacauuuuuguuagaaggacucuguuuuugcaugacaguaaacguaauuuggguugaaaucaaccagugagcucacuauuuuaacauggaaacucucauguaucccaaagcacuuuuucaugggguauaugugugugugcaagugugugugagcuacugaaggcuauuuuccuuuggagaaagcauucugaguaggagauaacauucauuuuuacagcaacuucuguuuuuaacacuuucccuuaaauugucgugaugauugaaaucucaaggcagucauugagcagccccuaaaugggagacagcagaguugcuggauucuggucuggaaagugcccagugcgugugagaggcuguggaggccgugagaggugaccucauggagggagaggaagagcgugagcaugcaggacacagaugaucugggcucagagaaagaggggaaguucauacacucaagaugcacagagaggacacucagcugggcagagggaggugcagguaucaguagcucugaggcucaaaugggcccugggaauuggaggacggcagagugggcagggauggugacacaugaggcagguggauggauguuggauaacagauaauaagacaaaaauaugggguauuuuuuccuaguugaaaccauagcauaaaauguaugaugcuacauucauuugcucugaauggacaugucuucugucugagaaggaacuuagcaagcaaaauugacagucaaacuuuacagaaacaaggccaucuugcuguuaagcaucgccuuuugucgucaaguuuucacugugguguauugagguaaaacugaagauguaaaugugcauauagggaaaggacaggaagcucuuguucaaauguagauuuuagugguuuguuguuuugaguucuguggcuauuggaacuaaaaagaggaagaaauaaaaacauuugaaauaagaauuaauauuguaaugccuacauuaacaaauugguaacaucaaauacaugugucuucaaaauaugggguaaugccuuucucagauacaaauuuaacacugggaaccuaaucuggaaagcugugcuuauaucagcucaccuuguaaggccuugcacguauaagcaugugaaugagcuaugggacaagaaagacaaggaaggggcacagauguuugaagguaguguuuacuuacaguuaggauuuucugcacauguguauuuauugacagaggaugauguucacagaauauggcuagauuuaaaaaaucugguuacaaaaccauguguaagcagccauuuaaaaauaaauguaugcauggaaaaauauauguggcaaagaaaguccuaaaagagauacaauucauauccucuuggagaguaagcacccuaaagaaaauuccacaagagaccauaacuaauuacuacuucaucugcagccccuuguucgguggcagacacaauguaugugcucaacaaauucuuugcaaaaaugauugagucucuagaaguggaaucccugauggcuuucauuuuuguuucuuauuuuguuuauauaguuuuucuaauuuuucuacaacaaaccuguauuacuuguguuaaugaaaauaaaauaagaauagaauuauuuucuucuaacuuaauuuaagguuuaaguauuugagaucuaggcaaagaaagaccagucagcucuccuggauuuuugcaugaaucucauuaugcccgauagcacagaaacguguugggaauccacugcucaauauuccuugccuagggagguaguauggagccagcaguaagguacugaaggaauaagaaaaccacuagauggacguugaagagaaagugcgccacacuagaggcucucuuuuaauuaaucagcuacucugccuuuaaauacaguauguugucuuccaugucaggaacauggagggaaaagaccuaguauguuuuguucaauguuaaauccacgucacuuaacaaaauggucaggauagucaaaaaacaaaacaauuaugcaaacaugaaugaaugagaaacuucugcuagcaaugcugguugguuucccaaagacaugaaagucagaguuugaggugaagagucccggagauguuauugaacauuuucuuuucuuaauuuccuucucaaacugugccagggauacuaagcaaagagauaaaaacccaccauuaaguguguaugugugugucugugucugcaauagggcgguugauaaacaauuucacuugcacuccuaaagaccccacaguuuaugcacaaaaguuaucagaagagugguuguugguauugauguauugacaaccuuaauaacaccuaaugauuaaaaaugagucaaugacuucugucuucuuuggggcuuuuuagaaugaaauagaugcuuucauuuuauacaaguuguauguuuaucuucucacaucuuuauucccaaauauuaaguuuuucaguuauaacaaaucacacacauagacaaagucuucaugaguuaagugagggaauuaggaaagacugaugugggauuggcauuggauaacaaagaggacauggcuuggauaaaggguuugaauuaguugaguaaagguugcaggauggugaauaaugguauguuuagccaaccugagugcagcaugugguaugagugugaaaggaagugcagguacaaaucagugggacucaggguccuggaaacauaagguuaaauaaaguaggcaguucguaagcuucaagaaugccuucauauucagugcuguauacccagcacauaccgcagugccugauaccacaguggaugcauaauauuugcugugugaaugaaugaaugaacaaaugagugagugaaugagaaauaagaagauacacugagguuuucugggcuacaaaggagaccuacaguguguuuggaagcugauuuuuuuuuauauaaaagagggaacauuuugaaaggcaucccagaccugagggcccauggccuaccuagaaaggagucuagaaauggggauaggugaaaaaggccguuguacauauauggaaugaaugagcaagaaaacaauccacugcugagagugggugcaaagagaaccugcugggccuucccgcugcacauggggaaccugaagaguucagagcaguagggucugggacaugagaggaaggagaaaagcaggaugccuggcucaugucgcucucucaggcugaaucuucauucaugaugguguuggcaccgucuuccuacaucugcgggggaagcagcaccgauaccucucuaaauuaguagcuggacacagaugguaauggaaacuguaacaacaggugaucacuuaagggguuaaguagagaagacaggcaagaagggcaugcugugaaccauaauuuggaagacaggagaagauucaaaagacuuuaauacugaacccaagagagcugcaagggaaagaaaugacccauaguguugcaagggcgcugcaguuaaagaaaauggaauauuuuaauuuuaauacugugaagacggggcuggaaugaaguagggaaaguauauaccaauagaaaugaaauugcuaucacagaauacaaaaacugggucuuaaccauuuaaaacagcaaugaacaugggaugaaugaguuuccugaguugcuauaagcuguuucugaguaaaagauuuauuaauggauacauugugacuguguagccucucucccgauauugaacuauuuaaauaccaacuacuuuuaauaaaugucggaaaccuuuugaaagccauguuuuucaaacuuuguguacugucuuaugaaggacacuuugguaaacagaaaaaagagauauuggcuuauaaaaacauaauaaugauaaggcucagauacacaggagcaauuuccuaucaaaauaauaaacuuaccuaggauacuuaaauaucccuacugguuuuuaucagagaaauaauaggucugcuguaugcaguuuuauugauucaacaugaaugaaggcauaaaacaauauuucuguuugcaaaggaaaauuauuacaaucaaccaccucaaauuaauuuugaauuccucauguguuuguaacuuaaauuuauuuuacuacuugaaugcuuuauauaauauuuaauaguauuaaauuaaaucuagagauccaggagcuaguuguugaguuuuuauguauguguggauuagccagguaucuuuggagcuuagaucauuucuugggcacugugagauuuaguggcaccugggagcagguaaagugaagguaaaugugagugacagcuaaugucauucaguuauaauugcacuauuuugguuggucagauauaaccaaagugggaauuuuuuaaaaaacaauaaauucuggacauguauuuuucuagauaaacaaauccauaaucaaaaaugauuuuugcuuuagguggcguauugauaauaaaggugcauggaauucauaugcccauugucuccacugcucagugaaagaggaauuguggacagaucucuaaaauuccuuauauaaucuuugaagugaaaccacucuuuuacuugcuccuuuguaugugucaucuugaaggauuucuaaaagauuguaucuacacucaguauuuggguggauaggagacugucauugaagaggcaucucaaauugaggccaccagauuuccuuccccacuaccaguacaucagagaaaaaaaaaacacuuuaaauacucuguauacauuaacaugggauaucaaagagucccaaacuccaauuauauaacauaaauuaauuagugcagccuacugcaaagcccauauucaaacucaauauucagagcaauaacagccuggaaauacccagcaugucuucaagccaguuagcuuguuuucuucugggaauaggaggugaauccguccguuuucacacuucuauaaagaaauaccugacgacgcuggcuaauuuauaaaggaaagagguuuaauugacuccauucugcauggcuggggaggccucaggaaacuuacaaucauggucgaagacaccuucuucacaaggcggcaggagaaagagugugugaaguaggaacugucaaacacuuauaaaaccaucagaucuugugagaacucacucccuaucaugagaacagcaugggggaaaccgccaccauaauucaaccccucucuccacacguggggauuguggggauuauaauucaagaugaaauuuuggggggugggaggacacagccaacccauaucaggagaguuaggcagagauaccugcccagguagauaaaggagcacauagcgauggggauaggugcucaauacaggcaaucagauucggagcugcuuuguucugaguuucuguguuuuauucucuuuuccaguaaaaacugcaucugugugcgcgcgcacacacgugcacacacacacacacacacacacacacacacacacacugcaaacauguucuuguacuccagugaggacuaaguggcacccauugugcuugguuagguuucuuucucuagacccauggagcaccagauaggagagccagugaacccgccugauguuaaaacugcagugcuacguuuuccugacucagccucuuuuuuuugccugaagcgcucuuuuuuuucuguuacccgccuugagaaauucuccuaauagucugcagcuucagcauggucaacucuaaaccccuuacacauuguagucaaacagagcuuauuuuaaauuucaaguuugcuuggauggccuuggucaaguuauuaccugccuugaggcuagcuuuucucauuuuucucaugcauguguaagaagaugaguuuuuuguuuuuuguuuuuuuuugguuagggcuguuguaaagaucaaauaaaauaucauugcuaagugucccaaacauaguauaugcccauagcuguuaguuccucaccuuccuuuaagacucaauccaggugcuaaucaaaugggaagucucacagucgacucagggaucaucagguaccaccugccuuuauaacaauucuucucacauuguauugcacuuauuugcuauuuguguccugagggcugacauauaauagccccccuucaagugacugcugaguuguggaaggcaguagcaauggccauagggagguaacgucuaucacaggauguagauguuucagaauuguggaaauuuaagcaguuagcaggcaucucaucucccaccucaauguaauuucaugaacaauuuacuucagaguagcuggaagaauuuagauaaucacugcauucauaaaacaacaucuccauuuaggggagguucuucccccauucuuucugaccucccuccccucccaaguugggagaucaacuuggggcuacuguuggaaguaagagacgucugugaaugucguauuaaauuaacacuggggaaaccauggggaagaucugugcauuucaucuguauuacucagcaguguucuagcacaaagcaccucuauguggagacagcuuuagguauaagagcauacaucuaaaaagauuuucccaagaauaugucugcccuaagaagcaacccauuuuacucuagcuauucuaaauagcuagccucuaaacugcuuuugaaguacauaaaauaauccauugcuuugggagaaaaaaaucaagcuucuguugguauuaauuuaucucauccuuuuaaaguuucuauuuucauauguuuauuauacacuauggaguagaacacauauaugccuuacaaauaaguagauauauguggggaacucaauuuuuugaugagggcaagaugguuuagaugacaaauacaacuuuuccuuuucccagacugugguuuugugcuugcucaccaaagcuaaccucagcaugcucaaaaggaagcagaguuccaggguggaagcccagccagucacugacuuugguccugaugagucucugucggauaaugcugacauccucuggauuaacaaaccaguaaguuucuucuuugaguauggagaagcauauguggaugugagauaaaugugauugacaaauucaaauaucauguaccuuuggcuucgaaauaucugagcugcaguagaauauggaugagguucagagucuggaaguagagaacaauccaaugaaauagugagaugucgcuaugaguuacucacauaggaagaugcacuggguagucugauccccuccccuccccacgcugugcacccuguccucagagucacaugguguagagaugauaccacuucuuaggcugauccaaagcugggguccaagaugagcaaccuguucugaaugaaccuccuuuacuuguugucaacguuccugaauccgugagacaauaugcacauguuuggaauuaaaggucuccuucugauuugcaaaauuugaguaaaaggucaaugagauaauggaugguaucucugaagaacuuugucaccuucaccgccuaauuaaguugaugaggauuugagaagaacugcuaggccaggcacgacugugugccagaaagcauaguaaccagaacuaagccugacaggcaugcauauccaugagugcuggaaucucagcucugcaaaaccaagcaggaucaacuucuuacucaucucaugguugaugcugaaguaacaaaaggaaauggccuguucccucuugcagugcuuguccuucccccaaccaugauacacacaugaucugcuuggacucuuugcuguccuucccagucucucuuccucuaaucugcccuccagguuacuuucccugccugcucacauuucuuucuauauuucuauuuuuauucacaucacgcuucugcuuuauaaucauggaagcaucccuauuaccuucauugcaaauuaaaauacguuagugugacauuccugcuucuuuucauucaggaccuaaccuguccagcaacugcuccuuuccugugucagcacacuguccacuugagccccaucagcagccuccuacuccucuaggcucucuggauuguucacauugcuuucccugcucguacugcucccuggccccagugacccuuucccagcuccucugaugagucaaauccuccucauccauuaggacuggaugagaugucaccucuggcauccuccucugaaaggcuuauuuccaccacagacagaauguaccucucuucucuuuccacuuagccuguuuuauauuuguauguaaauauaaaguuaucuauaaauaacuguauuuuuauaugcaucauauauuauguguauauuuacauuauauacauuguaggucguguguauauuuauauaauauacauauauuuauggaucuauugucuuagguauauauacauguuauauacacauacauauaaacauauaacagguuauauguauaucacauauauacacauuacacauacacauauauguuauauguguuaacauauaugcauauuacccacacauauaaauaucauguguauauaacauauauacaugucgcauaugcauauacauauauauuauauguauguauaauguguacauauauuuauaugugcaugcauauaacauguauauguaauauguauauauguuauauacgugagacuauacaugauauauguauauuaugucuuaucuagaacauguuuuauaauguuauauaaugugacauguuuuugccucuugcagugcuugucuuuccccuaaccaugauacaugcaggaucugcauggacucuuuguuguccuucccagucugucuuucuuucucuaaucugccuuccagacuacauguguuuacauguauguguauuuacaugaaacauaauauauacauacauauaacaugcuauguguauaugcacacauuauauauauguauguguauguauauauauauauauauauauauauauauauauauauauauauaauacauucauagguguuuuacuucuuggacugcaaagcaggagucagaaguguguugcuuccauauuuuguucuccauucccagcauucugacacauaguaggccuucauucauacuuagagaauugaauggaauagagaaugaagcaccccuaacuuuuucuuaguguccaucuuauuacagagcuuucuacaaacuuaugaagaagguaguauaaaagauguggccuuggaggcacuuacuaaaauuaauaauucuucauuaaaauuaugucuuuaaacuaaaaacacuuuuguuguugaagaacuuauauuuggaagcucuuuuguauaauuagauucuuuauguugaaaguccagauggggcuaaauucacacaccaauguuuauugaagugcuuccaaauugcaugaaaaauacaucaaccuuuaaaguaaacugaaucaucaguggcuuaugugguauggaauuagcagcaaaauaucuucauguaaauauuauaacugucagauaaauauuauaacuccucagcugcaagugucugagucuccugaaaguucugacagucuuuucuauuuuucaucuugaguauuugcuaguauauauagcugcagaauccaucuacuacaagacuaaaauuuuuuucagaguauuauauuaaagaauuaucauaauuucauauaugucccagauagucaauaaaaacguauuuggauuauguuuaagaauuguauacuaauugauuaacugguaauauuaauugugguggguuuagcauggagaugcaguuaaguauuuuuuuaauccuagauacuaguuuucauaauaaaauauugaguaugagugauuguauguccuguauauauauucauguuaacacacacuuaucuuuaauucuuucuucuuauuuugggguuaaagaaaaucuucagacagcagacaugccuguaguguugcacagaaaguuauuuuguggaauuuugaaagaugucugggcuaaauuuguauaaaauguguucuccaaaauaaagagaaaaaaucuaugcauuuuuuucaaauguaggaugagaccagauuuuuaaaaaguuucuuuguauuuuuauacaaaggcauuauauaucagauacaaauagaaaggaaauucuaaauaugggauguguuauauaucaauucauuuaaaaagcauuucuuaacuacuaugauaggcccuugugcuagaugcuagggaaguuaugguaaauauaguaugccccuaauucuagguacuuauaguacaaaaaugaaaaaaaaguaauggcacaucaaguuccuaugugacuaaauuacaaacacauauuuuaauugaaccagaaucuuccuauauuguagucugaugcccaggagguuaucagauguuugggagagccugaucagguuccgucuaugcuuugggucuuuguaacgcauggccacagaaaugccuccaccuuucugucuuaguguguuuauguggaaaauaggugccuugagaauuaaaugauauaaaaacgugaaaauauuuguagcacauuauaugcacuuaguguuagauuucuucuucuucaccuccacauuaguaaacuauuuuaaccucaguauuauguuuuccacuuagugugguucauaauacaaguuugagauaucaguuauggugccguguaguaacucuggaccaucauugcaguggguucacucuuugcugcgcaucugugccaucaucagcgucauuucuguuuguaugaauacgccaaugaccuucgagcacuauccuccacuucaguaugugaccuucacuuuggauacauuauugauguuucucuacacggcagagaugauagcaaaaaugcacauccggggcauugucaaggugagcacuuccaugucauuuaaacuaagaaccuaaauguguugaaagucuuaaucccuuuaaucauauuuucuuguucauuucaguaaaacaaaacaucauuuuaucuuauacauauggaaguccuuuuuaaaaaggcauaacuccagagacugggagaaauuguugcaugagacuauuuuaaaaguuaaauaaauuuuguaagucacaaacucuuggaauaucugagaaggaacaagaugguuugacuaaugacugugugaagucucgaguaggguuauucaugccacuuagggcugagcccacaacccagcacaggggcuggcccagagaagcaccuuauuauuuguugacuuagggagugcagaaucagagucacaugauagaguuagagcaugauauuauugcagcacgaugucauuuacuugauguguuuugaaaauacaaaaggauaaaaaaaaaaggacaugagauggaaaaaaugucuggggccaaaaggaaaauuaugugucaugugaaauuaguaccaauuggaaacaaaauagauauaaaauguuuuaaaaggguaaagaaagggaaagaaaaggaagaaaauuucugucacuggauaucuuuuccuuccauagcacuaaucuuuacauagguuaaacauauguagaugaugcugucccuagaguauuuaaauuguacuauuuggggaagcaguaauaggagugcagauuuuagaguuugacaaaugacagacgacucagaucuuaguucuuucacuuacugguuguaucagcaucucaaguuagcuaauuuuggugagaaaguguuuuauuuuguacaaggauuuugagaaucuacugagacaauauauaacacauaauuauuugucaauuucauugcuucccuuuuauacauaauuaauugugugccauccuugaaagacagagaucacagacaaugcauuaauagguucuuguuuaacuuuuuauuguggacuuuaaaaaauuuaccccaaaguauauuacaguuauaaugugaaucccuguaacuacacaucaacaauuaucaauauuuagccaauucuguuucauuuuaaagcaaaucugagaaaccaagucauuucagaaauaacuccuuuuguauuggugacugauaaaauuuucucuuuuuauaaccaccauaccauuaucaaauauaauaauauuuuacauaugauaaaauauuuguaacaagacuuagcaauaauuccuuaauguaggcuaauacuuaacccaccguucauauuuccuaauauugucacaaauuuuuuuuaugguugguuucuucaacucaagacucagacaagguuuacauaguauacuugauuguuuuuguuuucguuuuugggagggagguucacuuuuguugcccaggcuggagugcaauggcacgaucucagcucacugcaaccucugccuccugcauucaagcaauucuccugccucagccucccaaguagcugggauuacaggcauaagccaccaccccgggcuaauuuuguauuuucaguagagauggggcuucuccauguuggucuugaacucccgaccucaggugaucugcccgccucggccucccacuuauguuucuuaagucuccuuuaagucucuguaaguccacuaaguuucagcuuuucacauccugcaaaaaauuuuccuaugucauugauccauuggaagacaugcgucuuuugucuuguggaagauucuacauuugagauuuggcugauugcuuccagauggugcucuugaauaguuucuguguacuccuuguccucugaacugcuuuguauuuugaccagcaaugcgcacaggugcuucuuucccacauggucaccucaaaauaugucagacuucuggauauuugccagucugaagggugggaaacgguaauccacuguaguuuuaauuugcauuucccuuuugagagugagguuagaugggauuuuauguaucaagagccauuuuuaaguuacuauuuuuucauucaauuuuggccacucuguguguguuagaaguaucagccguuugugauauaaguugcaauuguuuuucccaguuugccauugugauuggcuuuguuugugguuauuuguaccauacacaauucuuauccaaaucauggacaaacuuucuauugucugcauuuuaugucauacaggagaguuuuguagguuuccucauacagauuuugcacauucuugguuauauuuaugcuuugguauuuuauuuaaucauuuuguuauuuguaugaggucuucuauuacauguucuaacuuguucuuuuaaaugaaggcuguugguuucuauacauuaauauuauauucugcuacuuuacuaaauguucuagauucuuguauuagucauaauaguuuuccugcuaauucuuuugaugcuuccauaugaucauaucauauucaaauaaagaaagauuugucuuuuucuuuguaauuuuuaugcccuaguugcuuuuacuuacuuaaaguaaaauaaaugaauugacuaacacugccgguaaaauuuuaaauacuaguagagguagugaacauuuuuauuuuguuuuguuuuugguuuaucuagaacaucucuaguguuucuucauuaacuaguucaaaaaauugggauuugaaguauguguacauuauuggauuaagugaauaaacuuuaauuucacauuuugagaguuguagcacaacuagcuuuuuaauuugucaaauguuuauuuuuaauuugucaaauuauuauuuuuuccuuagugcuuguaagagaagagauuuuuaaauauugaguuauccuuccauuccgauaaagaaaaaucccuacugggucaacauacauuuuuauucuauuuuaauguguuguuuuguuauauauguuauuauuuuccuuauuuuaaauuuggucuaaucuuugucagguuuugauauuagauuuuucauguguguggguggcgggcauguaugcacacuauaaaauagucugagcacucucagaauuguuuucacuuuaaaaguuugguaucaguucccggugaaaucaucugguccuguugcguuuuuguggggguuccuuugcaguauuuccuauuucuucuauggaaauugucuguuuuauuuuuauuuuuauuuuuuauuuuuuguuuuuuuuuuguuuuuguuuuuguuuuuucgagauggagucucacucuugucacccaggcuggagugcagugguucauuuucggcucacugcaaccucugucccccagguucaagcgauucuccugccuuagccucccgaguagcugggacuacaagcgugugccaccacgccuggcuaacuuuuuguguguuuaguagagaugcgguuucacuguguuggccaggauggucucaaucuccugaccuugugauccaccugucuuggcuucccaaagugcugggauuacaggcgugagccacuguggcagaccuaugucuucauuuuuuaguagagacaagaucuugcucuguugcccaggcuggaguguaguggugugaucauagcucacugcaaccuccagcucuugggaucaagagaucucccaccucauccucccauguagcugggacuacaggugugugccaccauguguggcugauucuuaaaacuuuuuuuagagacagggucuugcuauguugcccaggcuggucuccaacucccagacucaagcgauccucccaccucggccucccaaagugcugggauuacaggcgugagucacaguguucagucaaaacugucuguuucagacuugcuuggucuauuggggucuauuuggugaaguauauuuucuuaggaaauuauccccuauuuauuuuguuuaauuauuugguaacauagaccuguguaaauagcuuuucuuuccucuguuugauuuucuccuaauuuuguauuuuuuuguuauuuugauuagcauuuuguugucaucagguuggcuagcaguauuuuuuguuuguuccauuuuguuuuagguuagccaauugguuugcucauuuuguugauuuuuuuuaaaaagaaucagcuuaauuaacuuauuaauuuuuguuuaauuuuuuuccuuuaaaaauauuuuuauuauacuuuaaguucuaggguacaugugcauaacaugcagguuuguuacauauguauacaugugccauguuggugugcugcacccauuaacuugucauuuacauuagguauauuuccuaaugcuaucccuccucccucccccgaccccaugacaggccccgguuugugauguuccccuuccuguguccaagugcauuuauuaguuucuuucuuugcuuuauuugguuuacuuuaugggucuguuucuaacuuuucgaagguguuugucucacauuuucauuucuugagacucuuaaaucugcugcuuccuugccucgugguuaaaauguuaaccacaaggauaauguuaaccagcagcauaaaauguuacugcugagaauguuuuuuuuucccucgaaguggcuugcucuuuucuccugaauacggaaagagacuuucccuuuauuguucaagucagcagcucuaugagaauguauguuaucuuuuuguugauaguuacggauauauuuuccuaguuucaucaugugauauuuauuuuauugcauuguuuucaggauuccuuuuguauucuaauuauaccaggaucuaugguuuggucuuuccuuuccuuuguuuucuuuccauguauuucccucuguuuuuauguuuucuacauucucuuucccuugcuucacuccucaugcuguccccucacuccucuguccccuguauuucacuccucuuucucaaauacuuuuuucauuucuuuuucaucauuuccugaacaguuuuuguucuuucuuuuuuuagucucuuaucauuuagacaucauuucuguguuuucuuauuucuaguuuugugauucuuuuggagcuucuauuuguuuaaauuucuuuuggucauguugucauauucgauuauagucuucaucugcuuugaguguuuauuuucuguuuauacguuuauguauuauuuuauuuuuacuuuuauuauuuuuugagacagaaccucgcucugucacccaggccggaguacaguggugcaaucuuggcucacugcaaccuccaccuucuggguucaagcaauucuccugccucagccuccugaguagcugagauuacaggcacgcaccaccacacccggcuaauuuuuguauuuuuaguagagaugggguuucaccacguuggccaggccagucucagacuccugaccucaggugauucgccugccuuggccucccaagguucugggauuccaggcgugagccaccaugcccggccuauguauuauuucauucaucuuauucuguaauguuuuuacaagggcuucaucaugauccguuuguuugguuguucuucuuguuguucacaugaaaugggaguuuuucccacacauuggguagaguagccucugcauauugucaguacgaggggucccuccacuguuguuauccugauggguaaacauggagcuuuucuguguaccgaccgucagguucugagcucugcugccucuggacugcuggcccaauuaucgaauauuucuuacccacuggccccagugucccugcccuacugaauugccauucuaaacauggggcuguggucuggaaaggguuuuuguuggguguccuuuggaguuucuaauauuccauugccucugaucuuucugcaguuucuuggggacauugguagucauuuguuuuuguuuuguuccuuuguuuuacauuaaccugcaacuugcagccuaccaguuuacauuucuacaaauguugccauuuauuuuaagguucaccuucugagauaucugcucagcauuccacacguauuuauuagugauuuugggguuuuggaaaucuacugguuuauggaagaggugggcauccuccauagcuucaaugaacagauuucaggaugauuccaaaauugucuguaucuuccacaauguggcuaggcuaguuuuuauaagcacuagguuuagauaagcauagguucagaaaacuggaaccugucucaggaggccaucuugggagaaaguuggucuugggagaaugcuaacaucucuguuauucacaguacuccccuggacguugcccggcccuagcucacauucuguguaguugcccggcccuagcucacuagagggccaugaauggcccugucacuuguguguagugguuauuggggccauggcaaccuuugcccaugcauugaaagaucugaauauucugggugaagcauuuuaugauugaaauugccauguguugacuucuuaaggguuccauuugaaugaaacaaauaagugacauguuccuacaagaaaacuuuuguuuuuuuaagucauuaaauaaagacuuggauuucacaucacuaaaaugauaguaggcauucugcuaguugucacagucuaaugauaaaaagaacagaggcauacuuaauauauaaauuauauacucauuccaagugaacagagcagugagagaacacaaguuuuaauaauguaaauguuagaaguugaaucaauaguuaaaagagaaagaaaugacuuaggaccaaaucguuuucaaaaugcuguaaauuagccauuuccaguauuuucacauuuccaucaacauuugggugaugagcuauuuacuacaaccaaaauuuuuuuuuuuauuuucaaucuguaagaggugaaauuuaaaaugaaaaucaaauaagguuuucugguuuucauucagaaauaauuggaucaaauacaacuguaaugcaauuuuaguaauauugcacuguuaacauuaucuugaaguagucagcucaacuucauagcucaguaaaacugguauucuauguuuaaaugcuagcuaacguuuuaguuaaauauaguuaaauaugaaaucuguuuauccugaaccaagcuuuaaauguaucaacucacuaaauuuuuaccaucauggccucuauuauuguuagaggguaauaauuauaucaguaaguacugucauuuucaugauauuaaaucuaagccacaguuuuauuauuuuuauacuacagacuucuucaaacaugcaugucauaacagauacagcucaaagaguauauugggcuugauauuauuuucuuauauucaaaacuuaaacuuuuaauaagacuuuauuuuagcaaaauguccuuugucacauuaaauguauguuccuaauuuauauuuuauuagcuuugcauuuuuguauuuguaaauuuguuuugcuuuuauacuuacaugagaaauuuguacauauuguagguguuuaaguuacaucauaauaaaaacacacugucacaucgaaguucuauaccuuucaggggaccucucauauuacucaaguuugaguuacuaugcuuucuucaacucuaccauaauuuuuaaaacuuuuguuaagcacuugucugcugaaaaccucaucauuuuucauacuuuuucuaccuuaauacauuugccaauagcacugcaguuaucucucaauucuuuagucccuucacccagaauaauuugcaaauaugugcugcauuuucucacuaacauuuaagcuuguauuuuuucauacauaaauaggaacguuaugaauauacauguucuauuuuaaucuucagguuacacuuuucauaguaaguuuucacauuguuuggaacagaguugugcaaauaugaaauguuuaauauucacugauuuccaucuaaaauauuucuaaggaauagucaaauuuaguuauugagugagcaguaccuguuagccauguguucuggguggaaaagugugugugaguugauguacacauaugccagugauuugcgaaaugcuaaccuguuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgccuggccaaccuguuauuuuuuaaagagucuuuuccaugcauaaaaguauguuaguccauaagaaaauauuuauagaagcaaaccaauguauuuuugcccagcugucaugcacaguucuuuaaaauuauaccuagccaauuuuggcaauguuaugguguaccuaagagucauaccuaaucguuaaaguaguguuauccaaugauaccuaguuuauaaaauuaugcacgacaaaccaaacccagaaacuuuauuuuuucaaaacaaacgugucaaagcuguggcuuccuagcauugccuacuaaguuuauugaccuaguaauuugccaaauauauuaaaauauguauaaauauaaauauaaaauauguaagauaugaaaauguuuaagauauuuaagauauaaauguaauauaagaaugaguuauauucuuaaacccaaguacaguuuccaaguuuuccuuuagucauccagcaaccauuuauugaacacuuacaaugagcucaucucuguccuuggagaagggaaacagacaaaaccaagcagagcuccuguccucagagaaaaccugguucacucugugggacagacuuagcacauacaggcacucuucauuuucaacauccaauauauuucugaaaacaugguggauagcauauuuucagaaaauaggcacuucucuuucacuaauuuauaugggaaaacuaauaauguauuaggggagcucgacugauuucuccaaauaucacugcauuaccaucuaauaccuauacaagucaaccugcauauuucugcaaaauaaaaagcauuuaaaacaucccuuacccaauuauuugcacuaaucaaaccacaguggauguuuuauaugugcccaacaauaacaggaaguuucuguuauuaaguaaauuuaaaaaauacauuaaaguaccauccaccauauuuuauugaauuguugauaucaucaauuguaaaaaaaaauggcaucacuucacagauucacgggucucuaagaaauaauaaaggcuucuaauuauacuuugacuguaagauguaagauuuuaauugaagcaucaauuagaagaugcaugcugaauccagaauugugcaacuguguuggagcaggguaggguguguuuuagaauuggugaaauaugauaaaaugggccuggguugguaaacucaauuuuuggaucuuuugaaaggcuaacuuucaggggaaagguaagacagaggaagauaucaaugcacuaguauuaaauaguuaaguagguaaacaaugcugguacaagauugggcccaaaaggugaacaacagagauacaccugcauugcacacuauaccuuuggcagaauccacuggcaacuuuaaugucuccauuggcacacgugcaaagucauuauggugguucuucuagguucauagugauucuggggcaaacauuuuuugcagauauaaauagcaaauauuaguauaaugagaaucuacauagagagggaccuucuuuuuuuuuaugaaagggcuuuaauaguggucuguaaaagcuaugggggaggcaggcauaaaaaagaaaaggaccaaaacugucugcuuggggauaucagagaagucuugaagaaagaggaacgugaaacaaugccuugaaggaugaguaaguguggucuguggcaggggugauggaaguaagauagaaguaagggaucucacggagaaagaaaaggaauaugaggcacaaaggaguggaacagcaagguacaugccgagcucaaaguagucagaaguggcagaugggcugugcacaggaggcagcuggagaggaguuugugaaacuagaccuggcugcaucauggagggcccagcaggcucugcaaggaguucugacuuuguucuguggucaguaaagaugcauggaggauuuucaucugagagugguacaaucugauuuguguuugaauaguucacucuggaaguuacaugcuggaugcacagcuggggagagaaacugaagcagaaaguccuuccagcaagaaaugucuuuaacaauuuuuguuggaggaaugcauuuguuuuaaguguuuuccaucuuuuauaauauucccaaagcuugaaggugcuugcccaucaauucccacuccucaacagcuuucuucuaauugccucccuaauuccucuugcuggaagcauuuucacucaccaaaucccuagaggugaaaagaaacuauuuggaugauacaugucuguguuguugcagagcacuucaugcauugcagacugugaguucuuuagaccauucucaguugucuauuucacaucuggcaauagauacaaguaaaaguagcaugcauccuuuaagcacuguugaaguaauauauaaugaugcuaagacauagugacagaugggcccuggaaacuugggacaauaaauccuguucucaugaaacuguaccagugcauaucauuuugucacugcaaaauauaucccuauaaauguguuuccuuuuucugcuuguuaaauacuugcaugauauguuguuacuuucuuaccuuaucguugauuggcagucuucaaguguuuaccguuauaaaaauugacauauacagcucuugaagcacuccucuccucagccaccaaagugcugauuuuugcgcauagcucaagcacucucugcccuccauuucuuguugauggaacaaacaaauuaaaacauuuuuucauauuuaagguguuaaaauaucuugaguaccacugggcauucauauguguuagcuucugguugcauauuuuagaauuggguugcaaauauuauaacuugagccucaauacaguagaauuuuaaaggaucuggccaugcuuauaaauggaaucaaagcaacuuugacuacuauggcuagggcuucugacgauaauuugauaaaugugccagauacaaaacauaauccaagauuguauugcaaagugucagauuucaaggucugcauucuacuuauuuaaaaguauuauaaacuuauugugccuuagcaauuauugauaaugauuaauaugauaguaauuuuaauuccuaccaguucaauuguauuuacaaucaugguaauguauaaaauauguaaaccguaacuguauuugcauggcauguuuaguucugcuuaugcaaacuaugcuaauccaggaaguauccauaagucaucucauaaucucgucugugaucuuucaugguuacaaaggagccagaaaggaauaauuucuuuuuagaagcauacaaauaauuucagugaauagauggauggauggaugcauucauuaagaaauauuaacugacaucuugcuguauacauuguauauuaacugacaucuugcuguauacacuguaucuaagacaugguucauguaccuaucucaucauucauuuaauaucugcuauaugucacccacuguacugggugcugcaaacacaaccuuaaauuauccgacuuaaagucucaggguguuacucaucuucagaauacacucaaacauuuaccaugagagauagacuucuuuuuuuuuuucuaauguaacuccagagaauacguucagagaagauuuaaguaggaaacucaaacuucaccaucagauccaauaaguuggagagaccaaauauaaauucaugaaauaaccaauauggauuacaaaggcauauucugcgaguaacacaagaugcacauuauuuauauacaugagcugaguugucaguuguugcaugacgccugaguuaaggugaucagaggaggcuguagucagaucacucuggaaggaaagguuggcacagacuuggcagaauuuuucgggaagauggacagcaugaaaaacaaugaacauuaaaaagccaaagauuuuuuacaaauggaaaaaugcugaggguugcuggccuuuguaucuugggucauaacucugcuuauaaaagauguuuaugaauauugaaugacucuuggaaacaugagccaaaaaguaauacaugaaacuuaugcccagaggauuauuuccauacuucacugggaaaauaaaaagaggucaauucugauugaccacugcauaccaucuagcaugugcugagcuuguuggugacacaggaaugccacuauauguuucugaaaaguccaaggcagaagacauuccaaacaaaacaauuaaauuacuuccuauggaaaagaaaguuuucuacauuacaugguagaauuuuugcuaagccaguuuuuauaacugaggucguucgaaauuaagauguuuguaugcuucuaauuucugaucaccacuggugcuucuaaaaugauuuaaaauaauucauuauuuuauauaguuugaaauguagugugggccaguuuuacaacauuaauuuccuuagcaaagaaaucagaaacaaaaauucagucacaucuguuauugauagcuuuucauucugaauuggugaggccccaauuuuuaaauuuaaauuuauuuuugccaacuggagaagugauuuuguuaaagcuaaaauguccaacuuaaaaaaaaaauugaaaagcuauuuuuaaaaauuuaacauguaagcauugguccaaaaacauaucagaauacauugugaaaagcaugucucuccuccaccuuuggcuccuggccauucacuugcccgccccccuccccauaacacaaagggaaguaucacuguuuauccucauuuguuaacauuguaaauguaccucauuguaauggugaacucucauucaauguuccaccgaguuuaauucauuucuaaagcaaauuaugagcaauuaaaaagaggguaauuguagugcugcuacauauaacauuguuaaugacaaaaaugaaauaaaauaguaauacuguuuugaaaaaguacaauauaaauucauccuauuugggugcccguguacucaacgaucuauaauuacucuuuuccugccuaauauguacucauucauugcuccaauuuuaacauaguucucugcugagucccauaaaauuucaguuuucguuuuuggaauucuuugccuuuuuaaaaacaagugacaacucugccuaguucuuaaaauaaagaugaagugauacuuuucuuuuuuuuucccuaacacacaaguaaaaaacauuuguucauuuaauaaaaguccauuugaaaauauacacuuuuauuuuucuucaugacacuugucaacauauaacauaaugaauauuuuauauuuuauuucauucagaauguaaauugcuuaaagacagaagcguuuguuuuguucacccucguaucccuaguucuugaacacugccuagguuaaagggaugcuuaugagcugagggaaagaaggaaguaagggagggagagagggaggaaggaaugaagggcacaacuuuaaauaauucaucuucuauuaccuucuuggguauuaaucaaauuuaggcucagaaaaagucaauuuuauaugggcuauguuaucuguauuuagauuauaauuaauuuacauuuucaacugugcaauauacgaggcaaguaugaugcuuauaguuaaagauccucugugagaucuuuaacacaacuauuaaaaaaugcaacuauaaaaaaaguugaagaugacuauaaaaaauccuuacguuauuuguuauauauguaaccuuugugaugcguuuauguguagcacauaaacaccaguagcaucgguagcauccuaagaugcagcuuuucucuuccuuggguauaaaucuucauaugaugauaaucacacaauuuaauaaggccauuguccuucuugucacccagagccaagcuucagaguuugcuuucauaucucuuuugugagucuucccaaacccaggagucaccaaguuugguugauuaccuugccccugaaaacauuauuuguccguucauuugggaauuaacauugguuucucuaaacuccccauagaauuaaucuuaccaucuuucccaccauguuuauagcuuuaaguuauuuugcuuuauauacuagcuggauguguucacaucuguuuuucuacaagacuguucuuuugguuguuggugguggugauggugguguguguguguguguguguguguguguguguguguuagcuaggcauuauauauccucuaauguaaaacaggcacuuacccaguguucauuaaguugaguuuauacuucauuuuugggucaaauaacuuccauuaaguguuuuaucauaguguuaguuuugcauacaccauaaacuauuuccagaaaccucucaaggagauauuuggauacuuauuuguuacuaaagguagaggcuuaugucaauauccugcaacauguuuuaucauuugauuugaaaucuugacauuuuauuucuauuuucauuucccuagcagguuuaaucagaggagguaaugauauaugugacugaauucagaauugacuuacauggaugauuacagaauucaugauuuaaugggauaguccuaaaaaagcaaaggcuuuucuguuuaaaguuucuaauuuuuaaccucaugaaguuuucuguuuuauuauuccaaaggcauuuuuuaaauucccauguuauuaaagcauucuaaugucagaauagauacccuauuaaaaaaugaaagugguacaucuuuaucuuucuuuuacauaugcaaucccaauuaaaauuaaagucaauauguguuuuccuugcaaauuaagacaaguuucuucuucacuuuuuuuuguuagucuugaauucuauuuuuauuacacugugguccaagagaaugguuguuuugauuucaguuauuuugcauuuucugagagauguuuuaugucugauuaaguguugauguuagaauaugugcuaugugacaaugagaaaaaauguauauauguguauauauacauccacauauauacaguggaaaguucuguagaugucuaucaggugcauuugaucuuuggggguuuuugccuuaaugaucuaauacugucaagguguugaaaucucccaauauuauuaugcagaacuguaagucucuuugaacaucucuaagaacuugcuuuauaaauuuggguguuccuguguaaagugcauauauaguuaggauaguugggucuuuuuuuauuauuauaaaaaauuugcagaaugugcaguuuuguuacacagguauacacgugccauggugguuugcugcaccaucaaccugucaucuacguuagguguuucuccuaaugcuaucccucuccuagccccccaccucuugacaggcccgugugugauguuccccucccuguguccauauguucucauuguucgacucccacuuaugagugagaacaugcaguguuugguuuucuguuccuguguuaguuuggcugagagugaugguuuccagcuucauccaugucccuucaagaaacaugaacucauccuuuuuuauggcugcauaguauuccauaguauauugggccacauuuucuuuaaccaguuuaucauugaugggcauuuggauugauuccaagucuuugcuauugugaauagugcugcaauaaacauacgugugcauguguccuuguacuagaaugauuuguaauccuuuggguauauauccaguaaugggauugcuaggucaaaugguauuucugguucuagauccuugaggaaucgccacacugucuuucacaaugguugaacuaauuuacacucccaccaacaguguaaaaguguuccuaguucucuacauccucuccagcaucuguuguuuccugacuuuuuaaugaucaccauuaaacuggcgugagaugguaucucauugugguuuugauuugcauuucucuaaugaccagugaugaugagcuuuuuuucuucuucacuuuuuaaucagcuugaagugaaugccuuguuaguuuuccuacuaacggugcuaaaccuagcaguuuuaaagaccuuccuguugaccacagugcacucuugguucuuguaggcagggagcuggcuuaggaccuacauagcauauuuggaacaauggcuucugguucuuuaaguguuagaauuuguguggcugagaaaaaaaaaauagugauauuuucccuuugcaugaauuaaauauuuuaccugcaaaguugcuugucuuuuauaaauuauuuuucuuauaaguaaugcuacuuaaaaugcuaaacuuauuccuugugaaagucuguucuauuaugauacaaaaauuguagauagcuuuuauugaaauaauauuugacauuuuccuccacagauuguucuuuaaaauauuugcuuugccuaauaaugccauguaaaauuuauuuuuagggggauaguuccuaugugaaagaucgcugguguguuuuugauggauuuauggucuuuugccuuuggguuucuuuggugcuacagguaauuaaauauuuuuuaaauuacaagcagguauucuccaaaaugggaauuauuuugcauuaaaagucuaaauagaaauauuacaaaauauauaucaaaugugauuguguaauugccuacaacauuuuauuuuauuuuuauuuuaacagaugugauuagucuguuuacucugacauauuugaaauuugaaaaauuaauuuuaauugauacguaauacuuguauguauuuaugggggacugagugauauuugauguauacaagguguaaugaucaaaucugcauaauuagcaauuuuauaucaccucaaacauuuuauuguuagaaaagucaauagcuguaauaucuuaauuauugucaguuaugauugugaauuauuucucaaucagaaacgaaaaucaauacuauagaaaauuauuagcuguuaaucagauauaaaauauauucccugaaaugaaggaaacaauguggagcaauauuucuguauuuguaaauaaaaaauugaacuuaaaaauuuaaagucuagucuccccauauuuggauagguauuagccaacauaaaauacuauauugcaaauauuaaaugcuuuauuauaagugauggggaacguacauuaaaaagacuuacaggacagauuugauuggaaaauaaguagaauuaauuucugugcauucauucagacaugauuuugccuuuuaauucaacuaaaguuacuauauucuauugauuugauuugaucuguuuugauuugguugugguaagaaugccuaacaugaaaucuacuguuuuaaugaauuuuaauuguacaauaaauuauuguuaacuguagguacaauguuguacaggucucuagaguucaaucaucuauucuuuauuuaaaaauucagaauucaaaacuucacagcccauucugccaacucaucauaguguuuguugauaagcuuuccuuucauauuuuuauaaaguucaccucucccacaauuuaauuucaucacucauauauuuuuuuaaucagcuuugucagguugaauuguuucucacauuaauguguucuuuuccauuuaauaacuauuaugugauugacaaacauuucaaauuauuauuuugccuguuaguaaauagugcaauucuuuuuuaauauuuuaacccuuucucuauuacuuuauuuucuagauauucaaaagccuccacuaaagaacguuauuaacaagaaagacagcauacuuacuauauauucuaaguuggcacuucuuguaacuaaaaacugucuuaacgaacgagacaggaaaugaauaagauuaauguuguucuuauuaguuuauguauuuguuucuguuaagauagcuauagcuucaaaauauacucaaaagaaaguggauuuugguggaaaauaauguauggcuaaauucagaguagaggugcaccuacuuaugcugcuaacaucuguauguuccaugacuauaagcaaugcuaagggaaaauccaaccucauuuacccaucuuuuaauuuguagguguuugaaauugcugauauaguugaucagaugucaccuuggggcauguugcggauuccacggccacugauuaugauccgagcauuccggauuuauuuccgauuugaacugccaaggaccagaauuacaaauauuuuaaagugagcgcugcuuuacaauaaguuaagaggaaaaguuuaugaaguuuuuuguaaguuuuauguacuuuaccuacuuuuguuucucuaggcgaucgggagaacaaauauggaguguuuccauuuuucuacuuuucuuucuacuucuuuauggaauuuuaggaguucagauguuuggaacauuuacuuaucacuguguuguaaaugacacaaagccaggguaaguuuaucuauuaacugcauuuuaaucuaguugauuaacaaagauaucucuguaauuuucauaagaauaaccucuaugucagauuuuuuaaacagugcuuauguccucuuuguucugugucucugcuuccucgguauuguuuuuguccaguuuuuauuuuauuuuauuuuauuuuauuuuugagauggagucucgcucugucaugaggcuggggugcaguggcgcgaucucgguucacugcaaccuccgcaucccggguucaagcguuucuccuuccucagccugccaaguagcugggacuacaggcgugcaccaccaugcccgacuaauuuuuguuuuguccaauuuuuaaagacaaguauucaagacaggacagauuggaaaauguaaccugguggaaaaguagauuaagcaaaugcaaaguguacauuuagaaaccuuaguguggcaaaauggggagugugcuaacauaauaacauaaaccuagagcuucacuguggaagcuuuucauauuagaaugaguuacauguucgggaaaaaaagcucauuuuuauuauuauuuacuuuugucaucauucccuaaaauaguuuccuaaaugauuauaacaucauuucuagacuaaacacuauuaucuguugcauuugacuguuguaggguugguggguaagauagaauguauguacuuuaauuaccuauuauguauuaugcaauagagcaccugccucuucuacuuggcugaucauuguuaauauacaacuccagggaugugauggcaggagagagcagagugggauguuggccccuggaugguccagaagugucccauuagguguuagcuagauauagaguuugggguuccaagcacaacccagaagugcaacagauaugacuaugccagauuucagggcagcagggauuggggauaauacaauugauuuuauaccuuauauucaaaucuucacauaggaauuugucuauuuauaaaugaagaacucauccauaaauuaccgauugaaaaaucuugauucaaaucuuagaaauuagauuuaaagcacuuuguaaaauucaaaaagagauuacaagcagccauucaucuucaaaauauuuuuaauauaucaauaucuacuuacaaaccaauuggguauauaaggaucauugaguuuaaaaacauugaaaggguuauguuguguuuucugcaguuggaggauuucuuuuucauaaagucuauauacuuguauauauacaaaguaaauaaaccacaaauaagugaauaucucugugaguauagacaucaugauaagcuuggcucaauuccaacacuuuauuuuaugaguuugcauaaauuauuuagguuacuccucaaugaaguagauuaauaacaggacauacuuucuagaggcaucaggaagagcaaaugagggaaugaauguaaagacaagcaaaguaaccagcacauaguaaaggcauucacuguaugccagcugucauuauuuuguugucauaaagagauacguaaacacgcuuacaugcugaggugguaggcauaaguguauccuccaaaauagagauaacaugguuaaaaaaaaggaaagagcaauaaagaagaccaaaauuuaaacuuguaagagugugaaaggaaaacaucuaugaguaacucauggcuauguuauuuuacugacaaaguaacuaaauuaauucugaguuuauuucacauuuauaauggucauuuaauuauuagucucucacagaaauaaauuuaauaauugaauuucuaauucaugcacaaacaguauauguauauuaugcaacuccuaauaauuauauaauguucuaaaaacuaaaagugaauuuaguuguuugcuguugcaccaccccaaagaaugucaacuccaaaaagguagagauuuuguuuccacguguuuucagaccaggaggcaugugcaaguuucuaggaaaauaugaauguauucaguaacuucaaaacaucaguauaauuucacugguuaaauguuaaacaguaaagcauaaucuauuagucaaggccuuaauuaauuuuauuuuuauuuagaaggcaugcaucucauaccuacuuagaaauuuaccagagggggcugugcacaguggcucacaccuguaaucucagcacuuuaggaggcugaggaggguagauaaccugaggucaggaguuccagaccagccugaccaauacggugaaacccccucucuacuaaaaauaugaaaauuagccgggcaugguggcacaggcaccuguaaugccaggaggcaccugugaucgggaggcugagacaagagaauugcuugaauccagaaggcggagguugcagugagcugagaucgcgccacugcacuccagccuggaccacagagcaagacuccgucucaaaaaaaaaaaaaaaaaaaaagaaagaaauuuaccuuagguucacagaaguguggacagauaccaugccuuccuugauuauccauaguauuauguugaaguaaagaucucauuuuuucuuguuuuuuaauauaacuuuuauuuuugcaugaugugagugaauaaucuauucaaaauuauuuuuaaaagaaaaauacuguugcuacuaaccccacuccuaaucuucauuauuauuguucaaaauagccuuggaaaauaacuuuuugauaaccauuuucuggacauauuauuauuuuccccuauuauugaaauuaugucucuacuuuaaccacuuuauugagauuuuggugaauauaaaaaucuuuacauauuuauuauauaugucuugagggaacuauuuccuuuuucugucagaauuaaauccagagaguaaguuauugcauuuauuauucuacuuccugaaaauuaugauccuucucaaauuaacuuguauauuucuuaugagguacuuccugaaaauaaugauccuccucaaauuaauuuguguauuucuuaugagguacgggucaagauguagucuuaacuuagugguuggaauggacaucgguaucuuaggagaagcucucaguauuuccguuaagugggaugugagcuguagaguuuucaaagugaggaaguuaccuuuaauuccuauagugccaagaguuuuugaucauugauguaugcuaaauuuuguccagugcuuuuccguuuuguucaguuaauguaaugaauuacaugauugacuuuuuaaauagaaaccaaucuugcauuucugguauauugcuaauuuggucauauuguauuccucuuuauacauuggaagauuugauuugcuaauguuuuuguuacaaauuauugcaucuuuguucacaaggagcauuauuuuuagguuuuuuaaauugaaauaucuuuaccgggucuugaaauccggguaaugcuguccucauaaaacaaguggaacauguuuccaaggguuaauauaagauucauauucuuucuuucuuaaauguuugauagaauucaugaguaaaacucagggccugaaauuuucuuugugagaacguuuuucauuacaaauuaaauguauucaacuuacagagcuauggaguuguuaucuuucuuguucuguuaaguugguaaauuuugcuuuucaaagagcuuaccuauuuuuauaauuugucaauauugcauaauguuuauacaaaugcccucugauuaucuuuugaaugucugauuaucuuuuuaacaucuguagaauagugguaauaagccauuuuuuccugacauugauaauuuguaccuuucucuccauuuuuuuaugucuucucaauuguauuauucuuuucacacacacacaagaaucuuugcccuauuuaauguucucuauuguuagucuguuuuucauguugauuuuuuaucuucauuauuuccuuauuucugcuuuuuaguuuuuguuuucuuuuucaucuuucauaaaaugaagguauauagacaucuuuuaacauuuuucuaauacaauaauuuaaaaauauaauuuuccucuaagcacuguuuuagccucuaagcacuguuuuagcugcauuuccaaaauguugauauguuguauuuuuauuauuauucaauucaaauaucuucuaauauaugugauuucuccuuugaccuguagguuauuuagaagugcauuuuuagaaggaugagauuuucuaaaaauguuauuugggugcauaauuuuauucuguuguggucagacaauagucccugugaaauuucagccuuuugaaauucauuaggaaucauuuuaaggaccaguauauggucugaauuggugaaaauuccaugagaauuugaaaagaaaaaagugaaaucugcaguuuuugaguauaauaucuauaaaugucaccaaagucaaguuggcugauaauuuguucuggguauuucuauccuucuugguuuuuaaaaucaggguuguucuagcaauugcugagagaguacuauucaauuuucuagacaugacagaaauuuucaaucucucuuauuuuugucaguuuuugcuuucuauaauuuucaacuuuaauuaggcgcauaacgugucauuguaucuuucagaugggcugaccuuuuuaucgucaugaauuuugaauuuuuuuccuaauuagcuucgggaugccaggguauaugaugggucaagaacaugacguuucaaauuuuucaguaaucauaacucuaaaguaauguguaacucugaaauaauuuauuuuauuuaaucaucuuuuaucuuauuaaucaauugauuuguucccacaauuacuuacguguacuuuagaccauuccuggauugacaguaaaagggagcacaugacaaauucuuaguuuuagagcaugggcugcacaauccugagcccagccugguggugaugaaauuaagcccaguacuaagagcguaaaugaagaagaaacucaguaguaagagaguguggaccaacuggucagaugcucuaaucagcaacucucauuccacugucaaaaccuuggagauuuuguauguuuuuuaaauaggugaagugaaucaaguggugccuaccaaauuuauuuuguccucugcaucagugcguggcauacaacauuaacaaugagaagcaacuaacuccuauaagcuauuuugggggaauagaggaugguacaaauaucacaacuuuacagcaaauauuacaacuccuucaaaacacaguuuggcaguuuuuaaaaaaauaaaaauaaaagaguugaucaagcuggguacaguggcacacaccuguaaucucagcacuuugggagacugaggugggaugaucacuugagcccaggaguuugagacuagagugagcuaugauugcgucacugcacuccagccugggugauagagugagacccagucucuaagaaguaaaaaugaaagaaagaaaaaaaguuggacaggcaccugccacaucucauuuauuccacuccagguauuuaaccaaaauaaauaaaaauguauguccauagaaagauuuacacaugaaugcccacagcaacuuuauucauaguacuccaaacuggugacaacccaaauuuccaucaacagauagauaaacuaaugaugguauauccauauaauaaauacuguuuaauaauaauaaauaaugaacuauugauguauacagcaucuuggauaaaucucaaaauaauuaugaugacugaauaaagccagauuuaaaaagaggacauguucuauuauuccauuuacauaaaauucuagaaaaugcaaacuuaucuuuaaugauagaaaagaaaucagcaguugccuagugauaaagguuguggugggaauuaagggauuacaaaggggccucaagaaaccuuugggguuuauugacauguucauuaucuugacugugcuucuguacaugugccaaaacuuaucaaacuguacacuuucguaugugcaguuuauguuaugucaguuacacccacugaaacugcuuaaaaugucucagugugaaguagaaaucuaauuuuucauaugguuaagcaauugugccugcacuauuuauugugugcuauuacccacugaguuuaguuucaccugucucauucacuaauucccugucuauacgugggucuguuccuguggggcucuguugugcuucacuggucuauuggacuaccucuuugccaauaucacacucugaaagucuuucaaauuacaaucuggcuuuacacauggggucauauuuccagcuuucagcuuuacaugggcucaagaccuggucuuccgccucacaugggcauuaaaacccaggcauuagcucccauucauaacacuaugucaacucauguuccuucuguuccuacucauuuacugcuuuccuucuuauguuuugacauuuuggaaugcagguuuuguauugugagccuaaaugcggaguuuuuaaugcuaucuauuuguuuguaguggaaggaguugaauuugguguaguccaucuugccacaaccaggacucacauccauagcuauuuuuuuuucuauuuuugucuaagguccuugaggacacguaugagaaagguaaagaggauauuguguuauauucaucuuuuuauccuuacuaccuaguauccuaacacagaauaaauaauuaguaacuauuuauugaaggcaugguugagaacauauucuauuuagacagauaauauuaacaugaugacaaauugauaaagaagaugaaauaaaaaagaaacagagaaaaguaaguugcuaaaagcaggaaaggagaaauggcuaaaaaauagaaaaacaaaguuuaagcagaaagaagcagugaauuaguucauauacggaguaagaaaauugaagcaaguggugaguaagggaguugacugugugggugagggaagagacaaaugcauggaagaaaaucuguagguaguuggauuuauuuuuuuaguguauguaggcuguagaauaugccuagauuguucuaugagugaauaugaaaauggaaaaagauauuguguggguuggagacaaucaauauggagaugaagaacagggaaaucuucuggauaagaaagcagcuguguaguacugcaguggguacagaggcuggcuucaaauuaccguuuuauuaaaaccaagucagaaugugagaguuauaaaacuuguaaaugcagcuagaagaucaggcauuaugcuggcaaacgaaagcucauauuggcacauaaaugaucgcagaaauugagaacagauacacgaaugucuucugaacucaugacccuagaguugcuucaguaaguauucuuugcuaguuccacgcuguauuugguaccaagaaaagaaugauacugaaaaaaugcaugaaaacaugccuugugaucuaaauauuagcuccagcucauuacuuuauccuaaaaaugaaguucaccaugaaaaauuucauaaauguugacagaaugcuuaguuaccugagacauagccauuauggugaaauggcugcauuuuucucuuucccauauguguaaaaccugccuaguagcauacacacacacacacacacacacacacacacacauuuauuuugucuucuuuuuaugugacucuuuguuuacuauuuaagaagaaaaugcuuaacuagccacaugguaguaauguugcucauaaucacaacuguuauagcuuugauaauucauuucaagaaucuaucaauaauaucuuuuuuguuguuguuuuuuugagacagacucucacucugacacccaggcuggagugcaguggcaugaucucagcuuacugaaacauccaucucccagguucaagagauucuccugcuucagccccccaaguagcugggacuacaggcgugugccaccacacccggguaauuuuuguauuuuuagcagagacagggcuucaucauguuggccaggcuggucucgaacuccugaccucaagagaucugccugccucagccucccaaagugcugggauuaaaggccugagccaccauguccagccuuauuuuuaaaaaaaaauuucaguucaauauuacugcauuuuaaagccccacacauaagcagaaaaacugucagcaccauuuuaccguuacuauuagcccagacauaaauguaguuuuacucuuagagacucaagaaauauccaaacucaaaauaaaacagaaaauguuaauugauuugaaaauuuuuaaacuuuucuguuuccuuuuguagccucuaaacuaugacuuuuuuugcugcuauaaagacacaugcacacguauguuuauugcagcacuauucacaauagcaaagacuuggaaccaacccaaauguccaacaaugauagacuggauuaagaaaauguggcacauauacaccauggaauacuaugcagccauaaaaaaugaugaguucauguccuugguagggacguggaugaaauuggaaaucaucauucucaguaaacuaucgcaagaacaaaaaaccaaacaccgcauauucucacucauaggugggaauugaacaaugagaacacauggauacaggaaggagaacaucacacucuggggacuguugugggguggggggaggggggagggauagcuuuaggagauauaccuaaugcuaaaugaugaguuaauggguacagcacaccagcauggcacauguauacauauguaacuaaccugcacauugugcacauguacccuaaaacuuaaaguauaauaauaauaaaauaaaauaaaauaaaauaaauuucaaaaaagucaaaaaaagaauucccuguguaagaacauucaaagugaaaggagcaucauagggaaaagacaaaccgugaaagcagagaaauaggagacgccacaucaagacaccaccaugcuuacaaguuggcauuuuauucugaagaccauaaugaacugccaaagaagcugaaaccuaaaauaaaauuauuguuuuuacauauaaagaugauuuuucacaucuauauuuaugaucucaccuuuuaaaucaguaucuacuuuugaaaauguacauguaaccuucaacauauacacagaaaauaagauaaacuaauuuauauaguuuuguuucaauccuacacaauuagaguugauuuuuacuccauauuuagauuuccagaaucccagcucauuaauuuaauauuuauuaagcauaaaagcuuuaagaccuagaaugcaugggacguggaauuaagcacuagggauaaaagaggaagaaaaaaauaggucauguccuggaggagcucacacuugaggcagccaaagauuaauuaccuuaggcauugauuaguaauaauaauaauaauuaguuagaaaguguuaucagaugucaaaaaagagagaaaaugugaguuuuauagucuuuguaaagaauaugaccuuugagcaaacucuagaauuaggaauggaguguuugaauuggaaauuaaggcaggauaauaccuuucagaugaaacaauguaauagaguacuaggauguauaauagaaugcuggccccaaacugggaugguagauuuaaguugugaguuucuuucuacaacugcagaguccauugaauaaauacaacuuuauauauuaaaauuaaaaaaauaaaaaaaaauaaaaaaagaaauucugucauuuggaauaacaggaaugaaucuagaggacauuaugcuaagugaaauaagccaggcacagaaagaucaauacugcaugaucucacgcauauguggaauccuaaccaguuaauucauugaaguagagaggacaauggugguuaucaggggcugcggugagaaggagauggagcugcaagggaaugaggagcugcugaucaaaggguacaaaguuucagcuaggcaguaagaguaaguuuugagauccaugcacaacagggugacaauggucaauaauaaugcguuauauaugucaacauaacuaagaaaguaaauuucaaauguaucaucacaaaaaaguuaagugauaugauggauauauuaauuggcccgauguaaccauuaugucuuguauacauacaucaaaacaucacauggugcugcauuaaaguaauacaauuaugauuugucaauugaaauacuauuauuuaaaaaauguauuauacacaucuccgagucacauauuaagcuaagguaugauggcuguguuuucagcaaucaguguuaccagcuacugccgugaccucauuucucuuaaucauuuaagagaaacgauuaagagaaauuguuaacaauuguuccaaguucugccuaauugauuugcauguauuauagccuaaucaugacagagauuucagaccagaaacuugcauaucuuggguuucauaguugaccuccagaacugauuguguuuaauaugugaggcaaacaagauaaagaagcaacacaauauauacaguuuugcuuuuaaauggaacuuaguuccuguaaggcccaauagcaggaaaucuuaguuaugucuucaguagcaguacuaguaaagcuuuagauucuucucuguuaaugaauggagaccuaaggcaauuaugaaaagaguaaugagauuugacuaagcaaagcagcucauuuccuaaagaaaguugaggagagcaauggcuuguagcagaaacagguguugugaaauaccaacugugauggcagaaaucuccccgaagcuggaacaggaauguuuaaaaaugagcuggcagguuaaauagaaaagaugaagacuuaccugacaccuuauuaucauuccugaaaaagaagggaaacauauucauagcucgguaucaaauaaugaaaucuuauuuccaagagugagauaauuagaaaaacuuuaagguaaguaaguguaaccauuaaauauaugaaaguuuaauauagagagagcaggauucaaacaggaacucaggaacauauucgcgauggcuggaccacuagcuuuaagcccagagguagggugaucacacaucacagaugcccaggacaaucuuggcuuaucccuacuguuucaaaguaaucacuaacagccuguuauucgauuuuaaggaaucucaauguagacaaugcauuuuauggucaccuugcccaggggaaguuuauagaacuugguauuuuauaaaauaucaccaagaguugaauuagagauaauauaaaguuggauuuuuuugcaguuugcucuugcugguccaaauacauuuuacauuuauuaaaauaaauacauuaaaauuuaucaacuaaauuaaaauuuauuugucacguauucuuuaggguacuuggcaaauaagugaaguauugucuuauaaauuuuguugacaaaauaaagagguuuuuucauggaaugcuaugcagccaugagaaagaaugagacuauguccuuuguagcaacaugaaugaagcuggaggccguuauccuaagcaaacuaacacaggaagagaaaaccaaauaccgcuuguucucacuuaugaaugagagcuaaacacugaguacauacagacacaaagaaggcaacaacagacacuggagccuaccugaggguggaggaugagaggaaggugaggacugaaaaacuaccuaucgggugcuaugcuuauuagcugaguggcgaaacaaucuguacgccacgcucgcaugacacgcaguuuaccuauauaacaaaccugcacauguaucccugaaucuaaaauaaaaguuaaaagaaaaagaaauacaaauggaaacauacuggaauuuagagcauuaauuuuuaauuucuaaggacuuuaucaagagacaguuuuguagaauauguaaaaucauaauugccccaaauucaugcaacggucuaugacgucuucuugauuccuauguauuuauuuauuuacauauguuuauugacacaauagauguaaguauuuuuggaguacauaugauauuucgauacauugauguaaggcauaauaaucaaaucagggcaauuggcauauccaucaccugaaacauuuuucuuaauacugggaacauuugaauuauucucuacuagcuauuuugaaauauguaauaaauuacuguuuacuauagucacccuacugauuuaucaaaugcuuaggucuuauuuauuuuaucugacuguauuuuuguacccauucaccaaccuuucuucauccaacccugggcuuuacccuuccccuucucugguaacaaccaaucuacuuucuaucuucauaagauccacuuacuuaaggccuaaauaugagugagaucaugugauauuugucuuucugugcuuggcuuauuucuuuuaacauaaugaccuccaguucuguccaugcagcugcaaacgucaggauuucacucauuuuuauggcugaauaguauuaacacuguguguguguauauauacauaucacauuuucuuuauccauuuauccauuggugggcaguuagguugauuccguauuuggcuauuuggaauagugcugcagucaacaugugagugcugcuaucucuuaaauauauagauuuccucccuuuuggauauauacccaauagugaaauugcuggaucauagaguuguuccauguuuaguuuuuuucaguccguacuguuuuucacaguggcugucagaauuugcauuaccaccaacaguguaugaguguuccuguuucucuacauucucaccagcacucacugucuuuuuuauaaaagccauuuuaacuuggggugacaugauauuucacuguagcuuuuauuugcauuucccugaugauuagugauguuaaccauuuuuauauaccuacuugccauuuguaugucuucuuuugagaaaugucuauucagauuuuuugcccauuucuuaaucagauuauuagauuuuucccauugaguuauuugaguucuuuauauauucugguuauuaauccuuugucaguugaaucauuugcagacauuuucccuuauucugugggcugucacuucaauuuguugauuguuuccuuugcugugccgaaguuuugagcuuaaugcaauuccauuuaucuauuuuugcuuuaguugccugugcuuuucagauuuuguccccccaaaaauuugcccaguccaguguccuggagcauuuacccaauguuuucuucuaggaguuucauagauucaguucuuagauuuaagucuuuaauccuuuauuauuugauuuuuauaugaugagagguaggagcauaauuuuauucuucugcacauggauauccauuuuucccagcaccauuuguugaagagacuguccuuuccuuaauguucuugauaccuuugucaagaaugaauuggcuguaaaagcauguauuuauuucuggguuuucuauuccauuccauugggauauuuucuguuuuuuuaccaguaccaugcugguuugguugcuauagcuuuguagcauauuuugaagucaguuagugugaugccuccagcuuuguucuuuuugcacgagauugcuuuggcuauucagaaucuuuuguguuuuaauauaaauuuuaggauaguuuuuuauauuccugugaagaaugucauugguauuuugauagagauugcauugaaacuguagauugcuucggguaguguugacauuuuaacaauauugauucuuccaauucaugagcaucgaauaucuuuccauuuuuuguguccacuucaauuucuuucaucagaguguuauaguuuucauuguagagaucuuucacuucuuuagucacaauuauuccuaggcauuuuuaauuuuuuaauaaauauuguaaauggcauugcuuucuugauuuauuuuucagauuguucacuguugguguauauaaaugcuauuaauuuuuguauguugguuuuguauccugcaauuuacugaguuugcuuaucauuucuaacaguuuuugguggagucuuuaggauuuucuaaguguaagaucaugucgucugcaaaugaggauaauuuuauuucuuccuucccaauuuggaugucguuuauuucuuucucuuaucugauugcucuggcuagaacuuccaguaguauguugaauaaaucugaugaaaaugggcguccugaucuuguuccagaucuuagcagaaaggcuuucaauuuuuccgccuuugguaugauguuagccauggguuugucaaauauggucuuuauuguuuugagguauaccccuuuuauacucaauuuuuuaguguuuugauaauaaagacauguugaauuuuaccaaaugcuuuuucugcaucuauugaaauaauaacaugguuuuuguuccugguuuauuuauguaauguaucauguuuauugauuuccauauguuaagccauccuuucauuucugggagguuaaauaauauguccagaugguaaguaagaaagccaggauuuuaacucaagucuaacuuccaagccuauguacguuuuaccauuugagaaacuucuguauuuuaauucuacauucauaaaccuauagacauauagagauccacauccauauguauaaacuguuuauaauauauguaguauaauuucuacauuaaaguuuucauuaagucugguuucuaucccuauguauauguuauguuucaugggauucgacuucaucuaaaucuauaaacuagugauauauuauauauuuuuaguacuaucuauauaucucuuuuaaaauuguucugcacauugaucuccaagaugugaaccaccugaggugccagaaaccagccuuucauaugauaauaauauuaauaaaguaaauauaagaauauauuucagaauaaauugaacuuucagaugaaaauuaauaccagcaugauuuuuaccagaauagcaaaaauguuugugagagucuucaguauaccaaaagaaaaccaugcaguuugaaugggggucuaaaagaaauguaacuuauuuugauccaucuuuugaucauauguuuacuucccaaaaagaagauaauguaauauuauagguuauaagauucuuauuuuuagugguaaauaacuuuuauugaacaauugcuguauguuauuuucucacuuaauacuuauaacaacccgauaaguuauguuccauuuuuacacuguauauuacagccaaggaaauugaagcugaguaaaguuaaauaaaguggcugagaugaaacagcuuguaucagaagcaagacuagacccauuucucccucacacugcuuucuaugcuuucaguuguaacuuguucaguguaugagauaaccuuccuucaacauguguguccaaaauguuugaauaaaauauuuaguuuuccuuuaguuacaaggagccuauucuuaaaagacaaguucucagugggacgcaugaguaagugguuaauuacgauugcuuauuuuaagacugaauucuaaaggcaugcacuggaacuucugaacauccucugugaguguggaaugaggagcucuaccuauucugucccucacaaauaguguuuacuguagccgccuccacagaaucgauauuuacuaucacuuuuguaucucagguuccacccaaccagcuugguuuuccccaugauagaaaccauaauaaguaugcauaacuacagcagcaccaagaguaaauuuugaaaauuaauuuuuaggaugaaaucucuuugguaaagaaaaucaccuggcaaaaguuguaaaaaauacugauuccaagccacauuugugauucguauuuuuaggcaaggcugagauucucagaauuggccagguuagaaaucaaucguuuaaaauuuuaguuuugcaauuaaacuccaaaagauauguuauagaguagaacacaaaauuacauggcuuuuuaaaaaaauagaccuugagucuucaaagaaauguuagucuucuagcuagcugcuuacugcccugcccaaggguagcaugccuguccucuucccuuaagacuauuuccccagaaauguccaaggagcaccagagguaauuagagccuccugucuuuccugcaaagaggcagguaugucuuuguuuucugggacggacaaccaucucaauuuuauuuauuuagugacucuuacauguucuuauuucuagagauugaauugggcugguguacuuugugguugagugugguuggagucgucaggggcauuggcacuuuuaaaaucccucacugacuuuacuuuucguguucacaucauuggggaguuuguaaauccauucuuucauugcuauaaagaaauaccugaaacuggcagggcacgguggcucaugccuguaaucccagcacuuugagaggucaagacgggcagaugacuugagacuaggaguucaagaccaaccugggcaauaugguggaaccccaucucuacugaaaauacaagaaauagcugggaaugguacugugcaccugugaucccagcuacuugggaggcugaggcacaagaaucguuggagccgggaggugagggagguugcagugagccgagaucaugccacugcauucuagccugggucacagagugaaacuccaucgaaggaaggaaggaaggaaggagagagagagagagagagagagagagagagagagagagaggaagagaggaagagaggaagaaagagaaagaaagaaagaaaaaaagagagaaagaaagaaaaaagaaaggaaagaaaaagagaaagagaaagaaaagaaagaaagagaaagaaagaaagaaaaagaaagaaagagaaaaagaaaaacugagacuggguaucuuauuucuuuuauuacauuuuuggguccuauauuuguaucauacagaaugaguucuguauauuuuucagauggaaaagaaauauugacuuaaaagguaccucucaaaucuuaauguguacaauaaacuggagaucguguuaauguagauuauuuuuucagaagaucuggaagaaagccucaguuucugaauuuuuaacaagcucaccaguaaugucaauguuuuuggccaaagaagaauauuuugucaaaaauucaguaaguggaagagccuguguuucuuuuucuaguuuuucuggcuuguaaacaaagaugagaguuuucauuuaccaaagacagauauaugcaaagaaaaccuaagaaagaagggcagcugccagauuaaaugugaugguuuaugcacaucagcugcauaaagauaccuaauaauuaagagaaaaauaauuaacucuguagugcgacagucugucagagagcucuuuaaccaagugaaucauaaacauuaacugcacuaggacaaauuuuuaugaugugcugaugcacacagaaggacgcagcaucacugcugugauauugcccccucaaaaguacauuauagucuaaauuuaaccauaaagagacaucaguuuuaugcgaagcucaagauacacguaucuuucauguucuguaauuuguaauguugauuuuaaguagucuuuagcacccuagggagcaagcaucuccuaauaauuuuuuucagaacuuucuggguaauaaaugccauccuguuaaauaaguauuuucuacuuuuuuuccugcuuuguauccauuuauucacuuguuugcuuuuuaaaaaauuuuuacuuuaaguugugggauacaugggcagaaugugcagguuugcuaccuagguauacaugugccauggugguuugcugcaccugucaacccaucaucuauguuuucagccccgcaugcauuagcuauuuguccuaaugcucucccucccccugccccucaccccgcgacagaccccaguauguguuguauguucucauuguucaacucccacuuaugagugagaacaugcgcuguuugguuuucugauccuguguuacguuugcugaaggugauggcuuccagcuucauccaugucccugcaaaggauaugaucucauuucuuuuuauggcugcauaguauuccaugguguauaugucccacauuuucuuaguccagucuauccuugauggguauuugggugguuccgugucuuugcuauuguaaauaguguugcaagaaacauacguguacauguaucuuuauaguagaaugaugucuauucuuuuggguguauacccaguaaugggauugcugugucaaauuuuauuucugguucuagauccuugaugaaucaucacauugucuuccacagugguugaacuaauuuacauuccuaccaacaguguaaaagcguuccuauuucuccacauccucgccagcauuuauuguuucuugacuuuuuaauaaucgccguucugacuggugugaaaugguacugcauugugguuuugguuugcauuucccuagugaucagugguguugagcuuuuuuucauguuuuuuggcugcauaaauaucuucuuuugagaagagucuguucauauccuuuguucacuuuuugaugggguuguuucuuuuuuucuugcaaauuuguuuacauuucuuauagguuguggauauuagaccuuugucagauggguagauugcaaaaauuuucuccuauucuauucuguagguugccuguucacucugaugauaguuucuuuugcugugcauaagcucuuuaguacuucuaguuuaauuagaucccauuugucuguuuuggcuuuucuugccauugcuuuuagcauuuucaucaugaaaucacuguccaugucuauguccugaauaguauugccuaaguuuucuucuaggguuuuuaugguuauggguuuaacauuuaagucuuuaauccaucucgauuuaauuuuugucuaagguauaagggguccaguuuuaguuuucugcacauggcuagcaaguuuucucagcaccauuuauuaaauagggaauccuuuccccacugcuuguuuuugucagguuugucaaagaucagaugguuguagaugcgugaugugauuucugaggucucuguucuguuccauuggucuauauggcuguuuugguaccagugccaugcuguuuugguuacucuagccuuguaguauaguuugaagucagguagcaugaugccuccagcuuuguucuuuuuccuaaggauugucuugguuauacaggcucuuuuuugguuccauaugaaauuuaggguaguuuuuuucuaauucugugaagaaugucaaugguaguuugaugggaauagcauugaaucuauaauuuauuuugggcaguauggccauuuucaugauauugauucuuccuauccaugaggauggaauguuuuuccauuuguuugugucgucucuuauuuccuugagcagugauuuguaguucuccuugaagagguccuucacguccuuuguaaguuguauuccuaaguauuuuauucucuuuguagcaauugugaaugggaguucauucaugauuuggcucucugcuuguguauuuuugguguauaggaauacuugugauuuuugcacauccauuuuguauccugagauuugcugaaguugcuuaucagguuaaggaguuuucgggcugagaugaugggguuuucuaacuauagaaucacgacaucuggaaacagaaaauuucacuuccucucuuccuauuuaaauacccuuuauuucuuucucuugacugauugcucuggccagaacauccaauacuauguugaauaggaguggugagagagggcauccuugucuugugccaguuuucaaaaagaaugcuuccagcuuuuucccauucaguaugauacuggcuguggguuugucacaaauagcacuuauuauuuugagauauguuccaucaauaccuaguuuauugaaagcuuuuaacaugaagaguuguugaauuuuaucaaaggccuuuucugcaucuauugagaaucauguggcuuuugucucugguucuguuuaugugaugaauuacguuuauugauuuguguaugcugaaccagccuuacacuucagggaugaagccgacuugauugugguggguaagcuuuuugaugugcuguuggauucgguuugccaguauuuuauugaggauuuuugcauugauguucaucagggauauuggccugaaguuuuauuuuuguuguuguugugucucugccagguuuucguaucgggaugaugcugaccucauaaaaugaguuaggaaggagucccuccuuuucaauucuuuuggaauaguuucagaaggaaugauaccagcuccucuuuguaccucugguagaauuuggcugugaaucugucugguccugggcuuuuuuugguugguaggcuauuaauuacuaccucaauuucagaacuuguuauugguuuauuuagggagccaacuucuugggagggugcguguguccaagaauuuauccauuucuucuagauuuucuaguuuauuuagguagacauguuuauaguauucugaugguauuuuguauuucuguggggucaguggugauauccccguuaucauuuuuuauugugucuauuugauucuucucucuuuucuucuuuaucaguuuagcuagcagucugucuaucuauuuuguuaauuuuuucaaaaauuagcuccugaauucauuaauuuuuugaauggcuucuugugucacugucuccuucaauucugcucugaucuuaguuauuucuugucuucugcuagcuuuuagauuuuuuugcucuugcuucucuaguucuuuucauugugauguuaggguauccauuugagauauuucuagcuuucugaugugggcauuuaguacuauaaauuuccuucuuaacacugcuuuaguucccagauauucugguacguugucucuuuguucucauugguuucaaagaacuucuugauuugugccuuaacuucauuauuuacucaggagucauucagcagcagguuguucaauuuccuuguaauuguguuguuuugagugaguuucuuaauccugaguucuaauuugauugcacuguggucugagagacuguuuguuaugaguucaguucuuuugcauuugcugagcaguguuuuacuuccaauuaugugguugauuuuagaauaagugccaugucgcacugagaagaauguauauucuguugauuugggguugagaguucuauagauguccauuagguccacuugauccagagcugaguucaaguccugaauauccuuguuaauuuucugucucguuaaucugucuaauauugacagugggguguuaaauucucccacuauuauuuugugggagucuaagucucuuuguggaucucuaagaacuuguuuuaugaaucugggugcuccuguauugggugcauauauauuuaggauaguuagcucuucuuguugaauugaucccuuuaccuuuaaguaaugccauucuuugucuuuuuuuaucuuuguuuguuuaaaguccguuuucucagaggcuaggauugcaaccccugauuuuuuuuuuucuuuccauuugcuugguaggucuuccuccaucccuuuauuuugagccuaugugugucuuugcacaugagaucgguccccugaauacagcauaccaauggaucuuaacucuuuauccaaguuggagacuggguauuuuauaaagaagaaagguuuaauuggcucaugguucuccaggcuguacaggaagcauggcaccaggcaccugcucagcuucugaugaggccucaggaagcuuacaaucauggcagaaggcagacggggagcaggcacaucacgugacaagaaugaacacgagagagagauaguggaggggaggugcccuacacuuguaaaugaccagauccccugugaacucagagcaggagcucauugaucaccuaggaguuggcucaagccauucaugaggguucugccccugugauccaaucaccucccaccaggccccaccuccagcgcugaggaguauacuucgaugagauuugcgcaaggacaaauauccaaacuauaucagggagucguuaguaugucuggccaccuugaaaggaugaaagcuuauuggaguggaaaaaaaauugccucucuccagccauacaacucagucaaaccacauucaauuaacauaaauauauuuugaccuccaaguauguaagaggugauuuauauucacaauuucuaauuuauaauacaguuucauaaauuugaucuucacaagaaagaugagcaaauugcuccuugccaaaguuaauuggcugaauuaccaacugaaguucuguuaugcuuggccccaaauucugguggccccuuuccauuaugucaacuggcucucuuuacauauagauucucacccuguaguuuccaguuccuaaggcaaaaggagaaaaguugcugcgugaggaucucuuggcccagauuuuaaaagucaaagacaguggacugccuuauaaccucaaacgguuucacauuucaguuuggagcugaucagugcauccucuguguccugaugcuuaacuuuucuuuucuuuucuuuuugagguggaaucucacucuguugcccaggcuguaguucaguggcaugauguuggcucagugcaaccucuacccgcuggguucaagugauucuccugccucagccucccaaguagcugggauuacaggcauacgcuaccaaaccuggcuaauuuuuguauuuuuaguagagauggguuuuacuguguuggccaggcuggucucgaauuccugaccuuaggugauccgcccgccucggccucccaaagugcugggauugcaggcgugagccacugcacccgaccaacuuuucugauauuauuuugaauauguucaugcccucucauugccuuauccuaacccaacugcagucuucuggcuucugucaggugcacugucccuuauccauacuggcaaaguaguugagggagucaacuuggggaacauauauuauuuuaaaaagcuauucagauauaacaagauaacuauuuaaaauauuccuuuaaaauaaaaucauguacugcauugucacuuaaauuucauagucacaauauuugaaaaaauacuuaauuuuaccauuuuuaugcaugauggcuacaauucuuuacaacuuugccuaccaacccuuucaggaaugggugaaaggagugggaaaaucauauuaaaauacucaguuuuacaacuuauuuccuagaaaaaaugugccagguuaacuuguuuauuaaaagaggugugaugucaauauuauuuccugcuucagaauauuuaucuuguuuugcaguuccacuaaaaguccaggcggagccauugaaaguuuuccaaaaucaauaaauaauuuaucucugcaaauaagacucuugcuuuccagggugggauuaguauuccaaagcauccagcauuagaauuagcuagaccaauucauaggaguuuauaauuaauccugaccagaggaagcuaaauaagagugaaaaugaagucagaugauugucugaagugaagcuggaaggcgguaacagccagacuaaguuuucuguaaguacaugcaaugaccaggaaaaccucucaaucuaggggucagcuuuuagcaagauaaugugucuugcuaaauuuuuauaucugccacaaaaggcaagacaagcaccacguaagguaucaaaggcuauauucauuauucucuugagugcaaaagagucugugucugugucuauguaugauuguguguggguguaauuuucuccauggguuuauuuagaauuguguuccucuauuuuugauguauuucuagaacauacuauauaaauaaaaaugaagccuuacagaugcaaucaaaaacaaaaugcucaaguuguauaguguuaucuguugcauguggauuuguugggcuacuuauuuauuuacaucacugacaauuucuuauggaaugccgacuucagaaauguauuguagcuuggacucugcaaaugucuuuuacaacaaaugggucaaauuucgauaccaagaaguaauccuuagccuguuugucuuuagcuuuuuaacaaaaaaagguaauaacaauguaaacaaaauugcuauguauaaauuccuaucauagguauauguuuugaaaaucuagcaaguaaauuuaguaauaauuuauuuugugaguaucuuuugaccuuuuuuguccuuucucaccuacuaggaacaguuuauaaucagcucaugcugcaucagucacaguauccauuuaggguagcacgaauccuugucuuuuacccuaaucuauaaaucucuaacaguguaguuuaaaaauugcuuuuguaugauaacaacugcuuguuaacaauccuuguaucucacuaaacagcuacacucaccagagaaaaggugaaaaggucucucucuuucucucucucuuucuuucugucacucucucucucucauaugcaaaugcaggcucugacauuuucacuuuccagaauguuaugcuauuuauuccaucccuagaacuaguacgugugcauccuuuaauaauagucacuccaagcaacacccuauugcaagguuuucccaguacccaccaucugccacccguagucauaguugauguuuccgcuuugaacuucaguuaacaucaggagcauauagauagcucuuaaagcauucaucacacucuccuguggucauuccuuuuuuauucucucucauacuaagcaguaaagucccugaguccauuuuauuccuuuuauucaucuccauuccuagcaugcuguguggcauagaguaggcuugucaaaaauaauuauuaugaauuaauaaacagacauucaaauacaauuaagugccccccuacgaauacaggaaaauuuuucugaaaagaggcuaagucaucauaagcauagucauauucauuaaugacagugauuacagaaggccaacacuaagugcagugccagaagccaugaugguaguuccauaucuguagagaaagacgauauugugaauaacgaagagaggaaucuuaacaugaagucuuaagcuauugccuuugucguuggugagucuuguggugagaggagaacuaugcacagugaagcauauguugaauuauggggcacaugcuuuugcuuaaguauaucccuuuucuuuuauaugaaagcguuaugagguccuucugggaauuguuuuuuaaacagcuggaaaguuucucauuuuucagaugaggaaacugaagcucaaauguuucaagugaaucucccaagguaauuaaguugguuaaucaccgaacugagaugaucaucuuuguguugugauauacagcucagugcucugcaccgcuaggaguggugaauaacuuaaaaccacaggacucugagguccugagguauuguuuguggccauuaucaacaauuuuaguaacaaguucagaacacauuuucuuagaucucaaacuccuacaaaauguuauuuguaaauagaauguuuuguuaagaauuaaaaacaaacaagcaaacauaugcuaggaggauaauugaaggcuuuuaaaaaaacaauuagcugcucccagggauucuaguacucauuuugauacauggaagcuacuaaagccagaaauuuaaaacauugaaaaucagugccaauuuguggauuauuacacuuaaaagugcauaaaacaacaggauccacuuauuaaagaguuucuguaguuuacaaauaaauaauucaccauagauuuaaauaaugguagaaagacacauucauucauucauucauuuauucagaaaauaauuauuaaacaucuacuauauauuagguuucuccagagagaauauagaauagaauauauuauauauauguauguguauauacauauauguauguuggcuuagcucaaaagauaugucuauagauacagauacagauauaaagagauuuacuuuaaggaauuggcucauguaauuuuguaggcuguuaagaccaaaaucuucagggcagccuggaaauuucagcagaagcugauguggcaggccaaaggcucugccaaagaugugguaggccagugaccucucccugcagagaagucaaaaucuuuccuauuaauaagaugagucccacucacauuauggagggugacaugcuuuacucaaagucuaucaauuuaaguguuaaucacaacuguaaaauaccuucacagcaacaucuagacugguguucaaccaaacagccaggcaccauacuuuagucaaguugauacauaaauuuaacuaucauagacgcugugucagggacuucauggaauuggaaauuacacuaaggaacaguugaguuuggaagacauccaaugaacagaugaccacacaaacaugaauugccuuugucucaagugccagaaacaaaaagugaggguaccuugagaaguuauagcagggaaaccuggcccaguggaaggcacuuggaguggcucccccgagaaaaugauaguuaagcuggggccugaaggcuacaaaaaugggguuaaccaaagaaaacaggagagacuuccaaguggaggagaagacccugcauuaggcaggagcugggagaaggccaacguggucagacacugggauacuugggggaaaggggguacaaagggguguuugaagugugggaggagccagauccuucaguaucuugcagaccauguuacagguuugccacuguuaagguaggacagugauuaugaagggucucuccauaugcuuugugccaaauguaucagaaaggcuaagagugggaggcaggguggccagugaggaggccagauaagaguguguguagagagggagauggagagaauggaauuagcucaaaagauauuuugagaauauguuggagaacgugacgauuacuuaugaggguugagggagaaguagguaucaagcaugauucuaagacuucaaguuugcuccacgguuuggaagcugguccuguuuguuaugacagggaacucugguuuaggauuucaaauugaauaagggaccuauugagcuggagguacuugugguguagccaaguggagaaaucuaauaagcaguuggacauguagcucuaagacucuacaacgauguaaaggaugacagagaauugagaaaucaugaaaguggaugagauugccugggagaguuaucaugaaaagagaaaggucaaagacagagcucagagcagcucaugacuaaaggucagcucacgacuagaggagauggaaaagcagaauggccuaagaaauauggacaaaccagcaccuucaaagccagcagaguugcaucugugucuuccucccauacucacaucucucuccaaccacagccaugaucacuguuagugauucauggaguuagguuggguccaccuggauaauucaggaucaucucccaaauuuaaugucuuuagccuuaaucacaccuauaacuuuaguucccuuuugcuaugcaacauuaucuacucacagguuccauauguuagaauggggacaucuuuaggggaccaguauuuucucuaccacaaaaacaacaauucagagcacugcugagaggucacagaagauaaaacuaaaauuuuucugauuggguauaucauauggaagugaacaaaaguaauuucauugucuuggagucacagaaaugggcuaaaaaguuaaaagagggagauuacaaguagauacuuuauucaagaaauaugugaguaagaaaugcuggucuugaaacccguuuaaacaugaguggauauuuauuaccacugaaagaaucauugucuauguccaggauuuuccugguggggcaagaauuccauccaccccacccccaacuccagagagucacuuguucucuauccaaaguaccugagggaaaaugacuacggaaauaauuaagguuaaugaauaaaaauaaacucuggaagauucuuguuaacugaaaaaaaugaaacaaagauuaacaaauauauauucugaaacucuugacauucauuucaauuuuuaaaaacaguaauuaccuugugguuuuagauacauguguuccagggcaauuaaucuucuaauaaauguguuucuaauaaacauuugcuaauaacuugauguugguaaaaauguuucaagccugcugccucugaagccaaagacuucaaaauaauaucuagugagaguugugcuuaaaaugaguaucagcacuaauaugaaagaaaaagcaaauauaauaggaagaaaaaaggaaaaaauacucuaauauuuauaaauuaauuuaaaaaaucauaaucauuaacaguugagugauuaacuuauuuuuggcaccauucugaguguugcacauuaucuaauuuaaucauuaaaaugccccuacaaagaaugcaauaacuauccucauuuuggaagugggauaacugaggcuauacacacagggcuggaguuucaaucuaggaaaucuacaacuuucaaacugucaauaacaguagguaacaucuagcauugauugucuaucaaguaccuguuuuauacaauuuacagauguaaauacuuacgucucaccccaggcuuaugagguagacguuuucacaccauuauggauuggaaaacuaaagcaugcuuaagucacacauguaauaaguaggucagaacucacagccaagaagauuggcuccaaaguccaauuucuucuccaaauaucugaaaugugauuuuuuuggaaacuuuuucauguagacagaguguuaucuuagacauuucugcuauuguauuuuuaaaaguauuuggaauuaaaaauauauguaauuuugaugggcuaguagacccuucccucucugaacuucaccuugccuucaagaguaaaugaagaacuaggugauccauauaguaucucuuagcugcauaguucuaugaacaugcuaaaguuucuucuccucuuuuaacaagucuuuauuguucuguuuuuacaugcugggauuuaugcuacauuguauuauuguaaugauuaauaaucauuuagaucaagcauuauuugaguacaguacuugcaacacauuaggugcuaugcaaagugcauuacuugguuuacuuuacuuaacccucacaugagcuuugcuuuuaauuaugauuacucucucuaccuuacagaugaggaagcugagcuuagaggcccuuagagccuuauuuaagucacacaaccaguaaauggcagagcugggaucaaacccagaaagccucacucugaaacucagaagcccagucuccuuaccaucuuacuguuauauuguagguaccaaaucauugaugacaagcaucguugaugagguucauaguauuuguaccacacauucugaaacagagucagaucagacugaagcaaagaugaaucauuuggccuacauguaagaaugagaaauggggagauauacacgaugugucugucuaaaauaauaucuuucugacccacccaauugugguaauuuccacaauuagagccuuucccuuggguuuuacagaugggguccaaaggaccagcuuaaaauaugacuagagggagcaaugauuuaaccacuuauuuccugagaccagcagacagaugagcucaucugcugcugacaaagggcagaacccuaaaggaauagcuuaggguguuugaaucaugggugaaguuucuggagcuuuguuuauggcugagaagugggcaaaguaucaccagccaugggguguguguguguguguguguguguguaaaacuauguacguguguguaugcgugguggcagcaaauagcuaagggauugcacaauuaggugucagacuuuagagaaagcauauuauaaaagggauggaagcagcaacugaacauaagaagguauuaaagaaaaagagucaucugguaagucuaccucaauuuggucagaaacucacgugacugaggcugucuuaggguuguucuccauuuaagaaauuccuagaaacauugauguagugggaaauuaguguaacacaauuauggauuuagaaggcuucugaaaucaucaagcccagacuuuggcgucugcucaaucugugugggauaccucagauagcagcuauuugggguccauuuuuaaggucaacccagaaugagagucuacagucagcaguccuauguuaucuauacuugcugucaggaaagccauuacauaucuaaauccuuuauaucaaguugauauccaaccuauucuuaagaaggauaaaaauggguuaugucauuauccaccuaaaggauucuuauauuccuagagcuaucacuaaaucaccucauaaucucucuuuccuaugggauaccuugaguuccuuccauuucuccuuauuugucugguuauuucuaaacuagacaccuuccaacacucagaaggacaaguaucauugaugaguuucguaguauucguacugcaaagaaaaugauuuucaucaugcaacauugcuuagaaguggggaaguaaaaugugugcccacagugagacaagaauuuugugaaucacaaugacuccucagacaaguuaacguucuuugcaaaucuguagaaaaauuccuuccuuugcuuaucugggucucagucuguaauggcaaaaaccguaauggugauaguauucuuauaaagagcuauuguggggaugaaucagauaucauuugagaauguuuaauauguaauuaauguuaugaauaucauuuauggauuaugaaucuuaaaacuauauucagauacacauacacaauuuugcaaauaacaucauauauauauauauauauauauauagagagagagagagagagagagagagagagaaagucucucaaggucucauauauauauuaccaauuaccacaguugggugggccagaaagauaugauuuuagacagacacgucacguauaucuccucauuucucauucuuauauguaagccaaaugauccaucuucgcuucagucuuaacugacucuauauuucaaagugugugguacaaauauuauuaaccucaucaacaaugcuugucaucagugauuugguaucuacaacauaagagcaagaaggucucucaaggucucucuuucucucucucucccucucuaaauauauauauauauauauauauauauauauauauucucuuugcuguacucuuagauagauagauagauagauagauagauagauagauagauagaaagagcaaaggucucucaaggucuugcucuguugcccaggcuagaaugcaguggcaugaucauaguucacugcaaccucgaaccccugggcucaagggauucuccugccuaugccucccaaagugcaacgauuacaggcaugagcaaccucacuuggccagauacauagauauuaaugaaggguaauuacauuauucauuguaaucaacauuuaugauuguugaaauugucuaacacuuucauguguuguucacaggaauguaaccuggaauaguuuagcuauuccagacacacacugcucaccagagcuagaagaaggcuaccagugcccaccuggauuuaaaugcauggaccuugaagaucugggacuuagcaggcaagagcugggcuacaguggcuuuaaugagauaggucugucuuacugguaaaauacguuuuaaguuucuauuuugugauguuuaugaaguggacagaauaauuaaauaauugauacuaauauuuugacuggcuguaguauagaagaaauacaaauauaaauuuuaauucuaugccuauuuuauaauauauucuacccgacagugcguagcauacaagcuguguauguauaugggcagcaguguuuguauggaguuacagaucucucauuuuugacuauuucgauucucaauaacagcauuuaagcauuuaaaaauauuuguuuguugaacaggguucuggguuguugacucaaagauaaacaaaauuugguuuccuuucauauguaacuauguaacuauacccuaauaggcaagguaagucuuaaaaacuguaauacuagguauugaugagugcauuagagcugaaaagugcuccuugauuagaauacaauuaaugaacuacuuagugaauaugcaucaacuaaguaauaaauguaugggaaaugcuugugcaugagaacuaugugcucaaauguguacauucuucuuggcuugccuuauuaaguccuaaaaugugccauuacauacauaaugaaagaauuuagcaucugccauuuaguugauaucauuguauuuuuauaauuccaugcaaguugcgcauauuauauuauuaaagcaaaaaauguauaauuccaaacaaguauuuuaugccuugagaauuguuaucagaguaauuuuuuaaacuaaaauuucuucaagugucaggccugcgugcuaaaccauaaaguuacagcuuuuauauagaauauaguacugaacgugggcugaugguaucuuuuuaaagucaguuuugcaaauaacaucucagguuuucaucuuuauguuuuaguauuuccucauauuuuauuucaagcauuauaguuagauggcauucuuccaucucuuuugaccaguaauauugucuccuauuucacaaaaauccagaagccaacugaugugaagcaauuucaauuuucuauacucucuuaaacuuauccaacuuuguaauuagucuuaaauccuucccucugucucaaaaguacagaggcaucaugaauuauaccaauaacuuuuaggcaugaggaagaaaucacagaugugguaugggaggcgagauguauauaggcugauaggcugugcggaauaagcuucaggaguuccaacagcugggcaugacuagaaugcaugccuuaucagagucugcagcucuuucuuuuagggucugaguguauccaugucuucuauggagaguggucaccauuccaggguuaagguugcccuuacagaaaauaaccuccaauuuuuuaaaaucauguagcuaaagcaccucauacccucaccguuuuuaaugcaacaauuguacccaaauucaaaaugcagcauuauauucaaguugauucaucuuucuucacucugacuuacaauggcuuugcuuaauauaggguagaaucucuuuuugagagaaaaagucuccuuguacugugcugacuugagaggaccaguucuaggaggaaauugccuuggaggcagucgcccccuacuaaagcaauuaucuuacuauagcuguacuguuaauuuaucucccaaggauuuaagcuccuugaaaacaggaagugcaucuuuucgucuucaagucuccagggcacagggcuaugccuggcucacagggagcccuccauaaauauuuacuaauaggcucaacaaagcguaugucuuuuuaauucauugguaaccaggcauguuuguaugaggaggcagagccacaauagagaauuuaguuguuuucuuguuguucuuuugccugauuuugucuguuuuuguuggcaauauucauuauuccucaugacuccuuccuuucuauacaggcuuaauuucauccguuugcuuauuuuucccaaauucaucaucacuguaugacuaauuguuagauaaugaaauguugaucuuguaccauaaccaaaacauuuuuaaauggucguuauaauuuagauugaaauugauagcugcuuccugauauuauguaucucuguagauacacaaacuacuauauuuaaaaguucuuauggaaacaaaagacaauuuuuugcccaaaaugaggaaaauaaaauauuuuauuagacacaugugaucaucucuucaugcaugcauuugaauuuaaaacauaauuaggugccuaauuaugcauaugaauuuggcuaauauacuugaauauguaaguaauuaugguuaguuaaaaaggagcccauuuccuuuucuuacuaaucaaauuaccauucaaaacaugaauuucaauucacuuauaaaauuucuggcagaaguagcuuuaugucucauuaagauuuaacacugaugauguugaaaaauucaaauuuuaaaauauauuaaaagccagagucauggaguagaaaaaauuacaaggaaccccuguuguaagauugaagaguaaagacaucuuugccucuuuguguccccaaaaucauccaaauaucaagaagauugagaaacagaaaugaaauuuucauguuuaagaacucugaaaagcuguaacuauaaaccacaucacaggacugggcaucuaacagaaaacuuccugagaagauucugccuacuguggaucucagacagcaccagcaggauagcaauauucuaagauaaugcauguuccuggaggaacacaacugucucauauuugagucagggaaucagagcaaaggcugauuguggaggcuuacuaggaccccaugcagcaucacaaggcagaggcccucauuucugcaggcaguugguggggagauagaguggaggggacacaacugcuuuguugcugcugaucuggguuggcuagaaugggauaaaagcuaaacggaagguuuucauggccacuauaacuuaggaugaccuggggaaccuuuuaaaacaaacagauucucaagcaccauccucaugucaauuaaaucacaaccuuagagugauccaaggaauagauggcuuuuaaaggcucuccaggugauuaauuuaugugcaugcagaguuaugaaccauuggacuaaagaaauacacacauagacacacacacaccuguauuauaaaaaccuucaauuccaucuugauccauuuugguuguuguaacaaaaugucacagaaucagugucucauaaccaagagaaauuuauuucucacaguucuagagucugggaaguccaagagcaagacagcagcagauuucaugccuggugaaggcucacuuccugguucauagaauggcaccuuuucacuguguccucacguaguagaagcaguaaggguucucucuugaaccuccuucauaagguuacuaauaccauuaaugugggcuccaccuucaugaucuaaucacacccaaagguccuaccuucugguagcaucacccccauggggguuagaaauucaacaaaugaauuugggggaaacaucagcauucuguccauugcacuauccuagaacauuacccuguuccuccccaaagugaaacagugacagacaucuggucuaacaaaaauuuauuucaaagaugagucauaauugaaagaaugaggaccacaucuauaaaaauguacuuugagguacuuuuaaaacugaaaaaaaaucaugauauauaacucauaaaagcuuaguaggaaacagagcacugaauuacagauucgaaggaugcagcuuuucucaguaagugaacauagaacagucaacacugagacacaucuuaguaaaauuguuggaaaucaaagcuaaagaaaacauucauuaggcauccagaaaaaauaaggucaaguuagcuauaaggagguacaucagagaggccugaaacuucaugucaauauggaacucuagaauguaauggcacaaugcuuacaaauucuuuagggaaagaaugggucaagcucuuucugaauauuuuugaagaggcaggaacauagagacuauauuuugcaugaaaucuucuugaaaacauucagucaaucaagaauuucuuaucaugagcuagucucuaguaucuauuuguuuuaagaacaaagcuaauguaacuguaggauuuacaaaauacaauguaaauauuauaaauuaugaauaucuagaagagauaagaugaaaaccgggggagauagugugauuauguugauauucuuaacauucacauuuuagcaguuaaaaaaguaacauuuauacaauauaugaaauguauaauagagauaugugcauacuugucaugagaugagaaugcaugauaaacucagaaauuacuuucuuuagaaauaacucaaaaauccaaauaauauuaucuaugaccacgucccaaaaaaucauuucaauaugaguaauaauauuggaaucaauucuuucuaaaucuugauaauaguucucaaaagaaaaguaacaaacaguauauuuuuuaaccucugaauagaguuaugcuauuugcuguagcauguuuaaaauuauuaggggcacaugacuccuuugugguaaaguuugcuugaagcacaguuguucaaaagaauggcccugggguuuagaucaugacuccacuuuauauuagugugacagccuuaggaaaguaauuaacucucuugccucaauuuccccaucuaggaaaugggguaagugauagaccuaccuuauacaguuaauguaaagagcaacugagaaacuacacuuagaguacguguagcguagaacaaacgcagaaugaacuagaaauugggaugcacgggcaaaauaugaauguaucucuguguuauuugagggaaaaugguguaauaauaagggagggcaggacauagauauuuucacacucacacacugcaucugauaugauucccuuuguuuacagacauuaacuaugcagguuuuccaguaucuuauucaagggagaggcauuggggcaggggcacgguguuuuuuguuuguuuguuuguuugagauggagucucggucugucgcccaagcuggagugcaguggcacaauuuuggcucacugcaaacuuugccuccuggguucaagcaauucuccugccucugccucccaguuagcugggacuacaggcgcccaucaccaugccuggcuaauuuuuuuguauuuuuaguagagacggaguuucaccguguuagccaggagggucucgaucuccugaccucgugauccacccgccucggccuccaaaagugcugggauuacaggcgugagccacuguacccgccggggcacgguguucuuaaccuugcaucuugccuauguuaacucauaucucccauuucauuuuauuccaaucaaugacuagcauucuagaaggcaaguuuuuggugauguuuggucuuuauucaucaauuauuccccuccccucucacaaauguccugacuucugugcuuguaccaaucucucuagaaucugaucaacauuuagcccgugucauugaauuuucuaguuugaugaagcaucaugcauauguuuaauuuuauuuauuuauccauauacauucgaaucugugaccccuggauuggagccucucccuuucagcgccuuucaacaggugcuccuuccacagagccuaaguaaagcaccagcuggggcauugagcagaaggcacagccaugcugugaugugcaggggcuccagcacuaagugauuuauuuuccgaccuccucuaauucccugagccacgugacaacugagauacuaguuauuucugucucuuucuuccauuuaugcaccuuuccaucuuuauuucuggauagcuuuccuguggcuccuuccuaaggacccccaacugacucaucccugcuaagacauuagcccgugcacucaagauaucacacacuccccauguugcaagcuuccugaguaguagacauaaucuaaaggacaucuugcaaaaucgcaaaauuuauuuagcagacauugagauuccgugauugcaguauggguggcaagguggguaggaaucauacagugguaagguuuggggauugacaacauccuaaaagccacacugucgaagugacacaaaaucacagcaacuuacccuauuuagaaaaugugucuucccuuuucugaauacuuaccccacuuucaguuccuacuuccgcuguucccacuugcucauaaacauaugagacauaaaagcugagacauaaaagaggcgacacugugauuuucuguaauaacacuggaaaugaaauuacagaaguuuagagcuggaacagauaaugcagucauacauuuuacccacacagguggggaucugagagucagagugagugggauuagaauuacagagaacuccgggcagaggcaggcugaacucacuucuccagauuugcagauguccaccauacuugcuguuuccaccaaaccgucuuacaacucaaaauaguguuuaagaagaaaauucaaaaacaauuugcaaagcuuaguuuuauuccuaauuuucuaguggaauguuagcauuauuucccuuuagugaaaugcugauggggaagaccguuauccaaacagaggugaugugccaguuagaaagaaagcaacacaaaauauaccauauaugcgaaauaaaucacagcaaaaaaacaccaucgaacuggugauuccuugucaugaccuuuuaaaagaaaguaaaacauuugguacaagagaugagaacaaaacuauucaggugguuauuugaacccuucauucauuguacagucagguaaaaaauaaaaaauguucaguuuggacuaaacaacuuaaugaaugucauuggaugauaaaacucauccugaaaagucacuuaggaaguaaaucgcuaucaugcauuuuuuauuagucuuuagaaucaucagaauaaaugacaaaagcccauuuucaaaaaaauccagaauaaaugaaauucaacugaaacagcuuauagcagaggaagcccacaagcaagauaaacuaugaaucaagacauucugaaaauaacuaauagaaaagacauacaacauaugcccuuaacacuacacgagcuguauaugguggaucacuuugccuguucuauauauucaaaagucgaagguaaagccaggaaauaauaaacacuguauucuuauggugacuaauuguccaucagacagucguuacuuuuguaauuacugucauuacuuaggacaacuguugguaucauuuaucgauugcauauuaugugccuggcaccagugaaaagguuuugcauccauuguguuuuuaauccucaaaaucagcccaugggguaucauuaucccucagcugaugaguggggagaaugagauaagcaagaaugaacucucccagagccucuuaccagccgcauuuggaagccaugucuugcugccccgugugcugaggcugaagccugugcucuugaucuacaaacuacuacguuaccagaguagccagccaugaguaaccuucauuccuguggcuugucaggacaccugguccauuauaaagucucauuaugaugauggaagaaacacaucuuccaaaagagugaccugccauaguggcauauccugcaacauggugaccucccucuuguccugaagucuuuagacaagucuuagaaaaaagaauaaaugugggcugggcgugguggcucaagccuguaauccaagcacuuugggaggcugaggcaggcagaucaccugaggucaggaauucaagaccagccugggcaacauagugaaauccugucucuacagaaauacaaaaauuagcugggcaugauggcgggugccaguaaucccagcuacucgggaggcugaggcaggagaaucgcuugaaucugggaggcagagguuacaguaagccgagauugagccacugaacuccagccugggcaacagagcaagacucugucucaaaaaauaaauaaauaaauaaauaaauaaauaaauaaauaaauaaauaauaaagaguaaaugugaaggaaugugacguccacugcaaacugauggccccuuaagggguuggucucuggcuuuaagucuagucccuuguauucuguauucugugagacagagaguuggugcauaauauauguuaguugaaugaaagaauauaaauauuaaacaauguaccugggaggcaaugcaguuuuauaagcuacugagcuguaaacaucugggcaaggauuagagauaaugccagaaaaaauuaguaaauacuacuuuugauguaaaauuaggugguagacacaucauggcuagagaugugggagagaacuuagcaagcaaaagaaaauaugcuauuugguauauuuuaguaaguuuuguguguauuugaacuaaauucaaaaugccgugauaaggcauguguuugcuauauguaauguauagcuacaugcauuaauuucuguuguguauuugaauuuacuuucuuugagauaugaauauuuaaauuugcuuucuaaauuaucacaaauuaaccaacaaauuuauacaaggugauuuuggaaauccacauuaauuaauuucuuuauuagaaugugacauaaacaguauuuaccuuauuaguuuucuuuacgaaaaaauuauaaagcuuuucuauauauauccuccuuaaaauauuagauaagaaaacuacaagucgucagcuccacaggaguuaacauguggauuuuggaugcuaagaacaaauuuaagaugaugacuuguaaucuucaugaauugcuuuuggcaacaauaaauuaauugggccuuucaagaaaaugcagaaaacuaagguaaagggugauugagucuuccagauuuccuauauucccaacucacuucugaagaacguaauuaugaguauugaaauuugggacugguauuuuuuacaagaagaaauauacuguagcuguuauuuacuuuugugguauuuuucuucuuugaauuuggguaguauugacuauaagcuauggacucagcucccugugugggucauaaaucaguuuuauuaaauauugauuuagaaauaucaguuauuauuuucaucacugguggaguucugugcuucggacuaccccuguaucuugcugaaauaggauugacaauggauccacuuacacggguccaguguuuuaguuuuaacacaggauuugcuugacuuugaaauaacuuucuauaucuuuuucuauuaguauucuauuauuuuuauaauuugccucuuauuacaucugauguuaaauauggacauaaaauaugaugaaagaaaauuacuuuuauucaaauuauaaugggauguaaauugaauuuuguugaugcugcugcuaaaaauugauucaucagaguuaaaugauauuaaagcauauuucaugcuaccauaugugauaucagaugagaacuuuacaaauaaauagaaaacagaaaguuauauaucuacaaccaugauuuauuacagaacguauauuuuuacugcagucauaaaagaaaaagcccaguaaagacuaauuuguaaaauauguaauugagauuuauaaugcuuucaaaaaaaaaaaagcaccaagggguuuuucugaugcauuuaucuugauguuuacuguugccauaggaauuacuuauugauuuuuaugaaaacacauauggaagagagaacuaaggcaauagaauucaacuaaaagggcuucaucuaugauaauucuguuugcucugauaaaaauuccuuuaucauggaacaaggaaaaccugacauauuuuuguugagucgaggacaagaucaagaaacauccuaugaggaauauuugugaaaacucuuagccaaaugcaaggaguuuuauccuuguaucuugaaucauaagugccccuagguuacaugaaaugugugcuugaggauuuuuaaagggacugucuuuagguuucucagguucucaaauagggccacagacuuacuuaaacugaaauuagguguccagauauucuucagaauguuaggaagaaaggaguuuaaaggcagaaauugcaggcaugacuuuuuaaaaauaagguuguccauugucugcugaaagauguuuaggaguucuuguugaauggaugagaaaagauagugacuagaggaguuuuucaucagacagugaaaggaaauuuuaaaaguaaauuuuggagagcauaaagugaugauuuauuucauguuauauguagaagacaguguucauuggaaauaucuaguggauuccaagaaauuagcauuuuuaugguuguauuuuaaacauuuauaaguuaaaaaaguaauacuucaaauaauguaagagauuuaaugauuuaagaaaguaauaaauucugccauauauaauucccucccuccuucccucucuuccuuucuuuucucauuucuucuccccucucuguaaguuucaugguauguuauaacauguuuuucauucuucccuuacugauagacauuuaagugguuuucagucuuucccugcaauaaguaaugcuguguugaauacaggcauauauacauucugugcucaugugugauuaugcuuuagaacagauuccuagaaacaauuucugggugaaaugauaugcacauuuuuaauaugagauagcuggcgguuuacuuuuuuaaaagauaaggauucauaguacugccuuuauugcgugagugaauuuuuauaaauacaagguauucuuuuucaauaugcauaaauauugaagaaaaaaaauaauguaggcauuucguauuccguacucuguacucuucugaacacuggcaguccauucucuucuugaauguauguauucaucccauucuuccuggaaugccucucuccauucucuucuugaauguauguguucaucccauucuuccuggauugccucucuccuaccgcucccccuacccccaucuccugugacucaccugucaggaccuacucagguaaguuuccccuaaucugccagcagcacucaucucccuucugucugaacugugauagcaagguuugugcaucaaaguggacacuucguuacuucguucuacaugugucccaccgucugggagugugugugugugugugcacacgugcgugccuguguguguuuuacccuuauguucuggauucguucauuagacccaguugucucaggugggagcagagccucaggcacuucuuuugaugucuuuucucgcucucauugaacucgguauauacuugaggacuggcugaucacauuuaugagaauuuuauauuugauagauugccuuuugaaaaucaucauucugcagaaauuuaguaauugaaaauuuaaaucaaauucaaauacaacucuaggcucuaauuucacuguucguuugaauguaugacuucucuguuaagccagauacucacgugaaacaaaugugaauagaauagcauggaaaucguguauggacagucaaggaaacuuucucugcuggcgacagcagccugcagaacauaauucccuggacacucuaugaaaucaaauccguuuuaucaacuaaucaguuggagcaaaaaauaauaauaguguuauuuaggaaagccguaacacagcucuuaccucaaggcuaaugaagaccugacccuugaacucuaggggcuuccauguuccagcuugugagcccugcuuugccaaaacccugcugaagagguaagagccuccuucucuggagagaaagcccccagccuuugacaaagugcuucuagccugagccaugugggcuaugaaaaagaaguuggucaucccgaggagucacuggacaguggagagagcccauccauuuuucuccuuuauucuucccuaccccucagcucucacucccuuaggacuugggauucuggaaucauaaaagcaaaauauucuaaauauacuaaaacaugcuaaauaacuuaaauaugcuaaauaaaauuaaaacuaaaauaaacguauuagaauaaaucaugaauggcuaauaaauauaagcugccaccauuaaaacaaaaauaacaaccacuaccacaauugcuacuauaaagauuauuauugaucagcuuuauuuuuagguaaguagaaaagugagauguauuucuauuuuucugagaauguaaccauucugaaagaauaggagauacuuucucacaguaagcagaagaaugagauguacucauaaauaauauauucaacaaacaguuauuuugcacuuacucuauauagguacugaaaauagaaugauguuaauaaauaugaacagcccucaaacagagauauuaaaauaaaacaagaaaugaaggugaaauaaauuuagaagaaacgauggaucauuaacuuguaguaguucuuacagccaugugcuggaugcaggcaucccugucugagugugugcguguguacagacauuguuuccaaacuuuuuuacuauaacuuuguuaaagugaagcgugagcacuccacauuugcugcaagucucacuuccccuauuuccuuuauuucucacauuuacguaacuugucuaaccucugaaacaaauguuuuuauuaguucugguaaugcaaaauaaucuuuagagaauuacguuuuuauuuuugcuuuuguuaaauaagaucuacaguagcauaaguuaagugugccaccuucauuuuguagcuggcuaaauauuucugcuuccuguguacuuuucugaaaauggcuuuaauuugucuuauuuuugauaauuagcuucaauuagugcagaauucuccuuugguauugauuggacauaaaaccugagauauguucguuguauucuggaaucuauuacugccaauaacaagccuaccgugagucgaauuuuaaggcuuuccuuuuuuuuuuuuuuuuuuuuuuuggcuuugugaauuuggguuuuuuuuaacaucguuuuucucugguaguuuuuaagauuuacccuuugucuuugcugucuuauggucuuaguauccugugccuaggcauggauuuuuauuuuuuaucuacugugaacucauucucugcauaugagacucaugccuuucuucaauucuggaagguuuuuagguauuaucuucucaaaacagcucucuucuccauucucucuauucuuuguuuucuggaauacugauuaauauuuguuuuuaucauauuuuuuauucuauccuccaugucuuuaaaucgugcuuucuaacuucccucuauuuucuugacuucucuuguuaccacacaaugggcggguucaguugcuuggcaggugggaguccaaugaccacaaccaaggaggauuuaaccaagggauuucauuacuggcaacaaguaaguagaacacuggggauaguucccaaagcagugccuccccagacacagguggaaacagggcuuugugggggcugcuuagcugagucacugugugcagagguggagugcaggcaggcacagcuguuguucaugcuucuucauauguugcccauacagaaaauggcacauaagcucuucccugggcagggcauuuaguaugguaaggugaagaggucuccaaaguucaucuccagcucaggcauccccggaugccugggaccaguuuuuuguguuuguucuuuguuuugcaggggcucggcuucuuccuagaacacuuuuaaacaacggaaacucaaggugcaacaguuaaaaguggauaguucuucacaguguguacccaaaaacccagggacccuggguuacacucuugauccuugauuaguugcacaaggaaucuucuaucauucucugucccuccaagaguuguuuacguauuuucaagcucaaauucuuugcugaacucuuaauuuucucucagugugucuagacugcuauuuauuuaucgaauuuucaauuccaacaucuauaauuuuuauaccuaauauuucuaucuaauucuguuucaaaccugccuguucuuuuaucuuagauuccuguucuugcuguuuucuuucuaaucuuuucuucaucucaccaaacauuuuaaacaugcuuauuuuagaauuuguuucuaaugcuuccauauuuucuaacucuccuuuacaauaguucauuuucuugugugguuuauaauauuggcuaugagcucauuuccacuggcuaugagcucauuuuucagggguacucuggccugaacugugacugggguuguguuugcugcaguuucauggauaucagccguucuuacugauacucguguuacuuuuguggcuuaaagaauauauuaauguguucucaugcugcuaauaaagacauacuugagacuggguaauuuauaaagaaaaagauuuaauagauucacaguuccacauggcuggggaggccucacaaucauggcacaaggugaagaaguaaagguaugucuuacuugguggcaggcacaucuuacaugggggcaggcaagagagccugugcagggaaacugcccuuuauaaaaccgucagaucuugugaggcuuauucaccaucaugagaacagcacaggaaagacucgcccccaugauucaauuaccucccacugaaucccucccaggacacauggggauuauuaugggagcuacaauucaagaugacauuuggguggaaacacagcuaaaccauaucagggaaggagagguccuugaacuauuugcauuaugggggcacuguaaaauuagacuacacacuucaguuggcccaggucuggauucugauuucucugaggagacucuuuugccccgcauggaucuggacagaagucaagcaacauucugcuuuuuucugagcuggaggccaggguucuuccaguccagauaaaaugcagaacaauccuuuguaacacccagcuuuguagagacaccucagcuccaacuuacugucuuauauuaggugccucccaacuccucucucuauugggacccagaagcccugaagauuuauauugacuccaaguacaucugugaaccauuuggcuucagcugcugcucacagcucugauuuuauauucucccaaacucucugaccgcuggauaguuugcucauguagcuuugagauaauuuauacauucaaaacuuacucucuuuuaucuauuuccuuguguugauuuggcauagggugaggaggguaagggaaaaaggugucuaaauaagcauaguccaacacauugaccuaaagcccauauauauauaugcugcuaauaacauuauauauauguauauauauauuauauauaauuuuuuuugaaacagucucucucugucacccaggcuggagugcaguggcaugaucucagcucacugcagccuccuccucccggguucaagcaauucucaugccucagccucccaaguagcugggacuacaggcgugagccaccacgcccggcuaauuuuuauauuuuuaguagagacaggguuucaccauuucggccaggcugguuuagaacuccugaccucaggugaucugcccaccucagccucccaaagugcagagauuacaggugugagccacuguguccagccuauguuuuuauauuuuuaggauucccauguaaugaugcaauuuuccuuucuuugauaugaugcaucuaugauuuuauauucuaaauguauuuuuauacuuauauauaaaaugcauuuuauuaauuaagcauuaguucuuaaaaguugguauuuccuugaacuuuuaauuuuacaaauauuccauuucgguguuauuauuuuuaguauuuuuuugcugcugaauaguuaugccaaccucugugcagccugggaagacaacacaucagcagucaauuuguguaaagacaaaauaauauuagagagcaagagaaugagacaagacugcaaaucagcaauaauaauuauugaguacugagaacaauuccaguggauuaagauuugggaugcuuaagcuucuuaauauuaauugcagcaaauauucaaaugcuuucacuuuccauauaaguacuucagcaaauaagcaaaauaugaaauaaaaacccuaauucagaauuaccuaaauauaaaacaaguaaauuguccuaggcaauucuuaccaucuuauguccaguaaaacaauaaccuauauuugugcauacagauauauuaucucauuuaaaaacuagcggugauuguaaaucuugacaccaaauugaaguugaacugaaagaggcuuuccuguaaagauacuuaggauccuuacauuguauguaaggaaagucaccuaguccucacaucaaccccaggugugacauguuauuaacuuauucuaaugguacagauguugagaugcagagaacagaagcagcucuuaggggacagagacagggcucagugaugauuauauucaccugucaugggguagagcuacaauagugaguauucuguggaugguccuauccagauaaaagaaggaauugguuucaggacauagucugcaucuuacuagguggggaauguuggacaaguuacuuaaccucuucugcccuguaaaauagggauaaaaaugguacauaucacagagugucauaggaagacuaaaguagacuauucucauccucacaccuaaugaguucucaauauuuaacugauuauaauuaucuuuacuagauacauaauuaaguaaauaaauuaaggaauuauagagcaaauagucauagggucacacagauagaaagugggaaaaauaggagacaaaccuaugucuauauucauuccauggcauuagauuuagauugccuccuuuuagucuggcaaaacacucaugauuauacaauguaauuuaaaaauauacaguacuuugcugggugugguggugcaugccuguggucccagcuacuugggaggcugaggugggaggauggcuuaagccugggaagcagagguugcaaugagccgagaucacgccaccgcacucuagccugggcuguagaacgagauacugucucaaaaaagaaaaaaaaauacaguacucacauuuuacuuugcuaguauaugcuguauucacugguguaugcucucuugcauggagacuuucauugggaauaaaauguuugaaacuauuuuacuauuucuugcacugcuuugagauacuaccagcaaagcuauuucuaagcugagacgcuauguccuggcaggacuucuaaagacuuaaagcaaugcuguagcuguguauuuacaacugacuagagcagggaucagcaaaccauggccagugggucaaauccugcuuacugccaguuuuuguaaacaaaguuuuaucgcaacucccugcccauuuguuuagacauggucuguggcugcuuuucuccaacagcagaaaaguucaguaguuccaacagaaacccugaggcccauaaagccuaaaauguuuaccaucuggccauuuacggaaaguuagccaacccccagacuagaauaaagguaggaaaaaccacucagcccaagcuucuuuuuugauucuaucuucccacagcugccuagaauccuuugcagucuuuauccuaggaggcucagaggcuauaacacaucucuaauuuugucuagauuugugagaauccauuucucacaaauccaguucuggcccucuuucccugacucgauguuccuugaacucuaaacaugaauuuuuaaaagaaggauuaccugggauggguauaucccugaaagucaccuccuuucugcugccucucacaaauacacaggcuaugugccuuaaaccugucauucacuuuaaggaauuuuugaaaaguggauaauagguuagacauaaaauucacugaaucuggguuaaauuuaaucagugaguauucuuuagaauggaagcaugagccugaaugauuaaagaaauugcuuaaaaaauuagaaucaaaauacuaaauaucaucccccccaauguuuuagcuagaaaaauuacuugaaaaugagccagagaaggagaaaaauaauuaucuuacagaaaacuaauaaaaauacaauaaacuaucauuuauuuaaauacaauaaacuaucauuuguuaaaauacaauaaacaugcaaaagcgcuaucauugauagcacuuuuaauguuuaaauaacccacugauuacuuucucuaguggauuauuugcaaggguagaguaagaaucgucgcuucucuggacacauaacccauuugccaugugacauugccucccuuccaccaagaaguggaauguauuuuuccuccccuuaaaucugaugccuauaacuuucuuuccccuugagauaauggcagaguggcauugugcaaguuuuggaacuaaggucccacgaggcccugcggcucucucucuuguuuaucugaguacugcccuaagaugaccauggagagaagcccagucuagccuagaaaaggagaagaggccacauggagaacugaggucagccagccccagcugcuugacuucugaacaaagccuucuccgacuauuuggcccuguuagacccagcugagaucagcagaagaaucacccaucugacccuagcccaaauugccuucugcagaaccacgggccaauaaauagcagaugcuuuaacccaccauauuuugcagugauuuguuauauggcaacauaucauugaaaaacccucauuuuaccaaagaaggggggucaugacauuaagcaacuaccuaaacccacaauguaaauggcaagucagggauuuagaugcaaaucauuccaacuaaaaauguauacucuaaaucaaugcccuguacuauacucuguauuuuccaaaaacuaauuagauugugucaucagcauuucugaagacagagguagucgucugggaaguagaguuuucucaaccaguauuuugcacuuguugggauuuuugagaucaggaauguuuuggaaaaccugagaugugcagucacaucucugagcaguguuuuaaguuuauucauucacucauucauucauucagcaaauauuuauugagaucuacuauauguuaggcacuauguuuaccacuggaaggcaggcaccagguaaguacaaacacagaaccugagauggauggcauugcauuuucauuugauuacaaauuuauucuugcuuauaaguugauuaccuaccuuauuaagagcugauuuguuucaaguuuuagaacuccaauuguguccuuaaauuuuugucuagcuuaaaacauagugcuagauuucaagaaguaaauugucaaacagguuugcuguuuaguuuuuguaaaaaaggaaacuuguaggcagaaacaaaaaccaaaauaaauaaaaucuaaauuaugguaauaacuaaagauaguugaggcauuaacagaguuugacugaacucucaagucucaagcaaauuucuaaacuaaacuguuuucuucuguuaaucaguuuaaaagggaauaccuugugcuaauuuuucuugguguugguaacauuaauaaagcucugugaaaugaggccagaaggaacagaaauugagucaaaauaaugauaacaccucuuacauauucuuaccaucuugucuccuagccacacacaccauguuuaaaccuaaaaggagagacaccuggagggguuaauuagcuugcagcugucugugacuagucugcagaggauaaaacggauaucagccguaagaaagcagcuagcacuagccuggaugaugaacaaagaaaagaagcagcugcugaggaaaagcacauuuugcugaccuuugaggagggcuuaagaggcccuuugcccccugaaaaugggaccugggaagaaagucuugauggcagacaguacaaaaucaagggacagcagcuggcuguuuuguguaaggggcaaaauucaagaggauuugugaaucguugugauuuacagugaccauuaacuauuguaauaaggagagaaaaaucaacauccauucagugcccacauugcaaauugccaagcacuggagggguacuuucaccuaggccaacaaacuuaauaagcagagaaacccuucaguguuuuggcuccuacagcucaaguguacuagguuggcaaguggaaguuccuuuggucaucucuguuuauacacuuguuugagauauuucauaaagucagcccauuuguuacuuuaucuguaguaugugcuguuucauguggaagaugcuugccuuuugauaguauuccaaacugaccaacccuguacggauuuaagccacugagaagcuaugaacagacaggugaaguuuugguauugccaggaaccagcuuguccagaaguuuaauccuuuaaggaaaaggauagcaagcccaaugcaacagcccuucaugcuaaaaacucucaauaaauuaaguauugaugggacguaucucaaaauaauaagagcuauuugugacaaaaccacagccaauaucauacugaaugggcaaaaacuggaagcauucccuuugaaaaccggcacaagacagggauggccucccucaccacuccuauucaacauaguguuggaaguucuggccagggcagucaggcaggagaaagaaauaaaggguauucaauuaggaagagaggaagucaaauugucccuguuugcagaugacaugauuguauaucuagaaaaccccaucgucucagcccaaaaucuccuuaagcugauaggcaacuucagcaaagucucaggauacaaaaucaaugugcaaaaaucacaagcauuccuauacaccaauaacagacagagagccaaaucaugagugaacucccauucacaauugcuucaaagagaguaaaauaccuaggaaucuaacuuacaagggaugugaaggagcucuucaaggagaacuacaaaccacugcucgacaauuguuaaaaacuaaaguuguuggggaacaaauuguacuuaaaauauauuuauuguguaaucugauaaaauauuuuaaauucugguguuacaaaguuuuaguguuucuuuuguucuuuuuacaaaacagaaacccacuaaaauguuaacugauugacauuauauuuuuugcuuucgucaguguuaaauacuuguugcacaguaguaugaguuguuucuaucauuuacucuucuacaagccaguugagacguguuacgaggacucaaaauauucuaauuggcggugaccaaaugucauacaauuaugaaguauacaagccauucuaaccuucacaguaaauuuuuuuacccucugguugcauacuuaaauagaauuauacuaauaaugcauauuuucugaauguuaaugucaugugaaauugcuacuaaguuaaacguugcuucccaugguuuucugggugauggguguuuauucugcuuauucagugccucucuacauagaggaaccuaucucagugacuccuguacuacucuacaacaaaauggcagaagaaaaguuacccauuugaaaaaauaccuuauuuuccaaacagaagucuucagacaggcagugcacaauauuugccuuccagaaaaggagauugcauaaaugcauaacuuacauguuaguacaugugacuguuucccugucuuauccugaaugcauggaaaaucaugagacuuauuuuuuucuuccuacuggauuccauuauaaaaccucuauuuguauagguuauaaauucuaaccaauaauugagcuuacuauguugaggcuguaggcagaggauaagauuuacaugucagacuuuauguucugcucuuuggauuaggguaauuuucaaaaguuauugacuguaaaauaauaaucaugcacugaggaaauacaauauuaaaauaaauuuugaagaagauggaauuauagcaggggaccuguggaaauagaaucuaagaacauauuguacauaugcugaauuaauagaguugcauugugucguucacauagcaaauucaguacagauuguuuguuaaugucaacagauuaugccguaaaauuuguaauuuguuuggcaaaucuugacaaugcugagacauuuauucuaguuaauacaaauggcuaaggucuguaauuaugaguuauuuaagcuaagaaauuuggcaaguucauuauucaucagucucuaccuacuauuccaaauuaauugacuguuuuauauacugauacaauuaauaguaaacuuuuuauauuaaguauacauaugugaaauaaaaucauauuauuauuggauuauaagauguuaauaaugguaagucaugacuguuauuuuguugaagugauuuuuuagaauuuuuaaagguuuauucaacaaaauagaguuaucuuacuuaaaaauggaugcuuagggccaggcgcaguggcucacaccuguaaucccagcacuuugggaggccaaggcgggcaguaucaccugaggucacaaguuugagaccagccuggccaacauggugaaacccugucucuacuaaaaauacaaaauuagccaggcaugguggugggcaccuguaauuccagcuacuugggaggcugagguaggagaauuguuugaacccgggaggcagagguugcagugagccgagaucaugccacuaaauuucaaccugggcgacagagugagacucugucucaaaaaaauaaaaaauaaaaaaaccacgcuuagagauuuuuaaauuaaauuaguuucaauacuucuauaauaguuaaaacaagugguuucuauuuaaaucacaaaugauagagguuagagaugaaacuaaacauaugagaucaucaaguccaaccuucugcuacgauauuagacuucaaaugaaaagcacaucaaacguuaaccagaugauuucuuugauagucuguuuaaaaauauugaauuaauaaacuggaaacauuuuaaaaauugcuguucuuuuggaauuaauauaaaaacauauacuuuaaaguaaggaauuuuauacugauuaaguuauacacugcuuagccuagcauguguauguuauacuuaaaaaugugcauuguacauugucaaauaauuugcacacgaucauuuacacaucuguauuguucacauugacguacuuugugucauauauauuugugcauuaucaguugauuugcacauugcacaccagagucacacaguuauagaucugugugaauucccuauauuccacaugcauggacauguucauauauacccacacaaauacaccccaugaaaugauauccaguuaaugaauacaaagguuuuuaaaggagaaauucauuagaaaaaaauccuauaagccucuaguuuucccaaugaauuaaucuaagaauggauauuuuauuuuuuccauguuugacuuguaaaguaaaacuuuaguaauaaagagugucugccuuacaguucauauauuucuugaauuuaaaaaacucaauuacauaagaaauacauuaauucuuuucuuuaaacuauuaagacagcaaagucuuuuuuaugauuaucuacaauuccgguccucucuccgguaucuccaagauaacauuauuaugaguuuaauguaugacauuuuugacuuugaaacucacuuucauauggguauauacauauguuuacauagaauauauggaguguuguuuacauauuauuuauaugaauaaauauacaccuacuccagguaauuuaguggugacuaucacguauuuuauuuggucauucuacaauugauugaugccuuuugugugugugugauuacuaauacuggaguauuaauauacuugcaugagucuccuuguguaccaugggaauaguucuguauuugaaaauagaauuacuggguaugcacauuuuuaauuuuuaauauauacuuccaaauuguuccugcauacucccaccaguacuaagaauguaucuguuuuccucuuagcaugucaauauuugauauaaugaaacuuguaaauuuuagccaacuaaaugagugugauuucuauuccuuuauaguaacugaugagguuauaaucaaguuaagcauuuuuuuauauguuuauuggccacucagguuuuuuucuucuacgaauugcugguucacaugcuucgcccauuuuccuucuggacuugugugugugucuuuuucuuacauauauugguauauuugacuuuugucuauuauuuauuuuaagguuauaggauuuuagaguuaaugaaaggauaaaaugcuggaggccuagaauucagaaucguacauaggauucuaaacagaagccauguucuaaauaaggauuuggcuugugggacaaaagaaaaauguggaauuucacagacauuuaugggcaauagagaaucaagaaugacuuugucauaacaucggcaucauugaaugguauugucaccuauaccaugaucaagaaauuaacgguguugcucugcagacuggcaaaucucauugcccuuucuucuaacccugggaaaguauuauuacaauggaaaaagauaugcgacaagauauuguauuaauaggguguuagaaucaaauaaaaggagggauagauguaguaagagaagcagauuuuauagcuauccccauuccaagaauaaaaaacaaaaaaauaauaggcgaguucauugugggcaucugucaggaacaaggaaggauagagcucugaaagcugacugcagucacuaacaaaaacccuuuugagacauauuccaagaaccugaaaaacugguaauggacccuuccuuauacucggugucuugaaaggcaguaaacugucuaaugggauauaaaaauagagucuuuuuuuccucccccacucuaauauucuccuauuuuaaaaaccuucuuuauauggcacugcaaauaauagcacacagcaagaacuguacuuugcaguauuauugagcaucucaagugucugaaagguacaaagcuaacaaccaaaugacuucagaauggaaaaugucccagaauuuuuaauuuuccuucuaaaacagaaauauaggggaagcaaaaacaaccuuaaucuaaaauccagcuuaaaaugacaaccagagguuuucuagcuuauauuuuauuucagaaugcuuagcaaauuucuugacuuuguauuaauuuuagugaguuguaauuugaggaaacucaugguuuucuaagauccuuuauaccugaaaaguugucgcauacguguaagacuugcuuuguuauuguuguuguaaauugaauaccugaagguagauuuuaguacacuaaauaaucaugauguucauucugugcuaauaggcaggaaagauggacaauagaacuuacugggaugccaggaagugcucugaucacccaggagugagacaugagaugggcagaaagaacaagauuaguuaacuaucaugggaaacauaagaagaauuuggcuuuagggauuguguguuugagauugauuuuuaaaagaaaaagaccuauuuaaaaauccacagaugcuuagggaauagaauagcuauuuuuuuaauucauaaauuuuauauugguuaguuuucacagcagugaauuaucaacuuuauauaaaaguaaaaugauaauuugauauauuuccugauaugaguccacauuuucagagccaucuaaauucagccuuguuuguucauuauacauauauaagaaaauccuucuucuaugcaacaaauggcuguauauaaaauauacaugacuuguugauuuaaaaucuuuuaccuuuuuuucucaucauaaagguaaaacacaugcauuucauaaauguuugaaaaugggaacguauguaccaaaaaaaucacuucaaaaucaugguuuacguaucuucuaaaaacauguaaucaaauauaacaaaguauauuuaggccaauauuuugacuaugauaaaaucgcuuugauucagaagguauuguguuuucugaguauuucauuauuuaaagcagaagguuucaucuuucagaagugucacuccagccuggguguccugugugguugagucaaaucagugcuuccacuaucaguagguuuggcacaggaugaagcaagaacaucaaacuaaaggggccaagaacaauaggugggagaggcugcaggaggagcagagagguccugauaaugagguucccugacuauagcagguuaggacuagacaagcccugugaccaacagaggaaagaguuucugagcacuuucuauaucuggcuguaccuugggggacuuccuccauuuugucugggcucauccacaguccugcuaagagauucugcaaaauauacugcaguucucauucaugugccccuugagaugcauuugagcugcagguauuuucccuccagugguacccaguuuauuauuucuaguccauucaacucauaacaacauccagcagcacuuuacccacagguggguguuuauuagguuuuuauuucuuuuguccagguuuauugaguuugaagaguaggcagggauuucuguuuuuaugagucacuugucagcuguaaugaagucuucuucacuaaaaaaaagaugugaggacaaucuugcgcagugucauaauuauucuaaaaauacaucaugcuuaauuguauccacaaagguuuuaaaaauuuaaacaucaguuuugaguuuuagggcuuucuuauuggugaauuaucaauaauuguagugcuuucuugaaaaguucccugggguggauuuccuuaguugcauauaauucuagccucuucagccuacuaaggauaaaagggacaugaaguacacauaucugggaauuaauuacauuuuucugcucaagagccaagucauuuucagaaauugaugucaaauaggucuuccauagcugaaagugcuaggugucucuucacauaguuaagauuucccccuauucagaaauauuaguuucugaugacaauggaaaauuccaaaugcagcagcuucacuguguucuaauaauguucaugcuuagggauccugaaaccacuugcaguaugccuggucuagccacagcagggagccggcgcccaugccaguucccagagcugaccaccccaccgcagccagcgugucuggcugugcaccauggccagacuccaugcucacucacucaugcaccccgcacugcuccccaccuggcucaaccuuggugggcaugggauccaggcugguagugaaagucaaaugcugccugccaggccgggugggcagaacgagcccagcgggugagaaaaacuugggcaaacgugccacuggcuacagagguuuccggcuggugaagugacacccuaaggauucugugacaaugggaaaagggguaaugaagggauagagcagauuaaggaauuuaaaacccaguugagcaaguauaucuguaaauaauguacuuuuguauacuacaaaaccacaaagaaaggaucucccuccucuauuaucacagggucaucccggaagaacugacauuucaauacguuaaaaaauaaguagauaauguuuuuagcuuuaaaaaaaaguggaauaaucuaugcauauauaaagaauaaaugcacauaacauuuauguggguuauguaagcagagguaagcauuauaauaaagcaaacacugaugagccacuggugaggaaacauaaccuuccuaaaucucugaggcuuucagaguggcucuuggcccauguagagguaagggugugaaagaacaggaagagagggcguccauguuugagaaaccacaaaaucacaggagucgcuaaaggaguaguuuaauugguuauauggaggaaaucuggagugauguuagaagaugcaauugaccagaucagguggaucacagaggccauccugagcaguacaauaggaaauuaaucagggauccccuaugguuaccauaccuuauggguuuaaaccaaugaugcuuacgagggagaaguuagcuuuucuggacaauguccuuggugugcacuuuucagauggagauuggcaagccaauggcuaaggagggugaaucagaucaaaauucuuccuugacuuucauagcauuuccagaggaugucuaguuuaugaguaaaaugucuugccuucaucucauaaaauuaucucuauguccucaccuguaaagauguucuauaucaaacauuauuauuuauacaaauaauuauauuuucuuaaaaagacuuuuuuguacaguaaaauaaguggaagcaaacuuaaaugauucagaacaacuuucuaaauauuugacuaaacaauuucaggaaauagccauuuaaucccucgaaaacaaaauuuggcuuugguuaauuuuuagaaaauccuaagaugaggagaugaagcuaaaaaaaauauauugaacacugugcauuucaauaaagaauuuacagaauagcuggaaaauuaagguuaaguauacaagguaauuauagauuuauuuuuaaaaugaaaaggcauuuaacaaucuaaaaacuacaucaaauacauuauauuuagcaucaugaaaguacuuaauuaucugcaccuaucagugaagcauuuuuuuucucauaaaucuguucuaugauaaucuacaggaagacauaauuuuaaaauuuguaaggauuagaguggauggucaccuggucccaaccuuuggaacauuugaaaagcaaggaacauauaaacugaacauuaauuuucuccuugcaauguauacaagaaauuuaaaaaagaauuuuccagaguacagguauaaaaggguauauucuugacagggaaucagagugcugacagauggcuaagauuuccauccaagaaaaauuugauguuugaacuuaagaaaauggaaacuuucuuugcuggaccucacauaauauuuucaguaaugacagaaagucaggaaagaugaauguggaaacaaaauguucuugaacacaugaaauaaauagguaauuuagauacaguggguggugccaguaugcucuguaggugaagaauaaaucuggaauccuaggaggucgcccuaaccagugaggucucucucacuuaugaacauaaaaugucuggguacuuaggacuccucuaggcaauaaaugaccuucaguuagauugagggcugaucgaacugagagggauuaguacauaauuuaaucuauuugcuaauuagcaugaugaauuagaccauugucaucuguugcugugugggagaggaagaggacaaggcauuuaaguuuugaugagaaggacauuuauugaauagcauuguacacuuuaagaguggauucucauauaugaucuaaguaucuuagucuauagacuaaguuugauucuuuccuuucauuagugacagagcuacaacugucacuugaguauugggugacuugacuucucuuccaagucgaacacacugcauaacauggaaagaaggcaaggaagaggagaauauaucuugucccaucacuggucauuucaggggagauuuuggcacugaagacagaucaggagcauaucagauaggaacaaaaaaaacaggcuugguagcuuaaaaggaggagucaagucuuaccaacucugaacacucaccucaguagugauguuucauuuuuacccucuuaggguaaaagagucugguauuucuaaguauaugcuuucuaguguuuguguuuacuauauuuaagaaacaccauuagaucaauucuuauuaaugauuacuugauauuaaucauuaugauuagacacuaguuuaaaagcauagauuaguuucauuaaagacuuuucuugagagauuauauauuaaaugggugguguacacauucuuacuaagaaaguuuucugcuguuuauaucuuaaauuaauguagaauuucucccuuaauuucuacauagaaacuuaguauagauaagcuugugcagucagcugugaauucaucuaggccuacuaccauuucuucaucuccucuaaagaauaaaauaugaacuaucuuguugaaauuaagugcuacuagaucuauacugcuagugauccuguaauaucaauacaugcaugcauacauacauaaauauuuuaagaaggaaaagaaaucugguuggaacugaugccuucccagugagccuuugcuggcucuugacaguuuucgcucucuucuuuaaggguguucagauuaucuagacuuucuagaauuaaugauuauuuuaucguuuugacaauuuuucuuucuaaguuaaaaccacauuggcauuuugugaauaugaucauauuucucauuuugaccaauuuuucccuagcauuacaguucguuaauuuacugguaauuaaauaaugauuaaacauauuaauuaaacaaauaaugauuauuuauuuuuguauuacguuuuauuccuuaaagccucucuccaucguuaacccuuuuccuuuguaagcccuuccuuagcaucucacuggagguacguucaggcagcaucacuuuaguaucucgccagcauuguccucuucccgccagugggaaccaacuaacaaguacacucucagguaugaacuuaaguacaggcaagucaacagauuucauaugcauccaaaugacacguuaaauacaaagcuuugcucaccugccuuuguacaggagucugcugcugcuggguuuuaaugaaacuuaaaggcugaaucaaagccuuauuagugggaggaucuuugacaugaaauucuuuuuguucaguauaauuugcauuuuguauucauuugaaaaauuguccugugcauuuguucgaauaucgagaauagagaacugagugauuccuggguuuaugugggugauauuguggaaauaagaggugcugugguauguacagcuaguccccaaauaugauuguauuuuacuagagauagagaauucacagugacugaacuauucaggcuguaaaauauaggaaccaucugccauagaauaagcauauuaggaaaaugccaccuauuccuacauuagucuggcccuugcuccaaaauuucacauguacucauauguuuguuuuccgugucucugauugaugcagcuagcuaaugccuaaugacaguuuuuuuaaucauucccuauauacauuuuuuuauuuuauuauuauacuuuaaguuuuaggguacaugugcacaacgugcagguuuguuacauauguauacaugugccauguuagugugcugcacccauuaacucgucauuuagcauuaggccuaucuccaaaugcuaucccuccccccuccccccaccccacaacaguccccagugugugauguucgccuuccuguguccauguguucucauuguucaauucccaccuaugagugagaacaugcgguguuugauuuuuuguccuugcgauaguuugcugagaaugaugguuuccagcuucauccaugucccuacaaaggacaugaacucuucauuuuuuauggcugcauaguauuccaugguguauaugugccacauuuuccuaauccagucucucguuguuggacauuuggguugguuccaagucuuugcuauugugaauagugccacaauaaacauacaugugcaugugucuuuauagcagcaugauuuauaauccuuuggguauauacccaguaaugggauggcugggucaaaugguauuucuaguucuagaucccugaggaaucgccacaccaacuuccacaaggguugaacuaguuuauaguccuaccaacaguguaaaaguguuccuguuucuccacauccucuccagcaccuguucuuuccugacauuuuaaugauuggugugagaugguaucucauugugguuuugauuugcaguucucugauggccagugaugaugagcauuuuuucauguguuuuuuggcugcauaaaugucuucuuuugagaagugucuguucauauccuucacccacuuuuugaugggguuguuuguuuuuuucuuguaaauuuguuugaguucauuguagauucuggauauuagccguuugucagaugaaaaauuuucucccauuuuauagguucccuauucacucugaugacgguuucuuuugcugugcagaagcucuuuaguuuaauuaaaucccauuugucaauuuuggcuuuuguugccauugcuuuugguguuuuagacaugaagucuuugcccaugccuauguccugaaugguauugccuagguuuuccucuaggguuuuuaugguuuuaggucuaacacguaagucuuuaauccaucuugaauuaauuuuuguauaagguguaaggaagggauccaguuucagcuuucuacauauggcuagccaguuuucccagcaccauuuauuaaauagggaauccuuuccccauuucuuguuuuugucagguuugucaaagaacagaugguuguagauauguggcauuauuucugagggcucuguucuguuccauugaucuauaucucuguuuugguaccaguaccaugcuguuuugguuacuguagccuuguaguauaguuugaagucagguagcuugaugccugcagcuuugcucuuuuggcuuaggauugacuuggugaugcgggcucuuuuuugguuccauaugaacuuuaaaguaguuuuuuccaguucugugaagaaagucauugguagcuugaccacauaguuggaaguaaagcacuccucagcaaauguaaaagaacagaaauuauaacaaacugucucucagaccacagugcaaucaaacuagaacucaggauuaagaaacucacucaaaaccgcucaacuacauggaaacugaacaaccugcuccugaaugaauacuggguacauaaugaaaugaaggcagaaauaaagauguucuuugaaaccaacgagaacaaagacacaacauaccagaaucucugggacacauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauagcuaaaaucagagcagaacugaaggaaauagagacacaaaaaaccuuucaaaaaauuaaugaauccaggagcugguuuuuugaaaagaucaacaaaauugauagaccucuaacaagacuaauaaagaagaaaagagagaagaaucaaauagacgcaauaaaaaaugauaaaggggauaucaccaccgaucccacagaaaugcaaacuaccaucagagaauauuacaaacaccucuacgcaaauaaacuagaaaaucuagaagaaauggauaaauuccucgacacguacacccucccaagacuaaaccaggaagaaguugaaucucugaauagaccaauaacaggcucugaaauuguggcaauaaucaauagcuuaccaaccaaaaaaaguccgggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccgggcagagacacaaccaaaaaagagaauuuuagaccaauaucuuugaugaacauugaugcaaaaauccucaauaaaauacuggcaaaccgaauccagcagcacaucaaaaagcuuauccaccaugaucaggugggcuucaucccugggaugcaaggcugguucaacauacgcaaaucaauaaauguaauccagcauauaaacagaaccaaagacaaaaaccacaugauuaucucaauacaugcagaaaaggccuuugacaaaauucaacagcccuucaugcuaaaaacucucaauaaauuagguauugaugggacguaucucaaaauaauaagagcuaucuaugacaaacccacagccaauaucauacugaaugggcaaaaauggaagcauucccuuugaaaacuggcacaagacagggaugcccucucucaccacuccuauucaacauaauguuggaaguccuggccagggcaauuaggcaggagaaggaaauaaaggguauucaauuaggaaaagaggaagucaaauugucccuguuugcagaugacaugauuauauaucuagaaaaccccauugucucagcccaaaaucuccuuaagcugauaagcaacuucagcaaagucucaggauacaaaaucaaugugcaaaaaucacaagcauucuuauacaccaauaacagacaaacagagagccaaaucaugagugaacucccauucacaguugcuucaaagagaauaaaauaccuagcaauccaacuuacgagggaugugaaggaccucuucaaggagaacuacaaaccacugcucaaugaaauaaaagaggauacaaacaaauggaagaacauuccaugcucauggguaggaagaaucaauaucgugaaaauggccacacugcccaugguaauuuacagauucagugccauccccaucaagagauuuuuuuacacauuccauaugugaauauccuauuuucugauucaguucugacuuuauuuccauuauaugugaauguguuucuuuacuauuuuucuaucaguuuccuuccuggucaauugauuauaugggaaaauauuuuauccauucaauauucaaaaauaguuuauugaggacccacuaugugcuaggcauuugaucacaacagugaaaaacagagaaaaaauccuugcuuucauggaguugacaaauucuaccaaaggaaacaggaaauaaugaaaauaaguaaguaaaauaaauagcaugcuacguaguaauaagugucaaggagaaaaggaaagcagacaaagagaggggaaggugugagcaggaauugcaguuucagauaagguggccaugaaggugucccuucaaggaaaauguaguaguugggaaggggcaagucacauggcucucuggggaagagugugcagggcaucgggaacagcccuugcaaaggccuugagaaggaagcaugccccaugcucuccuccucauaugaggaggccaacaggucuugaaugaagcuauggagaaagagaaagggaauacgauuggaaagguaacaaggaauggaucacguagagccuuccagggcaacguaaugaccuuggcuauuccuuuuaaaugagauggaaagcccguggagcauuuugaguagaggcgagacaaaacugaucaggacaacucugcuugcugggcagagaauagaaucaagggaagcaaugacagaagagacuguccuaagaguccaggcgagagauggcaguggcuuggacaaaggugguagcaguggaggucacagaagaugcugaauauaguguucauguuuacuuuaugggauuuacuaagagauuggcuguguguuaaaaggaaaagaucauucuaaagcuucuggccucagugauuagauagacuugccauuaacuuccagaagagcauguuugaggggaaauaugaggaucucgguuucauuacauguuaaguuccaguaaugugauuagauugaaaaugcuauagcugguagaauuuuuucacuuuuuaugucaaaacagaaaacaugauugaauaaugaaaacuacacaugcucaauuuuuuuaaaauuguuuucuuugacacaguaaaggaucaaugagacuugcuuaauucuugucaagaauacaaagucaacaauggcugagaugaaaauauuuuccauaaaguaaaaugaucaaauuugcaaaagcuugguuacaugaugugaauuucacucaaaccacaaggcauuacacuagagucuugcugaaauuuaagacagacugucuuaggaauuauuugccaauagacaaaaugaauauggggugguugaugugcugaaguggccaaugagcaugcuuugauugacagaugaggaaauguaucccuacauuuuaucaaacuauguggugucugauuuauaucacugagguggccauucauuauggucaugaacugugaggucaaagcacuugcaaaaacuugccaaaauacuuccuauuccaguacuaaauauuucucauauuuguuugccuagaauaacaagaugcaggcuugguaguccuuucaagaaugugaauuucuuugguaugucugaguuuaguaauguugaauuguguguguguguguauuauucuuaagacuuugccuguauuuuaacauuuuauuugguaaaaauagcauuauuuuggcaagauuuuuaaagccuugaaaugggacaaauuaaaguauaaugcuuuuucuugagaaauaauuuauugcuccauguuguugaaucauaccauuagucaugaaaccaaaacccuauauuuaaaaaguaacaaucucauauucaaaguaucuccuuugaacauuucaaagaaucuuaagcaaaucuuuaugugacauuaaauuguacauuuuaccuuguuauuuuagaucuauggguggaguucauucuucgggcuaaguguagguaugaagugugaauuucugugucuugguaugccaguaacuuagggcaagguuaguagaguggcuuuugugagaaaaaaagagcuguuuuaucagacaucaguuggaacuuugccuuguuuuguuucccugaaccguccaaucugcuucauauacuugugugaaauccuaaaaugucuguaugucaauaauuuuuaguuagcauauuuuuuccaaacagacauccuugugaacaucagccguuucugagaacugggcccacggaccauagcuacuuugagucucagucuauguaauaguugggguaaaguaagcuuuaaagagagaacucacaacacaauggcucaagcaagacacaaguugauuucuuucugaagcugccauccuggguauguggguauuuggaugagcugggccccaugaagucaucccaaagugcaggccucuguggcaucucugccaaacucaacacuuacucuccaagucuguccuuggcuucucuauuucuagcugguggaagggaagggaaaaaugaguccagggaaggaguuuuuguagauggcuugggaguugcauacaucaggaagaacuuugucacaaggccacaacuccuugcaggaaauucuaggaaacauauucccucacugagcagccaugcgcccaggaagaagagaagaaugagucuagagucgcaagcagcaauaucuacuacaggcuuaaauaaccaaaggacaaaaugcccaguccauuauaaauauauuccaaaaaugaagccaugaaauuugacuucauuuauugaagucaaaacaaauuuauuguuauaaacuaauuucucuauuuuauauuucucaaaugauuacauuuuuaacacagaacaaagccauaguuagaauuucaguaaucguauggaauauccaaaagguacacccaauacacccaaaagcuaaaccagagucacugcuaaauuuuauauuguucugauuuaccuaacagauuagugaaaauaauuaaaaucuugcugcuuuuuaaauuuuaaauaucggauuuugguuagaacucuaagaauauuuaaaacuaucuuuaccuacucuuguuggacaaucauuugaggagcuaagagugcagagaaggcagagaaauguucuccucaacccaagcaaaagcacagaagaacuauugcuaauccaaaaugcaggaaggaaauuucaccccuccucccuucccuuuucuugggcuagucuguuuaacuuuaaaagcagaauuuuugcucucacaaaguauaccagacaggaauuuguucaaauuccucaaaaccaagccaagaaaaguuucagaaaguucagacaugcauggcagaguggaaagaacauagucuguggaggcgagcacggauucauuggaaugccgcuccagacauccacucugggugaacucagggauguguuuagucucauuaagccacagucuuuucauuuuuaauguaagagugauaagaacgacuugccaguguguugguggagaacugaaauagagaaaggccugguguguaacaggauguuucucuccaucuguguaaucugugacaguccuaggaaguucaaaguuaugacuguucuggguuuguggccaacaguugucuguggcuuccauggguuggagcugucuaauggggcccagaccaccaucgcucugcucagaagcuaaucauaccaaaacaugagguuuuucuccaagcgacaaagaggggcuaagcacccaaggaucuccauaauaguagcaggaaaaugaagcugagaccuuacccugacuuagaaguucauaacaauaauggccccaaacaagaugcucaugucuauugguugugguuaauaaucaugcaacaacaugaacuucaaacccagccuaugcuuggcucuuccagggacugaaggcaucucagagccccaccccuuaccucagaaaccgcaggaaggagccuggguucucagaguccaagaaaaugcaccugauaauagcaccugaacuuccuccacacaaagaaagccugauagggacaggggauuaagcuugcauggagggcaggauccaacccacaguagcacuuccuugccaugcgaccuuagcaaauggcuuaacucgcuuucuguaucaguaaaaugguguuuguaguacuaaggugucagugaggauuaaaugagccaagccugacccacagcaauucaugacaagucucagccacuuuaaugaaugugaugauauucuaacguuugggaugcugagguggaggacgauggugucccaccuccugcaaaugccaugugaacacugaagcuacacaagcaauggcucuaaagucaaagccagcaucaggacugguauaaaagaaucaccaggacaagggcagggcagaggggaggccaaagcagcuuugucagugccugcacggcuggaccuagaggaauuucucgacauagaggguaaaacaacccauuggcccacauuucugaggaccgacgugggagaagggucacaugaggccaugaaaugggcaucugcagaggaaauggaagccagugucuggagacaaguggagccauugagcuagcaaugcgugauagauacugugggaagggauguggggaaugcagcaccucucaagggagguggcugagucuggcaaugagggccuggggcauccuuagucagcaaagcaggucugcagccucgggagcucuggcagcuggugugggucaccaacuggccucgggcaccauucauggaaauuaaucuggauaguccccuccuggagacccuccaggauggcagaugagcagacuggccggcuuucaaagucugcugaccucuauaauuguggcucuucacaugguccaacacacucuucccuuuuacauguguuuccucuuugaauauuuccaccagccccucucccugaccucucucugcuuuguuacuuuccuuugcccauuuaaucuacauuuuauguuuuguccagauuaacauaccuguguuucaucugccaggcacuggcccaggcccuaggaauaugguggugaccaacacagaguggcugcuuucauggaguuuacaaucuacaaagggacaaaaaggauaaacaacuuuaaacuuuaaaauuuggacaaacuuuuauaaauacugcauuuuuccaauaaaaugagauaaacaaugguauaaccuacauuguacagaaucugugucucccuaaaauuaaagcuuugagauaaaaggagacaagagguauuguuggacuugaauuugucgugcaaauaagauuaaaaccuugaauauuagccuuuugauuguugucucuuuuugcaguaugagguaguugugaauucuaggucaaaacauaaggguuaaaaggcuggaaaaauuaaauaggccaaaugaaagaauugucuugcuaaaaugucuauguagaugauaaaauguccuugugccucuuuaacuucaaugauuugugcuggauauuuuauaagcguccauuaggcaauagcaaauuuauucaacuauaagagaauuacgaaacacaacuaucauaggagauacuuauuuccuuccaaccaauaaguaaccaccagugaugagaaggcagaaagugacaagauuaaccaaguaagagaguuggauacaacauucaacuccauuucuucaugucccaauaagagacaacguuugaccugcccucucauuccuaaucuuguugaaugaaucuaguacagagguucauaaaaaccgucagguauauaaugccggauuuugucaacaaacaauaacaauaauuuuuucuuuaaaaauuauuccaggccaggccgggugcgguggcucaugccuguaaucccagcacuuugggaggcugaggcgggcggaucacgaggucaggagaucaagaccagucuggccaacauggugaaacccccaucucuacuaaaaauacaaaaaucagcugggcgugguggcagggaccuguagucgcagcuacucgggaggcugaggcaggagaaucacuuuaacacgggaggcggagauugcagcgagcugagauccagccaccgcacccuagccuggcaacagagcaagauuccgucucaaaaaaaaaaaaaaaagaaaagaaaaaaauuauuccaggccaggugugguggcucacaccuguaaucccaacacuuuagguggccaagguggguggaccgcuugagcucaggacuucaaggccagccugagcaacauggcgaaaccuggucucuacaagaaauacaaaaauuaaccaggcgugguagugagugccuguagucccagcuccucauccgccuguaaucccaggcggagauugaagugagccgagauggcaccacugcauuccauccugggugacagagccaaacccugucucaaaaaauaacaaaauacacaccagggccugucagggggugggagggaaggggagggagagcaugaggacaaauaccuagugcauguggggcuuaaaaccuagaugaugggucaauaggugcagcaaaccaucaugccacaugcauaccuauguaacaaaccugcacauucugcacauguaucccagaacuuaaauuuaaaaauaaaauaaaaauaauaacauaauaaaauaacaaaaaagucuuuacaucugaaauaaguguacuuaaaauuaaaaauaaaauuaaaguacaaaaacuuaaaauaaaaaucauuuuagauauuuccucagauuuaaauggaggucauugaagcucaaacaccuggcugcaaagugauuuguaagacgaacaccuacacucuacaaaaagacuuaugaauacccugcauugguugaugaacaagaacagugaguuauaccuucugaauagugaauuaaauaaaauacuauuaaaguuuuaaauaauugccaauugcuccauauuucucugcauguuagaguuuagcuaguguuuccagggaugauuuuucuguauuccucccagucaggaauagccagucaguauuacuccaucagccacagcacaaaugucugauugcucucuugaggucguuagcccagauacuugcuagaaagguaugauugcuggccaaaugagcucuggccuggugcagccgucuugccaaugugccuaaugagagcgcggaaagacauuuuauuccaggcauaagcaggccagaucacagcugcccaaagcucucuggcuuugauuaaguuuguugugcuauuauguaauggguacuugaaccauauuccgugaaugaccguuuuccuuccucuuucgccacuauucuaaguauguugucuguaucuaauguugccuugcaguuaguuguuaaaaucaagcagaaaagaaaacaggcaaauauuaaaacguaaauagaaaaaguuguugguggggaaaaugacuuauaaugcauuauucugacauaaugucuugggguccaccaggagaaucgccccaucacaauucagccucucucugugcuaaugacggccuuuucauccugugcuguuagugaugcauaagccaaauugugaccaggcagacuagaccacauguaagcagagaaccacgucuuuguagacauuaauuuaaaacucguucuaaucaaauauguucauuuaucuguacuauuuuugaucuauaucuuaaaucaaaacgaagcuuuuuugacuucugguuucuguuucugcuuguaaagagcuuggaaguuaucaauccugucuucauaacaagaaaaaugcugagcacacugaaagucaguaacuggaaaucaacaguguuuuaaaaguuaauugguuacaauuuucucauauucuucucucaccucuguagaguucuggucuacauuggaaaugcuggaaaaguaggaauauacaguacagagcuuucuuggcagcauaacuuaauacaugaaaaaugauuuuuaauuuuaguuuaaccuuuaaacuggaaucuguagcacauuggaaaaaaaaaaccuaaaccaguugaacaaauuucaauuuuaaacauguuuucaggcuuuggaagcuuacugaagaauguggauagcaaauacaggaaaaauucugugaauauuuuuauucacauauguaaacgugaaguuauaagacagaacaauuuccccauguacaagcuucaaauuuuuagcaguuaguuaacauuuucuauucaguuuuaaccauuaaguuguaauauuauuacaaaugauauuagaacacaucuuugcuuuuagugcuguauuauaaauauuuaaauuaaugacauucaguguaaauuugguauuuaucguaauacaaauaagaacuuuauuuuuaguuaauuccauguguuauuuguauuucuuaucucacauuuauuuaaaauuacauuuggucccuaucacucagguauguuucuucccucccacguagaccuaaucggauuuuuuaaaauuggauuuuaaucugccuuuauaaacaaacgucaauuauuuauuuccaaucuugguugaucuuuuuauuccgagauuauuuacuaguucauucagccuuccuauuaaaaauaaauaaauaaauaaauaauugcucuuguagcucuucugagguagacugaccaggucuaccuuauuguuaauuuuugcauuuucauuuuuauugaauauguaugaugaugcagauaugaaccaugugcauaucucagaauaggaggaaaaauaucuuaguacuuuugccaaaugcuugguucuaauuuuuggacuauuaugaauuuuuuaugucauaacuauuaucuuaacauuaugcgaacuucuagcccuuuugcuucaauuuccuuugaaaagauuuccuuccaauaaaucuuuaaaauaugggugacaaaacuaaaagacccucagaggaaacauauuucugguaugacauauuuuguguacucuuuaggacaauugaaaagcuucuaauuaacauuucuuuagcgccuuaguggugaucagcaguaucaucacugcccuagugcauccauggaaguugagguccaggguguacugacucacacagguuaccuagguaagaaguaauggaugacuggaauguuaggaacuguaaaugacagcuaacuguggcaaagcguaggguuuuguuuuuuuuuuucuugucuugucuuuuuuuuuugagacagagucuugcucuguccccgaggcuggagugcgguggugugaucucggcucacugcacccucugccucccagguucaagcaauucuccugccucagccucccaaguagcugggauuacagguacaugccaccaggccuggauaauuuuuguauuuuuaguagagacaagguuucaccauguuggccagguuggucucaagcuccugaccucaugauccaccugccuuggccucccgaagugcuggaauuacaggcaugagccacugcgcccggccuuucuuuucuucuuaagacaacuaauggaaaauaaacuuccaagaagcucuuuugaccugaccucacugcuccucaaaggcagaaugcugauucacaggcugagggguaucugaccagguuucuuugcuacccuuacucucagccuaccuggaaauugccgagcgcagggggcgcagggagugcuguaguuggcguguggacugagcguccugggaacuguucugcuguaguaccuacacuuuccugccaaugucagcauccggcuugucaacacuucuuuuccauuugugaauacuauagugaaagccuucaccucuccuuucuuugaaguauucucuguucagaacuuggaacuuuagaaauuuucuacauuuaaggaaacauauuucaacuaugauucuuuauuacuuauaaaaaauuaacuuagaagauauauguaaacauguguaugguuuaagguaacaaagugaguuuaccaauauggcaaguugugccaaaagagugcuuaaguguaaaaaacaaacaaagaaaccaaaaucaaaauuaaaguagcucaaaaacauaaaguuuauaaauauuuuuaaggcauuuauaauuuuaaaaaaguccuuuuauguuugucccauguucuggaauagcaaauaaaaaaugugguuuuugcuuuauuuuguuuuauugccuugauaugccacguggcaagccucaggcuggguguguggagcacaugacuugaguguguggacaaguuguguugaagauuauuauuacaggcacaauguuacagcacagucuaucagggaaaaauacuuaaguuuauuuuuuugaggcugagcgugguggcuuaugccuguaaucccagcuccuugggaggcugaggcagaaaauugguugaacccaggaggugaaggcugcagugagccaagacuguaccacugcacuccagccugggugacagggcgagacuccaucucagaaaaagaaaaaaaggaaaggaagaaagaaagagagagaaaaaaaagagaaagaaaggaaggaaggagggaaggaaggaaggaaggaaggaaggaaggaaagaaagaaagaaagaagaaaaagaaaaagaaggaaggaaggaaaagaagaggaagaagaagaaggagggaaggaaggaaggaggaucggagggagaaaacaugguuuacagagguuuuauucacuaggaugguaacauccucccaaguaauuuaguucuagcugcuuuaucguuuaguaaaucucugcaauucaggaugcaccuuucuugcuguugcuggucugcugauccacaugaucuuauuucauguauguggaucauccagccaccgugacaaauguucauuauguugaguccagauguccaccuuaagaguacacaccccucgcugcugcuuuuuuuuuuuaauuaugucacacuaaauacauuuacuuuaugauaacuacuguugggguacaauuuacucuuaccacagaaccagcucucaguuaagaagaaagugcugagaugguguggggaaauuuggugaagaaaaacauuauaguaaguuacagucaaucucacuacugaccuuuggcuaaaauuuuuuuuaauauguggcuaaaaucugcauaacagaugguauaucugagugaagagauuauuagaggaugagagaaacugagaguucaccaaaaauaaaaacuaauaauugcaauauagauuuugccaucaaaagugaccucaaaugcaaguuuguagcugaauugaagagguggccacuuuguucuuaaucugguggcugcugcuuagguuucauuguagaggcuacugagcuguuuugcaaguuuguauuaucugucucaugauccagacagaaccagagucuaccaacguggauuaagaauuagucuguuuucuucuguguuuuucuaugaauauacugaaugucucaucuugauucagaagaaaaaccugaaagcuuacccaaaaacaaacaaacaaacaaacaaacaaacaaaaaaaacccugugugugguuugucuugggacaguucagaaggcagucauuuaauuucguuugggaacauuuugcacuauuuauuucauucaaaauauguuaauuuauuuucgauuuuaauuaauguacuuuuguaauggcuuauuccgcaagcagagauagccucccuucccccaaauucuaagauaugcauguauacagucaucuuacuacauagcaggaauuuuaaaaagaaauaagcuuuucuuuccagugccuaguuguuaaaacagcaaaaugauaaaaauuuauguaaugguacuauugagcugucuacuguguggcaaauacuuuauacaaauaagcaaugucuuaggaucuaggcuuuuagccuucaaaaaucuuuaaagaagaaugaaaugucauuuuuaagucuuguauuugaucucaagugaagagauucaauucauuucaaaaauacuuaauauaaauuauaugcuagacccugugcuaggcacugcagggcaaaagcugaagaaucagagaggcugucaaguuagaaaaguguuucucaauuggcaauuuuuccaacaagggccacuggugaaugucuacaaguauuuuugguuggggguugcagggacuguuggaauuuaguggguagaggucagggguguggcuacacaucuugcaaugcauaggacagaccuucccauuaaagcaucauccaccugcagaugucacuaguaccaaacuuacauuuuguguagcuucagcaaguucucucuuaaacuauucaucgcucucuuuuuucauuaguucugcaguuuaauaagaauauugcccuauggagcaguucuagcacuuugggaggccgaggugaguggaucaccugaggucaggaguucgaggccagccuggccaacaugacgaaacccugucucuacuaaaaauacaaaacuuagccaggcgugguggcaugugccuguagucccagcuacuuggggaggcugaggcaggagaaucacuugaaucuggaggcagagguugcagugcguugagaucaagccacugcacuccagccugggugacagagcaagacaccgucucaaaaaaaaaaaauagcuggagauuaggcaaguuguauauauguaaacauaaaaagacagaaacaaauaaaaaccaauauagcacaacccaccccaucuugaacaaguuguacuucuaaucaugcacaugugaaaacaucaagcucuuauuugaccaccauucaggauugaauauuuagucauugcaaauguaguugagcaaauaaguaucuauuuggaguuuaggauuaggaucauacacuuccacaguuaaaucuacugacugacaguagacaguucauugagacacagauacagcauagucauccauguauagugguugaguaacguguaaguuucuuuucccuuccaacugaaggggaugcucaaacugagauuuaaccaggacaaagucaaucagcuucucucugaaaagggugaugucugaucagagucagcuggaggaucagaaagagucauuuagaaaagucugagggaaacugaugaucuugaguaacaagaaaguugccauuuuguucaccacagaugaaagucuauucccagacaguaaaugaagccggauaaucaggccaauuucauaaacaguagaucagauuggaagaguuaaaggaccagauaagaaaacaagcaccuguagcaggaugacccgaguaacacaaaggaugauucacgcaaagggggugcaaggacuaauucugcagacuccuauagcuuguugugccuugcaagcccaagagagguucccaaagggacugaagccuggcagcauccagugaaugggcucuagcauaccugguaaggagcugucucagaagaugggguguuccauaucccuggagggguuaaaguucaagaacauugcugaggauccaaacacugggagagagaaagaaauggauggucauaaaauaaauccucuuuguucuuuuaaaaauucugagugugggagugaaggugauuuuucagaccaagcccuuggguacugacucauucuuauuccacugucucgggcuuacaucuccaauucuaacuucccaacuucugucauggcagaucagguauuaccauuguuagaauaguacuauagguauuuuguguuuggagagagguuuagugguaggaccccagguuuguaguguguugcuaguuaucaucacaauuuuaugacccucucacuugagaguggaaugacaaugugguuauguaaccuaagacuagaagaaacaaaugggaguacucccaaaacacaaauaucucaccucuuuuuucaugggaaaagagucagcagaagagggcaaagcgguaaauaaaauccuaaagguaaucaaaacagaugggaauauaauuuuguucagagcuauaaaaaauauccucuacuauucucaauacaggcaguguguagaaaguuucaagguuaguauuuaucuucuaaacauagacuuguggucuucuuauuuaaucaauucaaaccaccaguggaagaggucagaaagaaugaaugaaaucaggagaacugauuaucaugaguaucauuguugugauugcauuucuugcacagcuuuaauuugugccuugagaguuuggggucugagaaaguagugcuauuccaagagcucuccagggauauuuuuggaacaggccuuauuguucucuaaaaaauuaaugcguuauauucccaggugcuguuguagcaucauuuuucauuuaacaaaaauauggucguuuagccagaaauuuuaguucuauaauuaaaauggacuaaaaauauucuguagcacaucuagaaaaaauauuuuaaauguaucaauguucuuccuagaaauuuuccauguuggaucaaacaguagaugaagacuuuucuguguguauagcauggguuuuuauguuuauauaugagugugcagguguuuuaagagaauuuugaaaaucagcaaagcaaagucaauucacuacaaaauaguuuccaaauuaucugugcaguauuaauauugaggaagaauuaaucaaaaagcaaauauuugagaaaugcuuuccuaugucuguaggcuacaaaaucauuguuuaauuuaucaacaaucuuugagugcuccucagugucugguacagaaaugaaagauacaguuuuaacuuuagagugcucacaccuacugagggaaacaaacaagguagagaauucaguaugacgagugacaugagacaguugaaugggaggcucucugggaguacuaagggccauugccuaguguagcugagggcacagaggagcugagcugggcagcccaggagucugucaagagggccagagggaagcagugcagggccagcagcgagagcgggacugugcaaaagaaguuucaguagcuacaguuucuuucucaggguccuccacuucccaaagaaaaugaaaggaacauacauuugauuuuugucaguuuaaauauuggucgaccauuggaaaaccauuuuugaaaagugauuucuuuugcuauguuuggcaaagccaggaguaguaaagagaugaggaaggaccaucuucguccauugccuuugccuuuguaacuguuacuucuucacagccuuucuacccaguguaguucacguaugggaaacauuucuuuccaucgucagcgucuuccuggggaguguuuugguuauacuuucacgaaugucucaccucuuugugucaacaaacccuucucuuugagcuguacuguggguuucuguuucuuuccuuuuuuccuuuguccaauuagaaaaaaaaauggaguagaaguuucaaggcuacuaguucaaugugcucuuuuuuacuugacuccaaaugacaucuugcuugcagaugugauuaagaaagaucuggacagggagagggaggauaauuuucaauguuccucucaaauuuaaucuuauagugacaagcuccauauucuacaugaaaaugcucaguuaauacagcuauuaaacuugaaugguagauaauaguggauuucuguagccacuguuugguuucauucaaaaaccuagaggaaaauaagggauauacauuauaaauuguuuguuuaauguuaaaaauauguuucauauucagugcacauaaagcaaagguauuguccaguguuaguaccuaugaaucaucaauaaaaacaguugcuucuguuugcuguugacauuuuauguauguguuguuccucucugaaccuuuuucuuaaaagucaacuuuuaagaaacuuauaaguuuacuguggagagccuaugaacagaugcaugagggggcgccuguucauauggauaagauagggcuauaaaugcccuuaucuugccagggcucuucuaggccucuuuaggguuaaggcauacucccuucugagaauuuguguuguaaccgguugucuagcuucacguccuguuucuauggauuguuuguaaccagcuuuugcugcaacuguuacugcugauuaauaccuugcuaaucauagguuauggaaagacuguuuucuguuuuaaggcucuguuagaaauugcugaugcacacaauauuguaaauucuuaucucuguauacuguacuucugcauacagauauuauguuaaagaauuacuucauccccaugugaccaucucacuucauaaucaaaugacucuaaaucccucacuaaacuacccccacccucacuaaacuuaacaauaaaugcugguauauccaguacguuggcggcaucacaggaccagaaggcagugaucccccuggacccagcuuucacuaaaaaaaaaaaaaaaaaaaaaaagaaacaauaaacuuagccauuauaaucccucagaaaaacauuaacuauauuuaaggauaauaagagaaaauaaucucuuuuuaacauacuuauugauacauaauaauuguacauauuuaugggguaccugugauauuuuguuuuauggauaaaauguguaauuaucaaaucaagauauuuaggauauccauaaccucaagcauuuaucauuucuauguguugggaacauuucaaggccucucugcuagcuauuuugaaauacacaauacauuguuguuaacuauaaucacccucgucugccauggaacauuacaacuuauuccuucuaucuaacucuauguuuguacccauuaauaauuucuuuuuaaagccccagucucaaucaagagaaauauaaauagcaugguaaaaaaaaauuuuuuuugaccugaugauauggguucaauuucugguucuaccacuuuccaccuuggagaccuucauuaaccagugaccuucacuuuucuuuucuguaagaugguauugauaauaucugcccucauccccacuucgccauuugccuagcuaauaagacagagauuuccuuagcauguuguguuaaagaggcuagaaacucaacaugcuuuacaaauaccagcuguaugacaaggaguuacaguaccaauguacaaaauaugauuuuuaaaaugaaaggcaggacauuuaugaaguuauauucuauagaaaguauauuagcacacauuaaugcauaauaggcgauaggacugcacuuugcuucuuucucuuagcuuuucuuuccagccucuuuuucucccuugucaucaagucugcggcuggacuugccuucuguucugcaugccuugguguuugcuguugcucugauucugcuuucucaugcacaggcucaaagaaacagugaggcugccccaaccugugcaacucuccucuuuguuuggauacuuggucauaugcacauucuaguuuaaauuucuguguaacuaaaacauguaugaguggagauugguuuuauauucuguaauaauaaaacuuauuuauagaaguagaauuuauugagguacaaauguuuaccaguuuuaugaauaacaacuuauauuuauuuuauaaacaacuucaaugguauauguguguguguuuucucacaaaagcauauugagcaauuauuuucaauuuuauagucauaaaugauaccugaaauaucuuaagaaccuacccugugauuuacaggaauuaagucauuaaauccuuacaacacaguaaagucuguguuauuucccauuuuacagauggagaaacuaacuacagaaagacuauuaaagaggcaagauaucaucacaguuggauguguggggcuuuguaccagaaugacugaguuaauuccaguucccuuaauuauuaucuuugcauccucagacaagucacuuuaucuuuauaugcuuuaguuucccugucuguaaaacaucuuauaguguuguuaggauuaaacacaucuuuucccuacauggcauuuuagguucucuuaaccaauguuaaaaaaucuauccacauauuuuuagcuuuccuuucuuuccauuacuagaaguacuuucuaugagguaauucucccagaaaauacaaaguccuauuuggugauucacugccuuacauucugguguucgguaacaccauggaauccaaagacaagcuccaucauaucaauuguggagccugagauacuuuacucucccugugagaaagugauuucaaaugaaacucaguucucccauuuauuucauuuugguuaaaacuauagcaggugcuuuucagcuuauugaauguguuaggcuccaaguggcaagcuuaaaugguacauauccuuuuuuuaauuauacauauauauacuugguuugacuguuuauuuccuuuuccacauuauuauuugcauuuaacagcuaaagguauaauaucaaauuauuuuauuguuagauguugaaauuacccuggcuugaagucagaaacaacuuuauuaaaauuuuaagagaacaguaaaauguguugcaugugauucuaaucaauuuuugaagcacuuuugucauugagaaaauaaguauggauaaauauugauuguuuuucuggaaaaugcuuucuuauuucaaaagucagcugugacucagucuguccuccucugucaugacaggaacuaguauauucaccgucuaugaggccgccucacaggaaggcuggguguuccucauguacagagcaauugacagcuuuccccguuggcguuccuacuucuauuucaucacucucauuuucuuccucgccuggcuugugaagguacugcgaagaauuguacuaagaaagucuauguucugugauaguucugcagaucuuuuguuugguuuugguugcccucugcuuugucauucuuagacuuugguaaaugugguuugugauuuuuuucagaacguguuuauugcuguuaucauugaaacauuugcagaaaucagaguacaguuucaacaaauguggggaucgagaagcagcacuaccucaacagccaccacccagguacgcuaucagcaagaggauguuauaacccauucgagcaugcacaugucucacccucaccaucaguggaccuuggggaagcucuugcaugaugggcuucuauagucugacucaggaagcuguuuaaaaauacaguugccagucaggcacaguggcucaugcuuguaauuccagcacuuugggaggcugagggagagggauugcuugagcccaggaguuugagaucagccuagguaauguagcaagacccugucucuacaaaaaaauuuuaaaaauuagccaagaguaguggcaugagcuuguagucccagcuacucaguaggcugagaugggaggaucacuugagcucaggaggucaaagguacagugagcugcaaucacaacacugcaccccagccugggugacagagcaagauccuauccccaaaaaacauaaaagaaaauaaaauaaaacagguucaaaggcccaaacacagaacaaucaaaucagagcuuccaggcagugagguaaugacaccuauauuuuguaacagcuccgugggugguuuugauacaaaaccaagaucgucaaccacauuuauuacauaccuuugauucugacaucacaaauccucaaauggcuuguggauaaaaugcaaccacuauggaauuucuuacuuuuauggguauuuauucauguacuugcaagccuauguaaugucuauguguaggauuagaauuuuguaauggaaaauauauuucauucagaacaaaccacaguacaauaaacuaugaaaaagaucccucaaccccaaaugcauguuugugauuuuuuaaagaaucccuauauauucagaaggauucccauaaguuccauagcaauauuguuuccauaaaaccauaaggcuccugagaauuugaaggugggcuacagauuugcuaaaagcagcagggcaguuauuacaaaagagggcaauucagauccaaugccuuuguuuuuauuuuugguuuuguuucacguguguguuuuugugguguuaaaaaaaggaagggcagauuuguguaucuucuucuagcgugaaucuuuauaaaagagagagaaaauauaaauuccagaaucaggaauaaaaugauauaaugccuuguaauuauuauaauauuaaauucuaaaggauauuuaacaacuuuguaaacacuuacaaauacuguuaagacaaagguaucuaucaaggagccgagguguacaaauuuuacuuuugaaaacccucaaguugagcuuuuaauaauuauuuguuaaaaugcaauuaaacacacuaauuugggaaaagccuggugguguugaggcaucuuuaugaugcuguaaaagucugaauuguccagucaauucauuauagaugaaauagugucagucuuauucaguuuuuacaaacaacuguucaaacuuccaugaaagguuuuuugaauaugcuauccagguuauaucagaaaugccauguagaaaagccuucaagaaaucaaccauagcaaguucucaucuccucucuccucucuuuuugcaaacuaugagagauaagaaaguucccgguccauuccgagguggcagccucuagaaggacauguuuucaguuaugacuuugagaccuaaauggaauauggaacuaugaucucagcccuuaacucacaugcaguguuccuggagaugaccuaagauuccuuuaaaaccauaguauguuuauggaguaacucucacguauaaaaucacagcuggaaaaaauaguguuuggaagcaccaccaagucaggcaaugguucuaauagaaagggaaaugugaagagacuuggaacaaaguuguacagaaucauuuugaugcaaaauuguacuuaaucaagaggaauaaauugguaauucagagguaaugcgucuagauauucagcagugguaaucauacagagaauugugaaaaaccuucauuaagaaaaaugcuauagcugaggaccugguugcuaagcaaccaaagcuccugcugucagccucugggugaaacaccacucaggcagccuagcaacgagcuucaggccccgcccacccuggcuagccacuugcgagugggcccucugaugcuuuuauguguagagaagggagagacauaauuugccaugaugcuauuauguuuguaaaauaugaccaaauuccgugaacagggacuucucauucagugguuuaaaacacuagaucacaaguuacuaauuugaaggaaauaaaauaaagaugauuauuauaaugcacacagcuuuucaaacauggaaguacauucuugccuuucucuagcauauggaaaauuugcaguuguuaaauauaggcuauucucaucaaaggacuaaaggguccugggcuuguuggacuuguugaugucuaagucugcagacuucccauaacagccauguguauagaaaauauguguauauauauauauauauauauauaugcacauuuucagaacaaagaaggggcuuucuguuauauuaggcagcucacuaggaacuggcucugacagggaccauuucaagggaggcgaaaggaaaucugugaugagaacuguuucuuuaaaauaacgaagcaauauuuuucaauugaauggucaccaccaaaugccuccaagacacagcauaggaacaaauuacagagacauuaaugccaagggucuuuaggagaccauaauauaacauguaacuggaaaacagaaggaaaaugauguagaaaauuucaaauuacuaaauauugacucuggccucugagagccuugugauuucauaccugccugauucuuagacguggguaacuauugccuugugcucaguuguggauuggguugaaggauaagugauucauacacccaugauauaauacccugcuuuguuaauccacuauaggguuacccaggccacaacuuuuuagugaugucccaugacuggauguugggaugugcaggugagcugaaagacgaaguccugaguaccguaucucacuaacccagaccuuuacucccauuauuuagaugcuuuacuucagauaccuguuaugagccccaugguccucugaucuagacuagcucaugauggagaugagcuuaucccaacuuugccuugaguagaacucaaagaacugcuaaauuuuagagccacacaaggcuacuuuucuguuaaaaugguaggagacagaaagcaggcuucugacagucaauacauaucuaacuuuuauaaaugaaucauaauccaauaggaucauauugaagguuugguaaauaauuaaauauucugauugcacaaagacagcaaucauuucugggucuguuauuaucucugauugagcacucuugcugacauguguuuucugaauuaauauccccuaauuaacagagaagacugauaaagguagaacuggugugggaagaaugggcacuuuugaguuuuucuccuuuggguuuccaucaacauucuuagaauauggguuauacaaugccuaaagcaacuugugcauaaauguucagugcuggguuaaaaaguagagaaaaaauggaugaaaagacacaugauccaaaauggaaagaauuucuccuccaaaaagaaagcuacauauaacuuaaugcucaaagaaaauacuuuagcaaaaauguguuuacuguguuccaagaccauuuauuuccucaugaauauacaucauuaaaauaugugagaaaacaauucaauuaaugcauuucagggaagggugcuucuagcaugguguaauaaugagugccuucuaauaagaaaccauaauaauagaauaguacaaucaucauaggaaaccauaaaugagaauuaaauuuugugagguugcaucauugaauauauuauuucguaaugaaaucaagccagguauccacuuucacuauuuucugucauagugacuauuagcuauuuuuugaaaaaccauaaauuuucaaagaauccaaagagcaugcaaauugcaaaguaaauuuuagauuuucucugcauuacuguguauguggaugugugugugccugucuugaguuuggaauucuaauucagcugcuagugauucuccauuaccaagauucuuucucuuaccacuauccauuagauaaccuguuauucauguuguugaugaugaugauauuaugccuauaauggaacaaucccagaagcauuuuuagcuacuuuacaaaccaaccgaccaguuauaaaacuguagcaguugcaaauggacaggccugagagaauucucaaaguugaaaucuccaugcgcuuccaaaugauugugcuaagaggagagugccauggaaauucauuuguguuauuggugagauucuacuaauucagaacaucuucuuacagucacucccauauauugagaucugcacuagucuaauggcuuuacaaacugucuuauuuaauuuucauaauaauacugugaagugggcacuauuaaugucuccacuuugcauguaaaaaaugacaaugauuggaaaguuaauuaucuaacccaauguuauauaacuggcuagugguaaaacugggacucaaaaccagguugcucagcugcaagagccuuuuuauucagcaugagaugcuaccaccuuucaauuuagccauuacaagcccugcugucaacaugcugucuuuguucuggccucauguuaacuuuucuuuucuuaaaaaagacaguauuuauugcuggcugaaagggacauucgcauacauuguugccaagaguaugaauuaaaacaucuuuuccagaaaaccguuuggcaauauguauccaaaaguaaaacauacauacuaucugaccaagaaaguccgcuuuuagaaauguauccuaagaaaaauugggggcaguagccaagggcauauguuugaggauguuuaugaggcauuauggcaauuuuuuaaaaauggaaacaaucuuagucucuagcaauaaguuaucgauuauaaauuaugaaauuggaauaaaugcaaaccauuaaaauaagaauugaacuuuauugaugugaagauaugcugaugacauauuaguacaaaaaaagauccuauguuugucugugggaugcagguguguguguguguguguguguguguguguguguauaauaccuggaauguuaacuguaaaauguuagugguggugucucuggggaauggguuuaagcuguuucuuuugcaacucauccucauuuucuaagccuuuaauaguaaaauauuuaauuauagaaugagaaaggaaaauuacaucaguaaaaugaaaaaaaaaauuaauggacauucuaacagaaaccacguauacuaguuaaguuacauucaguugcaagggacaaaaaagcccaaaauaaguugcuuaggugacguaugcgaugaggaaucccauucucucucauauaaaguuggaggugcucauucagcaugguaugguugucuguguugccacggauccagacaccuuccuuccuguuccacuuugcacagcccccauuaccacagucaccuuguagacuagcauggcugcuguagcucuaacccucacauccauaucccagagagcaggaagaagaaggaaauacaggaaaagaggguuucugcuugcauccuauaguccuguauguaguuacauggucaagcucagcuucaaaaaaagggcaagaacuggccuuuuuucuugguagccuaguggccccauacagauucucuuuguaaaacagggaaaagagauacaaaggaaagacuggcagucccugccacgcuccccgcaaggauuugagucucugaggauucuuggcuucugcuagcuagcccagcuucugucucaaagaucuacuguaauauuaaccaaucuaaauguuguauaauucaggggauuaaagagaaauugaacguuuuugcauuuccuuuacuuauuucauacaaauaagugaccuugggagaacacuuuuacugaaaauuaaauugauucuuuugauuuuggucuauugaaaaaaaaauuuaagagagaaaauuagucugcuacugaucaaagucaauauaugccccagggauccuuuaugccacaauuagagaguauaggauguaucaacagaggguuuuuauuaauaacuggugacuggcaaugcugguuuugucuuuuauccuuaaaaugaggcuuccagaauuuugacagaaacuuuacaagguccuauaacagguuugcaucuccacugaugucuauauucucagaaugagcuauucaggaagaauaugcuugauucaccccaaaaagaguuuuugcaguuuauucuaaagaaaaucagaauccuguaaauggacagcugagaugagcaauuugcaguuggcaucuuugucaaaggagcuuuauguaaaugugcaccuuaauuuugucauuuaaaaauacauauaggaggcagaagcugggggauugccugagcucaggaguucaaaaccacccuggacaacaagcugaaacccucugucuaguaaaaaaaaaaauacaaaaauuaguugggcauuguggcgggugccuguagucccagcuacucgggaggcugagacaggaaaauugcuugaacccgggagguggagguuggagugaguggagaucacgccccuacacuccagccugggcgacagagcaggacucuaucuccccccaaaaauaaauaaauaauaaaaauacauauagggacugugauuuuuggcaacugucucucaccaccucacucauuuuauagaaggcaaguuuauuuuccacaaaggaucuaccaccacuacuaccagggauuugaaacucuaauuacaaauccuagguaaugggaucuuugcaucaucucauucguauuuccaucagcaguuaccccuucgaauacagggucagacuaacaggaggacauaaauaagggugacaaaggaaacauuuauuucuguaaaacagcgaccucagguaggaaugaaacagugagcacuuguaguuaguaucauuauuuagaaaaacaaaaauguuuaauuuugcccuauuccuaccauacacacauacacacacacucgcuccuaagaacuagaaagaaaaauauguuagugggaaaauacgugaaagugggaaaugucuuccagcuggguguaauauugacacauagguaauaugugaugauaccuaggagauaauagguaccuaggagauaauaaccuagguaucuaauucaauggauuucagauuuagugggccuguagcaucuugaauuucaucacuugggucuuuaauccaaaagaaacuacuuguucccuucauaauacguacauaaaauuucugcugagcagguuaauugcugccuaguuaaaauaauuacacaaaguguauuaagcaauguggcaaucuucuaccauuaaaauaacaccaguucuuucccuaugccacacgcacacuucuuauuuuauggauccugagaauauuuuuauuaggucagugcuccuguucagccuugaggguaagauaccaugguaguccaagccagggaguggaagacuguccacuaaauaaaaauaaaaauuugcaaccuauaguaaaaacacaccagacacaaugcuuuuaaauucugauuuucauuuucucccagaucuaauagauauuuaucaauauaauggggauaaaauacuaaaguauuucucuuguggagaagaauauuugagcaauuauaugcaaagcauaugcaagacagaaagugccugacauagcaaguagucaauaaacucaaguuauuaucauuguucuuuuuucauucauuuaagcuuucaauguuaaagaacuauaauugaaaugacuucauuccaaauauaaauccauaagaagacaaauuuuugauaacauaaaaauauacaaagcuggagacauagaguucucaauguuccauauuaaaugucucugacucaucucccuucuuugucuugaagauguuucaugaagaugcugcuggagguuggcagcugguagcuguggaugucaacaagccccagggacgcgccccagccugccuccaggugcaguacaaugacauuuuuaaaaaucgcccagcaaaggucuuugaauuuuauuucauccaagaaaauccacagcucuuuaagcucuagauuuguccaaauuuaaaauccugaaguuagagaugguauuucacuccuuccucuauucccaggaccuagcuuuuuuuuuuuuaacauacacaauagggauuugauaaguuucugauggcugcaggcauguaagagcauuucagugguauugaaucaaugaagaauuuuguugacaugugaaaucuuauaaaaauauucuuuaccgaaggacugaguuauguggcagugggcaaauucauuguuucauaccuccccgaguaacugggaaaaauauguuaauacauagucucucuguuuuucugcauuuggaagcuuucagaggaacauaauguagagguguuucuuuagcaaagugcacugauagcaaacauaaggauugcagguggggccugagaguccucaugagauagauucucacagugauuagaagauggagucucacgucccugccugugaacuuucuggaaaaaccaucuucuccaagcugccauugacaacaauauggauaacaauaauaacaauaaggcccaauaaacuccuuuaucucuucuucagggggccauacugacaucuucucuuccuugguuuccccuccuugcccccuaaauaucaguaacucauucaaaauaaugucaccuuaccaagagcagcaccccuaacuuuccauaauauuuucacuuucauuuucccuccaagcagcccacucguaggaccggagaauugauucuuccaccuggagaauuuuauuuucuuuagccuuuuugguuuucagugacaaauccucuucucgcaaggggugguuuccauaguuguuuauauccugcccucauaauuuggagaaguguucacaucugccgugggaugagacuguaucucuuuucuuucuuuugggucuuucuccagauagggacuucuuaugcaacucaaggauggguacaugaaaaauaaaauuguacucugagccauuacugugggcuauguuuauauggccauuuuaccauagaguuauuuacuucuuuuuguuucuauuuguauugaggugugauuaacaaauaaaauuguaaauacuuaagguauacaaugugaugauuugauauauguacacaguguaaaacgauuguugcaaccaagcuaauuaacacacccaucaccgcauauauucaguaguuaccucuguguguguggggugggggguaacacuuaagaucuaaucuccuagcaaaucucauguauacaauacaguauuauuaaccauuaaugaaucacuuuguuuauuagauccugagaacuuggccaucuuuugacugauaacuaauaucuccccauuucuacccccuguccccagccccugguaaccacaauccuacucucugcuucaaugaauuugacuuuuugagauuccauauauaaaugagauuaugcgguguuugucuuucugugucuaguucauuucacuuagcauaacguccuccaggcuuauccauauaguugucaauggcaggauuuuuuucuuuauuauggcugaguaauauuucauuguaugucuauaccacauuuuuuuuauccauucauccaucaguagacacuuagguuguucccugucuugaccauugugaauaacgcugcaguaaacacggggcugcagaugucucuuugagauacugauuucauuuccuuugggcauauauccagaagugggauugugggaucauaugguaguucuauuuuuaauuuuuugggaaaccuccauacugcguuucagaauggcucuaccaauuuaaauccccaccaacaguguaaaaggguuaucuuuucuuuaugccuuugccaaauaguuaucuuuugucuuuuugauggugaccauuguaacagauaugaggugauaucucaaugugguuuaaauuuguauuucccugauaauuagggaucguaugcacuuuuucauauaccuauuggccauucauaugucuucuuuggaaaaaaaucuacucagaauuugcucauuuauaaucagauuauuugcauuuuguguuuguuuuuguuuuuuaguuugggggcuuuuuguuauugaguuguaugaguucuuugcaucuuuugaauauuaucuccuuuucagaaauaugguguuccaauuuuccccuguuccauagacugccuuuucauuuuguuuauuguuaguuauuuauuucugucaguuuaaaaaaauggagggcaauaaguagaaaagcuuacaaugaauauugauaaguauuauuuugugguccuccuuccauccuauauuugauguugacuaugcugcuaauauaaaacuacuacaacuaccuuuacuccuacuaucacuacuaauaguaauaacaauaaugacaaagauuauaguacuagcuucuuaccuaaaaagcacuuuuauugacauuauuuuuuaauccaucaacugauauuuacugaguaccaacuaugugcuagacacuaagauagucuugaaagaaacaugcacagucuccacacucauagagcuuacaguaugcuugagagugggagggaaaaaggcagcauugagcuagcaaucacaagagugauguggguuuugaaagaaguaaugcaagaugcaaugagaauauauaaauugggguccgcuuugagaggucagggaagguuuuagugcauaaucuuaaaaucaaaaccuugaguaauuccagcauuuugggaggcugaggcaggcagaucaccugaggucaugaguuugagaccagccuggccaacauggugaaaccccaucucuacuaaaaauccaaauauuacccagguguuguggugcacgccuguaaucccagcuacuugggaggcuaaggcacaagaaucacuugaacccgggagguggagguugcagugagcugagauugugccacugcaauguagccugggcaacagagugagacucugucucaaaaaaaaaaaaaaaagagagagagagaaugaggaaaagaaugacuaaggaugagguuuacuacaacccugugauguagaaagaccuacaugccuggucagccauuuauaggagaaagugcugauucagagaacauagggaugugaauuacauucaaccagagggagaacccaggacuaauggcugggucuuauggcuccuagccccaugcuuuauccagcugaaaaaaauaugcaaguaaucauaaguucgugauagagaaauaaacuaucagggcuacucugagugccaaaucagagucguaugguauccagagcuuuaaaaucuauuaaauccuuguuaauagaugccucaagguggccaucugaaauuaggaggcaagucagccuccuuaucacaaagauuugagaauaacaagggauuaaugacagggugaagugugaugacaaaaucgagcaaggagauaguaaaauaaagauuggaaugguguggggauagauguugggcuugaaguguauagauguggcaucucagagaccccuauaugagauauguguuaugaauauagcagcaugcuuaugacaucuuaugaaugugacucauaugcuuagaaacuggggggaaaggggucagguaauucagugugacacaaguuucauuccacucaacuucauguguuuggcccugaauaaagcuuuccagaggcagcaaugaagagugcauggaagaaaagugggauggccaagaaguuaucuguuuguaccgggcaggagcugugauuagagagagaauacauuucuaugucucagcaagaaaauaauuaauuaauuaaaagaaaagaauuaaguaaaaauauauugaagauaaaaugguccugaaauacuugauggcuuucacuaaugauuaaugccaucuaaaacuggguaacaggaaaacuuucaucucagucuuccacucccuggcuuggacuaccaugguaucuuacccucaaggcugaacaggagcauauaccacuucuuuuuauuuauuuauuuauuuauuuauuuauuuauuuauuuauuuuauuuauuuauuuauuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuaguagagacgggguuucaccguuuuagccgggauggucucgaucuccugaccucgugauccgcccgccucggccucccaaagugcugggauuacaggcgugagccaccgcgcccggcccuuuuuauuuuuaaaacaagcaaaaugugaacauguucucauaaaaaauuaauauggaaauaaaauuaaaaggaagaguuuacuugaaaucuucuuucaauguauccuuccucauucuucuuccaaugaguaacuuggagguuaauguugagucgauucuucucagacuccugcauuuaugcauuuuaucucacaugaaaaagcauuucugccuccaggaagcacugacauuuucacagaauguuuccucuuccuacaccacuuccuucucacucauccuucagaacucagcucaaacaucacuuucuuauccucaaaaaauaagccagguaccucuguuacauguuuucauaucauccuacacuuuucuuuuaugucugucauaauuuuaauaaaauaaauuaaggauauaauuaguuguugaugucugcuucuccaaccaggggaaauuccauuacuuuagagaccauaccagucauggucacuucugcaacugugcuuuagacaugagagaugaucaauuauguuuauuaaccgagaacaguccagugaaagaaggaggcaguaccuucuuggcuuaugaaaguacuuauuugaccucucgcuuagaagcugcucuguuuguccuccuggucuugucuguaagaacuagaaauugaauagacuguggcaauaacacccuuuuccauacagaacacuuauuucuauaugcaugucguuggagucuaaagcaagcaguacacuuggaguuugcuuccagaaagugccucgcagagguuguaggacuuuggauaucucuggauaguuuugccaggaugucuccucuaauaugugguggcagagccuuggcaggacauaacccugacuucuguuauguuucaccucuuucagaacucuuuucaucuuguaagcauauaagauaaauuugucuuauguuuagaaauauaguguuaggaauagcaucauugaaaagaacccaaacucauucuuuuuuuuuuuuuuuuuuuuuuuugagacagagucucacucuccugcccaggcuggaauccaguggcacaaucuuggcucauugcaaccuccgccucccagguucaagugauucuccugccucagccuccagaguagcugggacuacaggcaugcgccaccacgccuggcugauuuuuguauuuuuaguagaaaccggguuucaccauguuggucaggcuggucuugaacuccugaccucaugauccgcccaccucggccucccaaagugcugggauuacaggugugagccacugugcccagcugaacccaaacuaauuguauguuaaugagaaaacagaguuuauuggaaugaaacauuugaacggcuguacuuuguaauuuugaaacuguugaaauaaauuagaaaaaaugagguaucaauaauaucugagagacagcaaacugauguuugaguucccauuuaacuacugggaacuguugauuuuguucaaagugggacuuuguuuuuaaauuugacccaaaguuuaaaaaccagaguauuuuacauaaaaacccacacguccuacccaucuuguaaaagagaaugaucuggcaauaaagagcucucauuuccaccuggcuagaguuggccagagcugagugguggcugccacaugagcagaggcagagaggcuuuauugugccucaguuucccaacucuccauauugucuccacagcacuggaggugaguguuuuaccuacccaagaauucauacauuuauuuuucuaagaguagagaaagauuucucuuuguccgugacucuaucguguggaaauaaauaaacaaguaauaaauucauaaauauauaaauguauaaagauacacaaaugcauggaugaaugaauaaagaauaaauacaaggcauuuuaaaagcacccugugauuacagaaaacaaugagaaaugaaccuaguauuuuaagaaaaaaguuauuccgauguguuaaauauguaacccuaagccuaguuuucucauuauguuacuugcuaggucucaggaggcacuugguugggugacucacggaauaaaugaaaauaauguaacuuuagaucacaaagauuauauaauaacaauuaguccacacauuucagugauuccaaaauaguauuuucauauauuuuauguuuuuaacauuuuaaaauguuaaaaucauaacucagcauaauuggaagcuggcucaaguucucuuauaaaugaaauguacuaaaaaaucaaaacugucuccauugguauuauguauuauacuuuucaccauauuuucuacucuguauccucauccaguuacuauaaguaauuagguaauuuaauaaaacaagauugauuaagguggcuuaauuuuccucaccauuauuaaauuaaauacaugaaguaaccaaugcuucugugaugcugaguuuuuuacgaguaauaauuuauucucucuuucucccucucucucuauguguguguauauauacacaaacauauauauacacacguuuuuauauauacauauauaagugcauauguguguauauguauauguguauauacauauauauagaaacauugcuggcauaaaacuauuaggauuuuauauauuucaaugggcagugauucugaucacacauuagcaacuaauuuuaaauuguuuuccuacauucccacaugugcacauacauauuuuaccuuauaucaaauauuuccauuauuaugguauuuguuuccucuuuucaaauauugcuuauggagauagucaaugaauuagggcacauaaaagaucuucuuacucuucuacagaaaaaauaggcucuauugagccauuuguggaggagaauauaggcaucuuuugucugcaguuugaaaccacaaauuuauuuuguguucugaaacacaaauuacaauuacaaucauagcuauaauuauaauuagaauaggaaccauaugcaggcaugcaaggaaacgauucaaucuggugcccuugaagugaucuuucuguuuuuauaauaaaugaaaaugcacauacuuguaaauuuaacugcaagaccacaaguuuggagcaggaggacuagcagaaagguauuguuagcuugguaaguuauauguggugagcucuuuaacgccacuuguuaaaauuuuuuguuaaucaacuuaauuauauuaauuugucuaggacauuucucauguuuauccaguuauuaaugaaauuuauaccaugcuuaauaaggcugaguuuaauaagauacugagcaugguaaaugugugcaauuccuaauaaauuuauccucacguuaaaacgaguaagcgaauguccuagaaccccugaaaaacccccucccauccucugucaugccugcaaugucuuucuggcucuuucucaucucugugcauugcugaugugcuugucacuuaggggccccucgugccuguuccuuuuuuuuuuuuuuuuuuuuuuuuuuuuuugagaaggagucucgcucugucaucaggcuggagugcauuggugcgaucucggcucacugcaaccucuaccucccagguucaagcgauucuccugccucagccuccugaguagcugagacuacaggcgcccgccaccaugcccagcuaauuuuuuguauuuuaguagagacgggguuucaccacguuggccaggaugaucucgaucuucugaccucgugaucugccugccuuuuccuguuuuugguccauacuguggggacaagaugacucguggugaaaaagaaaagccuaggaacauagauaagccaagccccauaccugguuucuuuuccuuuuugugcuacaacugccuaaaugcgcaucucccaacaugaccuccucaccucucccuucuuccuccccagcuacagaucuccuuaucuucaccugaugcauagacacccaacacaacaucuuguuuugagacuacacgcuauuguggucuguuagagauaagacucuggaaacauauuucagcuacacuaccuaccagugguacgcgacaggacacguuuauggaaaauggggaugagaaugcaguuuuccuggguuugagagaauuauugaguauuuaugacuuaguaaagaauuauuuggaaggaacagaccaucugcucaaagggaacauugauugcaagugucauucggccuuucucugccugucucucacucuccguuugagccacaugauuucugucugugagccugccucuguuuucucaccuugaacacuggcuuuauucuguuuuguuuugguuuguuucucuccuugcauauuacccaaguauggcugauugugacuggguguaaugaccucccaaucaaaagcccuaacgagacuccccagaaaacacccaaaggugaaggugcacugggaaaaaaugaaguugcgugggggcaucagaaacaggaggcguggccgggagcagcaggucaggagagugcaaauggaaggaaagagcaggucugcugaagccaaguauuggauuucccugcagagcaaacccaaagucguuugaaaccgcccuuuuuaauccucucugaaagccuugccccaucucugcuggaaccacuacucaaccacccuccuuagcuucauggaaugggaggagagaggacacaacucuuuggccauacuaaguggugagacuugacugcaguacuuacaacucagggaucauuuuuccugucaaacuucuaaaucuuauaggacuugagaaguuuauuaagagcuaaaaaaauaggcuauuacagucucaccugaagcucaaaucaugcuguauaagauaguuucuuuagagaaacaccacguaguuacuauaaacuuacaaauggacaauuuguaaauuggugcuauuuuacaacauaauauuaagucgauuuccuugcauuuaaaaaauacauauucugaaauaauuuagaaacacagauaaaaaauaccuaugugucugucagaaauaauaauagcuaauauuuauggaccacucacuguguguuuuauuagguauuaaauuauuuaaugcucacagcaccauaaagguagguacuaauacgaucuguuuuacaaaagaggagguugaggcacagacagcauaaggaauuugaugaaggucacauaguuacugaauggggauuucaucucaggcaguccacguuauacuuuuaacuacuucauuuucaccccuguguauuacccuacugugaaaauaacccaguuucuucauucauuuauucauuccacuaucgauggacauugagcuugauuguuuugcuauugcagaccuucuaagaccuuucuuauccgugccuuuguaugcacacgugagagagguguucuaacauauauagcuaggacagcaauuucuggguuaaaggauaugagcaccuuugacucucugagauauggcagauggcucuccggaugauagggcuauuuuguaugccuucuagaaacguguaagggugcucguugucuacaucuucaucugcacuugauguuaucaggcuuuuacaccagaugacacgaaaugguguccuguaauguaaauuugcaucucccugaucucccugauuaauggauguugaacauuuuuagguucaagggccacacauuuucuuuuuuuuuuuuuuuuuuuuuuugagauggagucuugcucugucgcccaggcuggagugcgguggcgugaucuuggcucacugaaagcuccgccuccuggguucacgccauucuccugccccagccucccgaguugcugggucuacaggugccugccaccacgcccggcuaauuuuuuguauuuuuagaagagacgggguuucacuguguuagccaggauggucucgaucuccugacuguagauugcuuguuuaucucauuugcccauuuaucuguugauuuuucuaagugauguucaggaauucugaguguuucuaaaggguauauuguuucuuucuaaauaaaaauuuaagauauuagauauaaagacaaaucuaaaauauuaaaugcuugacacaugugccuuuuucaucucucccauguuuagucaauaaggcaauucuuuuaugugguauuaaagaaaccgauuagaaaguugcuucguugugugcuuaagugugagucuuagaaaggugaaaaguuauaauugacucuuuuagcaccaaaccaagcagguauauagcuguuuaaauacuauuuuagcauaagccauagcugugggaagggucacuccagugcuugauaaauagaagucuauucaauuggacccucauuccucagcggcugcugugacaagccguuuucccgcugcugcucagguaggaguuuucaucucuugacacuuugacagauguggcugcacacuuuugaaccaucuuccaacacacccccgugcucuauuaccaugaggaaagucucugacaagagaaugaaaguacauaugcaugagacgugguacaauggaugucaguuucccucugguagcauauuccaccgcgugccuccugugaggaacagagggagguaacaggugcuugcugaaaguaggucaaacgguggcgaaauuauuccuucaguguuuuaaugcucuuugaaaacauuuccauugaaggcuaagauugaggggagguggccugugugaugugagcauuucaagugacaaagugacauccuaggcacuccugaaacugucuucuucgugaaccuucccacaaacuggcagaucauuucaagaauugauggagcccaugagaauguagguucccuccagaacgcagcucucuccccagcccauucccacaaagaaacuagguuuucccugcauuuccagaaaccuccaaaccaacccauuaugcuucuccuuuuguccucuccaaauucaaucugauccuucuucaauucugucauuacuucaguauuuugauauuuuuugacucauucucuccacuccaucuucauauuccugcccucaaaaucaggucagugcuuccucaacagagugaucucugauuccuugauuauauuuggucauuuucuuuuuuguuucucuuucuucucuauugcuucauucacgauaggcauuugccaaaaauuuucugaauuauacgugauuguacauauccagcugcguucacgugcagaaaacauagccucacacacagcagacccaaauucuuacucuccccuuaggcaggugucaaacgauacuucccccaaaugcucacgcaugcacgcaaacagagacacacagucaaaaacacagcaugcauguguacacacacauacacacucauacaggcucacacaugcaugcagagacacacagucaaaaacacagcaugcauguguacacacacacacucauacaggcucacacaugcucacacgcacacacaccucaaacacacacagugacacagacacacacaugcacacucgugcacauacacaugccuacacacuuauacaugcucaugcacgcucacacaacucacauguacauacacacacagugacacacaaucgcagacacacacaugcacacaggcacacacacauaucuacacgcacaugcucaugcacacacacuucacacguacauacacacagugacacacaaucacacgcacacacauaugcacacaugcauauggcuacacacacgugcaugcucacacacaccucacaaugcacacucacaaacggugacacacugacacacacacacaugcaugcacacagacaugcauacacacgcuuauacacacacacaccucacgcauacucagugacacagugacacacagacauuuacaugcuuaugcacacaugcacacacacaugcacaaacacacuuguacauaaucaugcaugcucacacauacacacgcacauaccucacacacacacauacacucacacacaggcgcacacacauucauuuucaauuucucaggggaauauaaaacaacugcuuggaggaaaaguuuguaggaaaaagugaauauaaaaaugguuaugcaguaauuaccuggaauaaauauuaaaaccaggaaaaauaaaauagcuacauguagaaagggguagcuaaaaugcuacuugaaaaaggccuauuguaauuuugaagucaguggccaaauaaacuaaacagagaggccaauuguauaaauccucaguucuaaauaucccauauauauuuauuuaaauauauauucaauauguaucuaauauauccugauuauauuucaaauaauaauuauauuuagaauagacaccagaugaccaggcauaggauaauaaaaaauaagauuaaaauaucaguguuauuuuuauuuauuuguuuaucugucuuacuggcaauuaaacaguuuugcuucuuugauuuuuaaaccucacuggaagaaauaugcagaacauuuuaaaauuauuugcaugccacauuaucucaaacuaaauuccugucuccuauuauauuuucauccuccaguuugaaucaguccuauaacucuugaauguuuacaauuauauuaauuaggagacaugugcuaacuuaugccaagcauuuuuaaaauguccauuggagacaaauuuccaucaccaaagauuuguugcauugucaccuuuggcaaaaaugaaggaugaguuuuucuguuuguucguuugguuugguuuugcaagucuugaucuccagguuaaauacacagccuucuuuaagacuuaaacccaggguuugaaagugcuguguauuuucucaguguucaacacaaucugcaguagaaggguuuggagcagcaauaugaugccuuaugcacucuaaagcugcugacagguuuagacauaaucuaaaauguaagucacuuuguguaucaggcaguucaguccuucgcauuuguuuuaauguuuuuccuaaauacucuaaauauuucaaaaugagucuuuccuuaaagauucuacauagcucaaaauuauuuuauuuauguaugcauuuauuaaauaucacaagugagguccugcauugcauuagaaaugcaguguauuagaaaggacagcuagcuucaauuuugaauucauaauuugucucuugaguuuaaaacaaaaguuuuguguucaacugcccaccguuuaauacuaaaaauaaaagaugaacauaaaagucaauuugaagugauucuagauguaggaauuuaauuagcugugggaaugucaaugacaucucaaaaccaucauggcgucgugucaccugucuagcagcccuauuguaguccuuccugacuucucacuaacuuacccaugaagacaaagauaaagaaaaacucacaacaauacagguaacuaagaaagcaccuuuugucaaagucuguugagauuauucaguaacuaugugguuggcggaguacuagugagaaaaauauaaaacaucauguauauucaaauuguuuaaucuaaugcguccauccuuuuaggaacucaguacugaagucuaggaacaucaggcuaaaaaaaauaaugguuggauuuuucuacucuuucuagacaccagggaacaugagagaaaauuauuguggaaggacuaauauucuuauuuuuauuauuaccuauguccagccaaguaagcaaggucaacacuucaccguugaaaagccaagauuuuagcauuuucauucuuaauuuuuacucuaguauuucacugacacuugaguguaugucagaaucagagggucaugaagaagggacagcccuggugacugccacaggcugagacuuacugcuggaacauguauagugaggccuccuuuguugaccaucacccugggucuucuugugcccaaagcagaaugguguggcuuccuggaauaggagaucauauuacuugaagcaacaagauuguauugcuugaacucuaguguccuaauuuguuuuacucacuuuguauuaauacaugccaaagauagggaaggggaugaaagggucuugggaccaccaucuagguuacagcaucccucuuuuaggaguccuugcuaagacaccucaggggaaacugccuuucugaagccuggcucaugguccaguuaacuaugucaacaguaccaacauuacuuucauuuaauacaggagauagagaaauguuucacccccgaggcuacuuuccucagaaggaggcagaagaugcuccauggccaauugaguacauggaggaaauuaaguuauaucaaaaauuauuguugaaucuacuaugaauccagccuugcaggaacugaguacugaagcuuaggaacaccaggcuaaaauauauauauauauauauauauauauauaugagcuuuuucuacucuuucuggacaccaaggaacaugaaagaaaaguguugcggaauaacuaauauuuuuuauuuuucuuacccauguccagccaaguaagcaaagugaacacuucauuguugaaaagccaagauuuuagcauguuuauucuuaauuuuucuuccaagucaauaaugaagucaugcagggguauugaguucuuaauccauaaauuauagguuaguuaauugaaagguuuuuguacaugucaucauuuacuuuuccuuucuccuacuaauccauaaauguaggccacaaagugugaggaaaccaggagauuuuaaguaguguucuauaagauaguuuaaauugugaauauccauuauggcauuguacucuaggaaauacauguuguccuaaauugaagcuuucauaaagaaaauuucccauguuuuaaaucaauucaagacagaugauuuuauugggcaggauauaggaaaaguucuguuuuaaauauuucuuacuuuaacugauauauuuguaucucuguagucuuaguggcaguaucccaaugcccagaaauggcuuuugugugcuccuagugcuuaguaaggcaucauagcuaugugacugccauggcauuaugauugauaaggagucucuaaacagcagaaaaggacuauauguaauauauaugacccagacuagaguaacaaagcuaaacaccuuagaaaagcccagaaaauagucuccccuucccacaaggguuauuauuuaugaucaauguaugaguuuucaaauacccuacagcagacucagagaugccauaagagcugggggagcuggguggugaacaaucaaguugaaguccaggaguccugacuguuagcauuuucugcuuuccauaauguaaaugcucccaccauggccaauuucaagucaccaacaugacaucaguaaacaugaagguggagagagaugugauugcagcuccagcacaccacagcuggggcaagcugcacucccacugcagucagagauggcauauacauacauacaugucauacaugucuauguaaacacguugcaaaauuuuguuugcagaaaguggaauuuuugaugccuccauccaaaguaccuaguuuccaacaucacuguagagggaaagagagagggagacuuucgagaaggcacacccuuucucaaagugacacauccaaagugaugcaucacuuccauuucuguucugguugugagaaccaaucacauugcuccacuucaguaauaguaagcugagugauguagaugagcuauaugccaggaagaggaaaccagcuugguagguauaauagcuuuugcuaaaccacaaggcauccuaaaacuuaauggccuggacagacacuaacucuugcucaugaauuugcggaucaguugaacagcccugcuagucugagccaaucucagcugacuacagcugagcucaccccugccucugcggucagccacucgucagcuggcaucucugauuuuggguguggcucgccauuaauuggaaugaagagaauggcagggcccauggccaccuggccaccaugcaacaggcuaggcugcaggguugauguggucgcucgggguuccaagagcagcaagaguaauuucuaauacacaaguauuuuccaagucucugcuuacuucaccuuugcuaccaucucacugaccaaaauaagucacauggcugagucuggaguugguguggaggauacugccaaggauguguggauacagggaggugaauucaauuggaggccacuggguuuuuucacacaggcuaagaggaauuugaaaaucacuggcuuggcaucauaaucaauccugcuuagaggugauuucuuucacaccagccauuacuggugcuuuuuccuucuuguuaaaaucuaguuuguguuguaaagucaagaggagcuggugauugaaaaaaauaacauccacauguguuuguugauuugugauuucacaucuaaccuuacucuuacagaguagagugaaagcuauacucacauggccuagagauaaagggucuguccaggauucccuuacucggcucuccauuccaauaaagagagccagccacugauagggcguggcagcuggcaggguguccacugaaaucauaggcucuugguaccuuuguggagauggacauguggauucccuucuguccugacucucuaaggacgcaucaggaacagacagaugggaaaggcagucucuaaggauauccacugguuauguuuucaguguugauauaaguguuaccuuuuucauauaaauucuuuguauuggacagaauaauuguguacauugauaguagaaguaaugaauauccagaugucuucuaaauaagggaagcaaaagaugucccacuugcaaaugggagauuuauuuuagguuuuaugcauuuggucuuuuacauuguguccuuguucuuauguucauggcucauaugcaagaugguuucugagaauuucaucauguaauugcauuguucuccaaauaaguuuauuucaaaauccaauuaaaacacaaguuuuaguacauggcugaugcaguauucaguggaggagacuuuguuuuacuaaguugaguuguuuuacucacucaagcagcaauuuaaagacagauuucauuucugagcuguacuauucauuauccuaauuuauauuuauugcaaccucugagaccacuauuuugucucuuugccuacagucuucagaaucuuuaaguuacuguuucauaggaaaaauuauuggagaaauuuaauagaaagagcuuuuaugaaguacuuaagcauuuauaccacaaaaaaagauaagauagcuuuagaucauuuugaaaguuuauaaauguucacgguccauuucaagauuacuaaucucuuccaccugauuucuuauguuacaccuucaggccuucccuguaagcaacugacugcaucucuacuuucaaauccuuagagugcuuuccaagacugaaauaaugagaguuacagagcacacgguguccacugcaggcuagacucuacacugaagucucauuuauuuucguuuuacagccaaaagauguagaugucaucauacucauuuccucugugagaaaacugagucacagaaaggugaaauccagcacagagacaagauuuaaacucaguucauccugucuucaaaauugauauuccauuaaaccauggcaaucuuaaaucuuucugugaaaaacagauugucuucagcuuucagauuuaggguucauguacuuauaccuucuauccaaccacaaauacuuggugaggaagcugcugucacucuuuuuuaauauauagagcaauguugacugaugaauuuugacugucugauacaaggcaagagacuaccugguuugggcucacaaugucuaagauguuucuaucucugugggccuagaaaucuacuuagacuuucugagccuguuucuccauauguaaaaggggaugcaaaaguaucuaccucacagaguuguugaggauuaaagauguuauuacaugagcaagcaacaucuuuggaaugaaucuuggcacaaaccaagcacuccagaaaacaguagcucuuauuucaauaauccauccuguugguguccauuuuaauugcgugagaagcccuccccguguuuggcuuagacuuccacagucuccugggagguuugcuuucauggcaggacucagaaucaaugcgggaaaaagugaccuuucuuguuguucugcuugagguuggacucagucccauuguuccagacucauugucucauuacacuuuuggacacaaagcaagaugaaagcguugguugcuguuaugaguuuuauaucuguaguugucaaaguuacagagaccccacguuggcaagucaccuuguguggaacccuauggucagguaccauuuuguagcccugggcacuuuuauacaaucauguuucauagaaggugauuugagcugguauacaagacaguuugagcuggugucugucaaaaucguugacaaugcuguguuaguuuccuguugcugcuguaacaaauaaccacaaauucagugacuuaaaaccacacacauguauucucuuagaacucugcaguuagaaguccaaaauggacuuccuuaggcuaaacacaagguaucaacaaggcugcauugcuuugggagacucuggagaagaaauggcuuccuugcuuuuuucacauccuggaggccaccugcauuugcauuucuuaacuuuaugagagucuguaaugaugucuuuauaaugccuccaaaugguugcaaaacuaacacaugcuuuuguuuuuaugaagccaaacagauuuaguugauuuuugaccauggaguugggguauggggacaagguuggcagccauuuuuauguuaguguaguccaacauauuacauuccagccagcaucugugguauucuauucuagucauuauagacuuuuagaaucaugaaacugugaaguugcaaauaaucuuauaggucacccagugcagccugcuauuaaggaguauccccuacaacagugcuucucaaaauucaacaugcucacgaaucaccugggaaccguguuaaagauacagauucugauucaguaggccugggauggggccugagauccugcauucuuaauaauugcuuccagguugcugcugguccagggaccacacuuugaguaacaaugcucauuccugacagauaaugcugccuuggggauuaaucuaguauagacucuuuguauuuugaaaauuccagcugucauauacacagauaaguaauuuuuggaucaaagccaaacuaaaaacauauccaaaacuccucugcuuuuaaaaaauguaaaccaaaaugacauugcaauuaaaggaaacuuuaaaaaaucaaauguguauguggagucugaaggaccuuauauuaaaauauauaaauaaaaaagaauaugcacacacauaugugaauccacauauguauguacucacauacacauauacuagagauguauguguucaucugucuacauagauagguagagggauagaucaugcauccauauuaaauaaugcaauugugaagaccucaagucauauaauauuuugugguacugacucagcuuuaacauuuuccuuuauauuaauuuuuauuagaaaauaaaaaauugaaaaguauaaauuuggacuuuccuguagauacaaggaugaaucuaaauguaaugucaucagccuuuuuacauuaaagaaacugauagccaguuucaagcacuggcugaagugaauugaguugaagugggccaugccacuagcucuaacuuuaaagcuggaguuacugauuuuaauauuuaaauguagguacugcacauauuuaucaccuuaauucuuauuuaauauuugaaaguuacugcuuuggagaaagucagcuaagcaauggugauuauaguguaucaaaauccauuguaagugauuauuuuaauaacucugaaccaacagggacauguagacauucagacaaaaaacaaccuaauuauaaugacagcaccaaagugaagcugugacaguuacaaaaccaauuuaaaaguuuccugacagccauggcuaaaagcuuuguuuggaucuuucaguaauaacaguuuacuuaagacauaaauccacagcuaaggaaaauagaaaaagaaaguuguggcuuuucugccaugcagaugaaauggaaaucagcagaaauauuucuaauagaacauuaugcugaaaggaguauagaaaaggaauaauaguaauggaauuuaacucucacaaugcaagaaagacuaaauaacaauaaaaauuuuaaugagcauagaaaugugccagaugauuugccuaucuguguuaugaaggucagucauuucugcaaguaaauugaugugcauauaaacauguugauuggcagcucuggaauuugauuuuuguauuaccuguaaaauaaagucaaagggaaacggauaugcaucaauagccacggugacaggaagccuuaauaaaagucuacuuucccgaugucacuggcaugucucaaauuauuagauccuuaucaauguuacuuaccucacuagacuaugggcugagucugauaugcaacauaauuaauucuucaaccucggguaauuaauuucucauucccgaacagaaaaaugcuugauucacaaaauugcauuccuuuuuucuguaaaccuuuguagaauauuuguaaguguaaucacuguucuaagcccuuuacauauauugacucauuuaaaauuaauaacaagucuuuggaguagguacuauuuucuccacuuuaucaaugagaaaacagagguuuaaguaacuccccuggggccacagugccaguaagugguggaguuacggcuccaggcaguuuggcccagagcaccugauguaggauaaggaagaccccaugaaacacauacauagagucauggagacauuggcagugcucagaagaggcaguucuuguucucuuaccccauuuuaguaauaacaguuugcuuaagacauaaauccacagcuaaggaaaauagcucuuugagcugcaaggacuaaaggauucucaggucagaccagacaguaagggcauguguuaauaaauacccagaagaaaugaaaccucagaaagaggaugugugguggcgcuagucccugggcagauguggcucagugguguguuguuugugcucaguuccuuuccauaggucugcuucucucuccucuuucugcugcccagggccuucagccuccacucucuccauuuaaguauucucuaccccacagugggcagcgggccccagaauggacuuuaaauagacuaggguaaaaugacuuagucucucugaacugugugaaaugugaguaauauaucucaccauauagagcuaugguggauauuaaaguagauaaaacaaauaacauuugaauaauguggauuaugaccaagucggauuuaucccugggauacaaggaugauucaacauaugcaaauaaaugaaugugauacauccuaucaacagaaugaaggauaaaagcuauaugaucauuucaauucaugcuaaaaaagcauuuggcaaaauucaacaucucuucaugguaaaaccccucagcaaaacuggggauagaaggaacauacaucaacauaauaaaagcuauauaugacagacccacagcuaguaucauacugaauggggaaaaucugaaaagccuuuccucuaauaccugcaacaugacaaggaugcccacuaucaccucuguuauucaacauaguacuggaagucccagcuagaaaaauaggacaagagaaagauuaaagggcauccaaauuggaacggaagaagucaaauuauccuuguuugcagaugauaugaucuuauauuuggaaaaaccuaaagacuccacaaggaaacuauaagaacugaugaacaaaccuaguaauguugcaggauacaaaaucaacauacaaaaauuaguagcauuucuauaagccaacagcaaacagugugaaaaagaaaucaagaaaguaaucccauuuacgguagcuacaaauaaaauaaaauuccuugcaauuaaccaaaaaauugaaggaucuccauaaugaacacuaucaaacagugaugaaagaaaucgaagaggacaccaaaaauggaaaaauauuccauauucauggauuggaagaaucaauauuguuaaaauguucauacuacccaaagcagucuacagaugcaauugaauccuuaucaaaauaccaaugauauucuucacagaaauagaaaaaaauucuaaaauuauaugaaaccacagaagagccaaaucuauccuaaacaaauugaacaaagcugggggaaucacauuaccugacuucaauuuauaauucaaagcuacaguaaucaaaacgccgugguacugccauaaaaacagacacauagaccaacgaaacagaauagagaacccagaaggaaauccacacaccuacagugaacucauuuuuaacaaaggugccaagaacauacacuggggaaaagagaguuccuucaauaaaugguccuggacauccauaugcagaagaaugaaacuaaccccuaucucuguaagguacaaaaaucacaucaaaauggauuaaagacuuaaagcuaugaccucaaacuaugaaauuacuacaagaaaacacuggggaaaaucuccaggacauuggacugggcaaagauuuuaugagcaauacccccauaagcaccggcaaccaaagcaaaaauggacaaaugggauuacaucaaguuacaaagcuucugcacagcaaaagauacaauuaacaaagugaagagacaacacacagaauuagagaaaauauuugcaaacuaccccucugacaaaggauuaauaaccagaauauauaaggaccugaaacaacucuauaggaaaaaucuaauaaucugaucaaaaaaugggcaaaagauuugaauagacauuucucaaaagaagacauacaaaugacacaaacaggcauaugaaaagguguucaacaucauugaucaucagagaaaugcaaaugaaaacuacaaugagacaucauaucaccccaguuaaaaugguuuauauucaaaagucaggcaauaauaaaugcuggugaggaugcgaagaaaagggaacccuucuacacuguuggugggaagguaaauuaguacaaucacuauggagaacaguuugaacauuccucaaaaaacuaaaaauugagcugcuguaauuuagcaaucccacugcugggcauauacccaaaagaaaggaaauaaguauaucuaagagaaaucuucacucccauguuugcugcagcacuguuugcaauaagauuuggaagcaaccuaaguguccaucaacagacgaauagauaaagaaaauacaguacauaugcguaauggagcacuauucaaccauaguaaagaacaagauccagucauuuguaacaacauggauggaacuggagaucauuauguuaagcgaaauaagccaggcacagaaagacaaacaucacauguucucacuuauuugugggaucacaaaaucaagauaaucaaacucauggacauagagaguagagauugguugccagaggcugagauggguacuggggggacggggggaggcagggaugguuaaugggaacaaaaaaaauagaaagaauagauaagaccuacuauuugcuagcauaauacagugacugcagucaauaauaauaacuguacauuuuaaaauaacuuaaagaguguaacauaaucauuuguaacucaaaggauaccccauucuccaugauaugcuuauuccccauugcaugccuguaucaaaacaucuuguguacuccauaaauauauauguguauauauauauauuuauguguguguguauauauauauauauauauacacuuacuauguacccacaaauauuuuuaaugugaauaauauggccuggaacauaguaaccguuuaauacaugauaaccuuuauaauaauacucauuauggccaggcaugguggcucaugccuguaaucccaacacuuugggaggccgaggcgggcggaucaugaggucagaagaucgagaccauccuggcuaacguggugaaacccugucucuacuaaaaauacaaaaaaauuagccagacgugguggcgggcgccuguagucccagcuacucgggaggcugaagccggagaaugacgugaauccaggaagcagagcuugcagugagccaagaucacgccacugcacucuagccugggcgagagagcgagacucuuucucaaaauaauaauaauaauaauaaauaauacucauuauuuuuuaauguuuaauuaucuuuaucuuaauguaggcaguagacuuggaccagacuuggguuccaguauugaguccaucuucaaucccuguuugacagugggaaaguuacuuaaccucuuugagccucaguuuccuuauuagaauagguuccuagggcuguuaugaguuaauuuauguaaagcaccuagaaaaacuccagguagagagcaaguaugauguacaugucacuuacuagaaguuguaguaaaauuuucaacaaauauuuauggaaguaauaaguaaaaaauaaaucucagguuucucuuacuuuuccaguuguauaauaaucaucucuaaaauauuuucaucugcaguauucucccuaaacacagaauaaagaaauacuuguuuuguguuacuagcuuuuuaaaagccauuuauccauacagucagaauuaaggauaaauacuacccaaccaaccaauuaaaaauuaagaugcaagccauacacaaaugauauauguuuuccauuuuuagucaaaagucucugaaaccaucuuccuagucacuguuuagcugccugaaagaaagguucccuugccugcccaguucagcagugugggacauggauggcuuuaucuuggaagcccuguuuugcauagcagcacaucacaaaggugcugucagccaaggacuaagucaauuacacuuaaucaugagguuuauuucuuuguuaagagucugucuguuucgcccccucagaaaaugaugcggucauccguuuuccacauguucauccugagcauggugaccguggacgugaucguggcggcuagcaacuacuacaaaggagaaaacuucaggaggcaguacgacgaguucuaccuggcggagguaagcagcucuccaccgugcagaucgcugggcaaggagcaggugaaccgcggacagugccucuuagagaugcaaaagugaaguguagccuguucauuacuugacuuucaccaaagcugaaucauugucugcuucuuaagugguuccucuggucacaguguggccugauucauuuccugucaccgcgggccugagucaucuuccucacaguaugucacguugccaggguaacccuuuuccccugggucuuacucuagaaucuugcuguuuuccuauccaccucuuauuaucucucccuuucucagcguacauuaguuuguuuccuacuaaguacaagcaggcacagauucagaagaucauaaauaagcuggucagcucagcaauacguagaagagggcuggaaggacauauagagagaugguaaugauaaauuacuccucuagaaacggguguuacaaccuacauuaaagacaccaauuaaagguagguuucaugauuaaauaagcaucucccuagcacucuacauaucauauuacaguuuuggaauaguacuuccuauugauaagguaauuuuguuaauaccugauucuuaaaauauuuuaauuuuuauuucuuucaauaagcauuuugcauuuauauuaaagcauuuuaauaauuuuccaagaucuuuguuuuuuuaauguaaaaacuuaccuaaaauauaucucagaauucaaugguuacauauuuacaaaaaaauugauugacaacguagaaacccauucauugugugagugagguauacauacacaguuguacaacgcuucaauaaauccaaccuaugaaaaaguaaacugaaaagacagaaaaaagucacaauuuuauuauuuuuaccaaagcauuuuucacauaaaaaaaaucaauuugccauauaauuaaguguuauuacauuccuagaauucucucaguacauuuaaaaauugauuugguuaauaaaaauuuagucuacccacgcacaagcuuuucugaaaaagaauugauugcauguaccuaacgagcauagacaucuacguggauaucaagaaacuuuuaaguagucgcuucugaauucuccucuucauggaaguaugucuccugaaacaaaauaccguuaauacaaaacuuuuacugggcuacagucucugugaugcaacauuugcccaauggccaccugguauauggagcuuacaaucuagcaaaaaaaaaaaaaaaaaacaauaaacaauaagaguuuugugcuauggagaacuaaugacaggggcugaugaagaaauuauauccagcccagccucugaaaaauagguauaauuuugcugaaaauccagcacacgaugaauggauugucaauaaaagcagagagaaggucggguaugguggcuuacgcccguaaucccagaacuuugggaggccaaggcggguggaucacgaggucaggaguucgagacaagccuggccaacauggugaaaccccaucuauacuaaaaauacaaaaaauuagcuggguguagugucgggcaccuguaaucccagcuacucuggaggcugaggcaggagaaucacuugaaccugggaggcggagguugcagugagccaagagcgcaccacugaauuccagccagggugacagagugagacuccaucucaaaaaaaaaaaaaaaagcagaaagaagccuagacugauacuaauauuugcagguaaauuucuaacacagggaaagaacaaugaaggaagccucaucaaguuauuucuguuuuucccaggaaguaggaagcaaggucugcauccagccagaugaugagacagugaagugggaaguuggcaaagaaaggggagagggaagaggugccugggguuaggcaaaaaauuaacaauacagcaaaugcaacauuaaagauccauuuaggacuauggauuuacagugauaccaauucagauagcucugcgacuuuuuagcccuguauaagaagagggaaaagcaacauuuaaaucaauccaccuuuagggauuuuuuucagguuaggggaacugagaaacaaggggaaaagauggauugcuggcaaaggaguugaaaugaugacccugugguuucuguuggauguggaaaugggaggagaauggaggagugaaggugaaggaucaauggucucuauaugguuaaaggacggguaccaccaaagugauggaauaauagaaccagaagagguuaugaucagagaguggaguccaggauuuuacaauuccaggguaauucuaaguaaugaaauauaaaaucuagggugucacgugaauguggguggcuuaaacauauugauggagucaaggcagaaauggaaacgacuguugaagcuaaggcgcuggcugagucuucacauggacauugaagucacucagagugaggccaguucuuggagagaagaguggagucagggagcaaagucacggggaaugagcgagugacugaugaacagauugacagaaggacagaagacagcuacagggagagugggugacagcaugguuuaaccucauggaauacguugcaaaggaguaucaaggaguaauggaugggcaccucuuccucgucuacauguucuacuagaaagggcuggaaagggcugcagggguaacucauguauuugagagagaaucaguugaggcacagacagaaaguagauucugggaacagagauugauaauguagaggacauuauuuaacguaggagagacucaaagauuaguucaaggcucugaggagggagaagugggaagaucgaugagacagaagaaugauacaagaguaauagcaucaguagguaaagauuugcuggcaaaaaugccaggaaacaaaagcagaaaugaccacaagagauuacaguuaugcuuaucucucugggaggaggaaucugcaucugcuccugagggaaucuugacauuagagauuacaguaacauugcuuuugugaucuagcacagggugggcagguggucacacuaaaucaguccuggagcauaagugaauaggcccuccacacuggcaacagcagggaagggaauucuuuaguaaauuuuaccuaacuuuuucauguacagaauugauccuuuccuaauguguuuauguaugguagaugauuuauccucauaccuuaagaaauuccaacaaaaugucaaauaauugaauguuguagaguugacugguuacuauuuaaguguauuguagaguccagggguaguugguaaauccuugucuuuuuucuuuuuuauauaauauuaaaaauaaaaacaaccucaacaacagacagacaggauuggaugguggaauucaguauauauuauguguccaauaauuguuguccccugacaauaauaauaagaaagggugugggaggaaacuuugagaggugguggauaugucaauggcauugaugguaaugguuucacagggguacacuuauucccaaguucaucacauugguacauuacaugaaugcagcuuuuaacaugucauucauucuuuuuuuuuuuuuuuuuuuuuuugagacagagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccacaugucauucauucuuaacaaagcggcaaaucaguuaaccagcuaaaaacuaacuugaaauccuggaaaaauaaauaaauaaauaaacuagguaguggugauuuuguugacuuaaacaaccagauagaccccaucaguguacucuugaacuacuuaagcauucugaauuuguuccacucuagguuuugggguuuuuuuguuguuguuuuugucuccuuuuuuuuuuuuuuuuuuuuuugagacagucccacucuguugcucaggcuagagugcaguggcaccaucucggcucccugcaaccucugccucccaaguuccagugguucucuugccuuagcaucccaagaagcugggauaacaggcacacccagcuaauuuuuguauuucuaguagagaugggguuucgccauguuagccaggcuggucucaaacuccugggcucgagcgauccauccaucuugaccucccagagugcuggaauuacaggcgugagccaucacuccuggccguuccacucuguuuuugauuuuguguguuugacuuuccccaaguauguuucguuuuuauucagauuacauugccauuucucuuuguaucagaaacuuauacaugagacaaagugauuuguuucaaaugaaugugaaaaagucacuuuaauuaaacuuacuuuuucauaauauauucuauuuuuauaaaguuuauaaagaugucuugaguuuaggccaggguuuggcaaacucuuucuugcagacccagauaguaaacauuuugccuuuuguagaccacccucucucugucucaacuacucaacucugaaauuguacaaaagugagugugucucagaaugguuguuuuccaauaaaacuuuauuuacaaaaauggaucuugguuuaagcuauagaaacagagagcaaugucaaauaauugaauauuggauuauauucaauuauuuaaaauacaaauaaauaauaacauuuuguguuaaagucaaauauuuuaauacugacaacaauaaagcuaugauuuuuggggggcccauuauguucuaagugcuuuaaaagaauucauugucucauuuaauucucaaaauaguuauaauaacagcaauucaaguuuauagacuauaaugaugcaguauguaaggcaauagcauuauguaauauuuugaaaaguuuauuuuaaaaauggaucacaacaggucaugagcuuuuaaagaaguuauuuuuuaaguucccacauauuccagaauaaauuauuuagaaaaucuaaaauaaagcacuuuacccauuaagagccaacucacagucuaaaaaucacccuuuaagaauaaauuaagauacuuagcuucuguugugaagcuggggacuuguuuuguuacuuuggauuaauuaaccuacauuuagaauuaguuaagaaacaggaaacaguuuaccucuuuuguagccuaugcauaaacagaaaaagguaaaguuuauuuuccucuguaagaauuuuaacuuuucauugugaucuaagagaauauauuauuauugcacauuaaaucauauguuauaaugaacaugauuacauuuuaaaauauauauuauuuucuuaagaaauaaaauauaagcaauauuuuucuuauuauuauaugaauguauuuguauccauuagacuguacauuuaacaaaauuuaucagcacagcacaggagauuaaaagcuuuaucuucuuuuaucucaauucuucuuuugagaaacucacaaacagaugggagagauacaacaaggaaggcaacggaccuacagagaggcccaaaguuagcucugugucacccccuagcauuauccccagcuauguucucugauuuccucuagaccuaucugaauggggagcucaauccucuuccaccuccugguguuaaguauuaaugaggacagucauguuuuccaaugaagccagaggggagaaagaaguccuaggacucugugcuacauaccccacaguaaauuaacuagaacuccucuuacccucaacucugucuaucccuccuacccagccuacucccauaucuccccaacuugucaucagccaggcaggcucuuccccugcuacucaugcacagcaauuccacuccacccccagacuugcaucuucacuugcuuuuuguucagcaaaacaaaaagcucugcuauuaagaggaucuagauuccucagaaaagaaaguaucaucuauuacuuaagcccucuuagucccccacaggaaauauuuauuuuaaauacauucagaguuucucugcaaagauuucacauggauauaaaauuuuucaucucauuucaauuauaaagucagagaacagagaggaagaagggccuaguauccuuucuuacauggcaguugugcuuggugauggggaaucagagguaaauaaaguaaauaagauauggccaucgaugugugacucuaaggaccucuuucuacucuuagaagcuauaguucugugagauuaucugguguaaucuugagugagguguauaccuaaaauuuguggcaauaacaugauuuaucaaagaaauuuuagugacucuacaagaagaaauuaagaacaauuuccaagucaguguuugucucaacacaucauauccauaugagcaguuuuaguuauuaaauccguguuuccaauagaucuaaaaaucauucucuauugugguagacuaaauauguauuaaguugucuugucggagggaaugagucauaaacugccaaggugcuaguucgcugagagaaguuacagcuugagagaauguuguuucuaaaacagauuauugaugaagcaaaacgugcugagacuaaauuaauuuuacacaaauaagauuugggcaggauuagacuuauuuaugucagauaccuaugaugucagaagcaaccauuagccuuuguguauuaauaugauuauuuugcaggauucuuuuucuaugguuauuuuuccuucuuuuugaaauuucuauccuuugaaaaucugugacuuucuuuuauuuccuucuuaauuagaaaguauuucauaaauucaacacauagagaaaauauuauaaccaauauuuguguguccgucacccagauuuuuaaaaaauuaauaguuuuucauguuugggucagguuuuucaaucagaaauaaaacaucauuaguagaguagaagaucccuguguaccacuucuugaucuccuccuucucccuaauccacagagaacuauauucaucauaucaaugcaugcuuuauaauaguaugaaguauuaaggugccacuuuuucaauccucauuauauuugggaaauugauucaugucgauugaagcaugaauuuauuuguucugcauguaagggcaauggguauuucaauugcuuccaacuuuuugcuguugaaaacaauacuucaguaaacauugucauuagaauuucugugccacauuugggagagcucuuucuaaauauauaccuagacuuaaaauugugaauuugucagauaugcucacuuucaacuuugcuaaauauuguuaaauugaacuucaaagugcuugugucaauuuacauuccuaccaggauauaugagcagcucuacuucauacuacuuuuuuuuguucaggauuuuuaaguuucuuacaaucucauauaaucauuauagucuuaauauacauuuucuugguuaccauagagauuugaccuuuuuuucguauucugucagcccugaauuuccucuucuauaauuuugccuguuuaaucuguacccuaauugauuuuucaguuaucuaguaguaugcagugcagacaucucccagccuucagcuugucuuuuaacuuuuauuugcugucuuuucuucaauagaaguuauuaauuuuaacacuguaagauauagucaucuuuaauuuuugauucagugcuuuuugugucuuaucuauaccagagucauuaaagacauucucuuauaguaaaggcuagaguuuucaaguugugcuuuuucaauuuuagacuccaauacauuuggaaugagauaaggacuugauuuuuuccccauauauaaacaauuguccuucgaagauucauugaaaauucauucuuuccucacuccuguagugcaauuucugucauauaucagguuuacacaugugcacaauuguguuucuggacaccucagucugugucuauacaucaaagcuuuaguugauaacauguugucauaagugcuauccuuuauaauaaaccuugagaucuauuagggcaagcuacugauguugauauucuucuucagauuuguuuuaucuguucuuggucuugcuauucuugcucuacauuaugaaaauuuaauucauuuuaguaaugagauuuuaauugauguuaagaacaucucuauucaguuauucuaaccuuccuuaguguuuuccaacaaugcuuuauaauuuucuccaaaggucuuccacauuuuuuguuacauucaugccuacauauccuacaguuucuuuugugaaugaaauaauuucaauuacauuuuuauugauguaggaauaauauuaauuuuuuauauugaccuaauucauagccagcaacuuuacuacaauugguuguuugugaucauccauagacuugauuggaauuucuauguagauaauuguaucuucugaaauuaagguuuugucuuuccacgucuaauuaucauaucucugauuuuuuucuucuuuuauuauccgggugugggucucuaauaaaauguugaauagaggcagugauaguggacaugcuggguguuuuucuauauuuugauacgaaugcuuaugauuucaucauuaaugucauuuguagguuuuuauagaugccuuucaucauguuaauaaagcucacuucuauuucuagguugccaagagcauuucucauuaugaguugaguauucaaucuucuucuaccuauacugagcugacuacacagacuuuccuuuuuaauuucuuagugcaguauauuagaauaauagauauuuugauacugaaacuauuuuagauuccugaaacacuugauuuuauagcauuacuuuuaauaaacaaauccaauaagcugacauuauauuaggaauuuucaaucauaaggauaguaguucugugauuuuauuuucuuuuacauugcuagucugauuuuguuagggaaguuacacuuccuuucacaaauggaauagacauauuuuucucuuuuucucuucugugaaagaaugaauaaagucccucuggaacaccaucuagggcuauuguuugcagugggaucccugguggagaaagggagaagagagaucuugauuaaugacuuauuuuaugguuugauuauuaugguuugucaguuucaugguuuauugcuugcuauuuauagagucauuaauuuuaacuaaugucucacauuuccacaguuuucucucaggauuuuuauaaucucuauugaaacugaauguauaauccuuuuugcugccaauauuguuuauuuauaacuuucuuuuuuauagaaguaaaugacuucugaugcuaacuaccuggauuuuagaccaaacuucacagcacagaggcacaguccucuacaagauuacccuuacucgagauacuaacuguaagcucaggggguuccagggccucccugacauaugacauaucauauggcuaauaugguugauaugacauaugacauaucauaugacauaucaacaggcuaaaaacucggggguuuccacuagccuucucaaguuugauaauuugcuagaaugacucacagaaaucaggaaagugcuauacuucugauuacauuuuuauuaaagcaaaaagguugcaaaucagagccagccaaaagaagagaugcagagagaaaggucuggagaguccuacaugugaaacuugcuguuuccucuuuucauggagugaggacauaucacccucucagcacauggaugugaaacaauauucagagcgcugagaaccagggaagcucaccugagcuuugugcugaggcuucugauugggauuuccuuagguaggcaugaucgcuggaaucacuggccaugcacacaagguuggaguuucugacauggccagugcucaugaaugaucucauugccauaaacuaccagggucaccauaaauaacaaagauaccuaucaauuggcaaauuccaaggauguagaggcuacuucccaggaacuugaggcaaaagccaguaaaauucuuuauuuuucauucaaagaaccagcuuuuaguuugguugacacuaacaguuucuaauguaccugaaauuauugguucguucccaauauuuugaacuauuaagucccuuuauuucuuuguuuuuuaaauuucuccucucaccuuuauuauuuucucuuuuucauuuaucucuuuggucaucuuaaacuucuuugaaaauucuuacugggguucucuggguggaauauaaaucauucuauuauaaagauacaugcaugcauauguucaucgcagcacuguucacaauagcaaagacauggaaucaacccaaauguccaucagggauagacuggauaaagaaaaugugguacguauacacuauggaauacuaggcagcgauaaaaaggaacgagaucacauccuuugcagggacauggauagaucgggaagccaucauccucagcaaacuaacacaggaacagaaaaccgaacacugcauguucucacuuauaagugggagcuggauaaugagaacacugaauagcugaacauggacacagggagaacaacaacacacacuggggccuaucaggagguggggggagggguagcaucaggauaaauagcuaaugcauguggggcuuaauaccuaggucauggguuuauaggugcagcaaaccgccauggcacacauuuacuuauguaacaaaccugcauauccugcacauauauccuggaacuuuaaauuuaauugaauuuaauuuaaaaaaauaaaauaaugaaaacaacuaaaugauggugaaaaaaaaguuugacaaaauuaauuuuacugagaguaaauucauaguuugaauuuuagaauuuuguuuucuuucucauuagauuuauuuaaaaucuuugcaugcugccucauuuggcuugggagauuuucuuauuucucucucccucccucuaugaucacuucuacuuucuuagggauauugcaguugccuuaaccuugacccuggacccuaccauccagagccagguuuuuaagugucauuuggagaaugcuagccccuugauaugggugauaucacaguucuugucacuagucuauauuccauaaaauaucuuguucugauuuuucagauaagcugauaauuucuccuccugccucuggaggccugcagcugccuauaaggucuuagccuuggguaguuggucucuguccuuuccuuagcagagaaacccauucuagucccugucuuuucacuaugaagguucucaucuuuaccuuaucuaaggugccuuagucuccucacccuauaggaagcaauugaguccaacauugccugauucuugaccuagcauauguuucuguugcauuucuggucaacaaagagguuaaccucguuuagaauuccuuccugccucuuugguuuccuguuuuuuccuuugaucacaguauguuugaaacagaagggguuucauaaaucaugaacucauuuugccgucuugcagggaguccucuuuucuagaaaagugauuucugcauuccucugaagacauuugguuuuaugauauuuguuaaaaugaagagucauuuauuuuggccccaacaaaaucugacacccacguuugaguucauuaaucauaaaaauuggccaaaugaagaaaauaaucaaucuugccauagcagcagucuuugacauuauuguugaguuuaauuucauuuucugggaaacuucaaguaaauagguuucuucugacaauuacuuuuuguguguguuucuaaaagaucuggacauuaucuuguuagguaaaaauauaauacaauaaugacaaucuggacuucucaaccauccaucucaaaauuugcucuuuauaacauacugauauacacuauaagcuaagaguaggugauuuacagacagcuccagacugauacagguaaucaguaaucacuuuuuguuguuauugaaucugaauuucauguaagagaaugggauugccugaacugauuuucuugugagcuuuguccuguaaucuuccuuugugauaaauaugcauuuuuuucucaugauauccaucaugauucuuugaaauuagaaaacagagacugcaacacaaauauuagauaacacauuucaaauaucuuuccacucaugggcaauguccaucucuaccauuuuaucucauaggccuguguuuacgagauuaguuaaacucugcuguuguuacugguagagggucucgacugcaaguuguccagguucuugacguuuugaauaaagaacuggacaaaacgcacagcaaagcaaggaaagaaagaagcaaggaaagcagagauuuauugaaagugaaaguacacuucacagugugggagugagcccaagcagcagcucaagggccccagauacagaaucuucucagguccaaauacccccuagagguuucccauuggccaccuacuugguguucaccccauguaaaugaagugguugcccgcaaucagaggcugaggugaaguuacgaaguuacauuccuaggcaagugucugguugggaaaagcaaccgaucagagguacuuucaauuauccaucugccgcacagaaaagguggggguuugcaaagggaguagccccugguccuuuugcuacucaggcauggaaaguuaggguuuuucuuucaauuuaguucuaagaagucagugugaaauggacuuagguucccugccuccagacccuauucuccugccucauuauggcgacaucaaaccagguauaucgguugagcaugcauucucaacagggaguaaaaucaccuccaaaggggugaaaauauguucuuaguugggggguagaaaauucucucuuuuauaaugcagauugccuuguagaccaaauaaccaaaguagaguauguaaaaagauauauaauaugguagagguaucaaaacuccaugagguggugauuaagaacaaaaucucuaaaagacuucuuagaagaggugauuuaaaaaaagauugggaaacacugcuuugggguauuuguaagaagaaauaaauauuucucuucuuuucuaugcauuguuucuaaguuuucuuaaaguaaugcaaaaaaaaagaaaaguuuauuauacucuuacaaauuuugucuuaacucuuaaaaaguuaaguuuuaacuuguagguacucacaaagguggaaugcacugcagaauaugaaacagaagaagggucccaaugagcccuucuuggugcaggggcugcagacugaggagggccaaagcaguggagggcugccaggcuaagagugacaaauggaagccaccguuccacuuuuccacaggcugccugcugaaugccugggauuugcagaaagccuugagauuggacaccugcacaggugacuuuggugggagcccuccaggcaacuagguucugcagagaccccaguugccuucucccuuuuagauggcucccagcaugccccuggcaaauuccacccuguccagcuaccaucaagguugaguucacugcaauaaucuggagcugcacauugagaagugguuacuagagcuugccuccacugcuucuauuuugguucuucugaacuauuauaguccucugaauuuaaguccuguaccaaaccccauaaccuacacugaaauacuuagugaucauuuaaacuaauuugauuuuccuaaucaccuucuuuaaauccugacacaguucuucucuauggcaggauaacccauaccuucaaguuaaguuaggcauauuuuuaugugcauugauuuuccauaaaauguuaucacuuuggcaugaauauuucagagagcuagaguguuggcuuguaaaaguuaacaaauuauguucaaagcaagccauuugauuccaagagaaucuggaaucaggaauucuaggggaaaaucagugagacuauagauauuuaaauauaaucacauaacaauuugcuaaaucuuuuagugccuuuuagugucuuucaaaagaauaucauuuucccacagagaaaauuguaaugcaaacagauccagcugcauauuuuacuauaaauuaugcucauuuaaacaguucauuccaucuguccuuuugauaauauaugcaguuaguaaggugauuaauuguauguauacauaauuagacaaucuauuggaauaucuuucaggcauucauuaguaguuuucuuuuaaaaaaacacuuuaaaauggaucaccacucuuuuuuuuuggaaugaaaaucucagucugaaaauacaggugaagggagagaugauguaaugaaugccuauuacugcuuccucugcuaauacagcaaccaggucaggcauguggaugggaccuucaugacacaucaauuucaguuucuccugagauucccuaguauccauaggagagaaaacagguucaagucuuccccauaucauugcaaggccagaacuaagaagccugugcuagagaggaaguaccugucgcaggacuugcagcaaagucugaguccucugguccccugaggccacugcucagggcagagagccuuucauuucccgcagaggagcuggaccugccuguaugcugcuugugguccaggagcaguccacagaguccugugggucucagugggccaggaagggaagcucacuagagacugaauuacuccagguggagaagggggucaauaaaugacuccacucauuucugggaaauccugucaccaaaaagccuucuucagauguucagcaaaggagcuauggcuuuucaggucuuucgccuccguaaacuauggugcccucuacuaccccucauuugccacugcuuaagauagcauaaaagacaaacgacaauuacaucaaaaacauguauccauggugaaggaaagaaaaguuaacucacacacaaagggagacucagaaacugaggaugaaacucagagaaucaagacaaaugucuagucuagagauuucccaagcaaguagaauugaugggcgagagaauccguuguuguuguuguuguuguugucucaagaaaaaguaagcagggcacaaaauacaauuucuguaacuucaacuaaaaauguccaaaaaaugaguuaaaaaagggcauaguccuugagagcuaguuuuuaauaugggagaugaagcaggaaaaaauaacucaaaaagugguagagauauaauaauaagggcaaaguaaaauagccuauccacacagcuaugaauaauaggagucccugaaggaaaaagcgaacagauagaagaaaaguugucauaaacaacggaagaaagcuuacauaaaugaaaaaaaaaaaaaaacauaaaucugcaaacugaaagagcucacuaaauuuuagugagauuaaaugaaaauagaugcuuacucauguccuggugaccuuccuagguugcaagcauaaagaaguaaccuuguucagccccuaaacaggcugaaccuaaaccugaaaaaguaaaauaaauguauugugcaauggaugacucaucuacaauacuggaaaguggaagguaaugaaucaauauacauagacuacugagagaauagaacugcaacuacagaaucugaacacagacaacauguucaucugucaguguuaaaaaugcauuuuauauacaaaaggacuaagagagcauaaaacccuuuguauuuauuugagaaaacuacuuuaaagugugcuaaucacaagauaaguaaauugcaaucucaaugacuagacaaaagaagagagaauugaugggcauuggaucucaauagauaauaauaaauaugucaaauagggaucuuugaaaaaagagaaaugauaacauuaaagaaacuaguaauaaauuuguaaaugauuucagcaaaaccaggacuuaggaaagggugugauaucaaaggagagugggaugguagaaguguacuaugaaguuugcagaugugugggguggagggaugagugagccagcaauuuaguugugaagcaauaagaaaaaagcauugguuugaugucuaaccauugagaauuaagccaggagauuagaaaaaccaagucgagcguccaaauuaaugaauagggaaagaaauuagcaaauaguugaccaaguuaaaaaaagacaagauaagguuaaaaaugaaacagcaaugacauaaaauacacaggaagcguaagaccaaguauaacuuuggcacauuuuguuugagcagguugaauuuucuuaucaaaaacccuagaaaaucugaguauguuuaaacacaaaauaaaaauuguacacugcuuauaggaagcacauacaaaguggcccugcaagguaacuaaaaaucauuucuaccaaacacuuaaaauauuaagacguuuuaaauguucagcagagugugcaaaaaauuaaggaaaauucuugaggccaaaaauuaaaugugacgugaguccagaauaccaggugggccccaaggcaguggcugcccugaggacauuugcaaauccuugugaccagaacuugcaguuuucaggaguguguccaggauggaagugacuagaggccugugcaaagugaagaggcagaagagaggccccacauaacaucaggaaggaaaaaucccaucccucagagggaaaggaugggaucaucauucuggaccuugaccccuggcagaucaaaaauguuaucucuggccgggcaugguggcucacgccuguaaucccagcacuuugggaggccgagguggguggaucacuugaggucaggaguucgagaccaaccuggccaacauggugaaaccccaucucuacuaaacauacaaaaauuagccaggcaugguggcaugugccuguaauuccagcuacucgggaggcugaggcaggagaaucacuugaaccugggaggcagaggucccagugagcuaagacugaucaugccacugcacuccagacugggugacagaguaagacucugucucagaaaaagaaaaaaaaagguuaucauguuaucuguacugaauuguguaagacagccugcccacucgugggguuggagcucaaaaucccauuacguccagaaucugagaaacagcagccaaaaguugauuuaagggggacccaaauuucuaagaugacccagguucccuggaagaaccaauucuuucuggaaaaauauguacccuaaaugcaggucuugaaaaucuagagacaaucaaugauuuccuggcaaaauacaaacugccaaauugauggaugagauaagaaaccugaucugaacagcacuggacagcuuugcuccaccaucaccaaaaggccugugcccauguggguuuccuggugcuuucugucuacuuuuaaaggugugcuaauucuuauuuuauuucagaaauuuucauacaaaagauaaaaacuguacagaaugaaugauaaagcuagcauaaucuuagccaaaaccugauaaugauauacaaguaaaacuauaggccaauuucacauaaaacaguaacugugaaaauuauaaauaaaauauauuacccaauaaaauccaacauguuagcauuaucaucuagaguuuuuuuccaaaaauaaauaaaugguuaacaucaggagcuuuuguguuauauuucauugccucagugaauuaaagguuaaauccuuugaaggagaauaggaagaaaaggaaagucuuuaaacaugauaaaaauuaaucaccaagacucauuucaaccacuauauaugaacgcugaagaaacuuucauugaaaacaaggagcaaguuauggauuccuauuauuaccauuuuguauuuagcaaccauuauauaacuguaccuuuauaacuaaugcauucauaugauuaacuccaaaauaaaucuuaaaaaugaaauaaucuuauuuuauuuccuuaugaaauugugcacauuucuauaaaaaucgugagacuuuaugaaaaauauuagaauuaauagaagaaucuaguaaaguggguacagaaggucaauauagagaaaucaauagcuuuucuucccacuggaacuaacuggguagaaauaguaaaaaagaaaaaauacauagauagauagagagagagagagagaaagaaagauaggauauuuaggauauuuauauggaaaaaacuuauuaaagaacguaaaauccaguucaaauaaauaggaaaagagugcauuccuggauaugaagacuaguauuaaucuucuuaaaguucuauuuuauauguaaaagguaaagaaaaaaaucauaaaguuguagacauaugugaacauguaaauuuuauguuuguagcacuaacaauaucaaaguuagaaaccagacuguuggcuagggaaaaaauguuugcaguauauauagcaaagauuauuguccucaauaccaacaacucccaaaacgcauaaggaacacaacauaacaccauauaauagugucaagguuacggacaguaacauuuaauuacuuuaaaaagaaauuaaagugauuaauaaacauauaaacagaugagcaacaauaaguuugauuacacugauacuggcauggauuugagacaagauaacuuuccuguauugcugaagggcaaaugauuucuuauaauauuuugaaaguaaucacuuuaauauuuucuaaauuuaaaacacacuaaucugucuuugccccagcaauaccaacuuuggaaaucuauuuauagauaugaaagccucaauaaauacugguauugagggaggaugcuuagugcagccuuuuuauugaaguagcaaugugcuuaaccaccuuccugaugauuccugcaaauaccacccaucaaugaauuaguagagaaaauguugaguuacauaaacauugaacacuaugggaaauuaugcagcugauaaauaaaacauaggaccuauaucccuuaaucuggagggauauccacgauuguuagugacucagaaaacaaguugcagagugauauauaauauuccugcauacccaaaucuuuaucauucacaguucacguaacuuuagguaauaccaagaaugccuauuugucuuuagaauuuuuuuucuuuccagaguaaauaccugucacauuauuuuuaacaacuucauagaacuguauguaauauuuauacauaauaaguguauagaaaguaugaacuugacagaggacaaugacaucuuuaaaauuagaaauagugcuuucauaaauuguaacaauuguuuuuacaucucauguaaaaacauguaauugcaagccuguuucugugauugcauauguguggaugaagaagcagaugaucaaggaaagaauauacaugacauuaacaugaaauaccugagaaacgugggcaaaggaguucauccacguguuuuguggacuuaagaucauuucaaauuuaaaauauauuaccuuguuauguuuuuuaaggagggaaauggcaauuaaaauuaaaaagcaacuagaaucugcagaaaugguagauuugagaagugaugcuaauuuccucuucacaucuaaauuaacuaucugcagugccuuuaauguuucauuucuuaaaacacuauuauuaaaacugcauuuuccccacauguuccauauaugaguggaagaaaaucccuucugauacuccacauuagucuagaagaagagaagcaaggucugcuauauuccuaucuucaauaaaucauguagugucuucucagagggacauauuaugacuaaucccaguagucacccucauagucuuuaauuagaaguuaaucuucuauugcaaauuuuaauuccagcugcaaucuccuuuacaaaaugaaaauucuuguucauaggacauguaaaggaaauaacaugcugucuuuauguguguguuuuauaauauuguuauuuggaauaguaaauucauagaaugcaugugagagauuaaaagaucaaauaaauguguuaauauacuaauauugaucauuaauuuuauuaauauuaaaguaacauauugauuuauuugcauaagcacacauagaucaauugcuugguaugaaaucucaauuucucuuuugccauguggccuaaagcauaaaggaauaaaugauauuuuaacuuuuaaauuuuaguuuaauuagguuaauaauauguaaguuguuauuuuauaauaugccauguacauuaaauaaauuuuaucuuaaaaaauacaacauacaaaaaaauucagccuuuuguguacauagaaagucuuuaaauaauaaugguuuuaaaauaauaucaaauauagauaauaaagaaauaaugccacucacaaacauucaaaaucauaacauguuuuuauaauuguuuaagauugcuuuggucuacuguguucuaguugguauguuucaaaugcauucuuaaaguaaaaugucauucuugaccuuauggggcaccuuaguguauaugauaguggcaaaaauucauacacugacaaauaugugaaauaauuuagaauaaauuauaguucugaauuucaauuucaauguuucuuuguuucucuagguggcuuuuacaguacuuuuugauuuggaagcacuucugaagauaugguguuugggauuuacuggauauauuagcucaucucuccacaaauucgaacuacuacucguaauuggaacuacucuucauguauacccagaucuuuaucauucacaauucacguacuuucagguaauaaaaauaaugccuauuugucuuuagaaauuuauuuauuuccagaguaaauaccugucacauuauuuuaacaaccacauagaauuauauauaauauuuauauauaauaacuauuaugguaaauaugaacuugagaaaggcacaaugacaucuuacaaauuagaaaagugcauucacaaauuguaacaaucgcuuuuuaaaacuccugaaaauucacagaaacaauguagauguuuuacuuacuuuuccuaaauuagcaguauauagauacacauauuuuuauauauggauaacauauauccauacaugcguaucaaauuuuaaacuacauaagauguuggcacaaacuuuaaagacuaggaaacauuaauuuaaucccaaguguuucucuuccuugucgauaaggcuaaguguuugcucaacaacgguuuauaaugaaaauauuaaagguuuauaaaacuuaccuuuacagauuguaauuacucauacaguauuauuuauaaaugccuguuacuucaugauggcacuuauaauucuuauuuaacuuguaauaauuggauaucuuuuuuuaaaugugauauauuggaucacauugcuuucuaauuaugcaauaaacaguaauuauuaguuacauucuuuguuauuauugaauauagcaacacgcucacuguccugguaaauacuuagucaaaaugauaaaauaugucuacaugguauucuagucaaaaacaccucaaauguagucauuuuccugauucaaacuuggucauuuauuuuuuauuuuauuuuauuuuauuuuauauuauuuuauuuuuuauuuuauuuuauuuuauuauuauuauacuuuaaguuuuaggguacaugugcacaaugugcagguuaguuacauauguauacaugugccaugcuggugugcugcacccacuaacucgucaucuagcauuagguauaucuccuaaagcuaucccugcccccuccccccaccccacaacaggccccagagugugauguuccccuuccuguguccauguguucucauuguucaauucccaccuaugagugagaauaugcgguguuugguuuuuuguucuugcgauaguuuacugagaaugaugauuuccaauuucauccacguccccuacaaaggacaugaacucaucauuuuuuauggcugcauaguauuccaugguguauaugcgccacauuuucuuaauccagucuaucauuguuggacauuuggguugguuccaagucuuuccuauugugaagagugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaagaguugaacuaguuuacagucccaccaacaguguaaaaguguuccuauuucuccacauccucuccagcaccuguuguuuccugacuuuuuaaugauugccauucuaacuggugugagaugguaucucauugugguuuucauuugcguuucucugauggccagugauggugagcauuuuuccauguguuuuuuggcugcauaaaugucuucuuuugagaagugucuguucauguccuucgcauuuauauaauuuaucauggaaacacuagaaugugcauugauuguuuucuaaauagauauuguuaaauauuugggaaauaaaaugacaguagaauuuuaaagaaguaauuuugagaaacaggacucuaaccccuuaggaaaaagaacaugcauugcaacuuuauugauuuuauuuauuaguaauaccaaaauauuauuuucagaacaauauucacuuuaacugccagaucacagguaacuagacacuuuuaguaccugggggaaaggacaugcaaauauaauucacaaaaaguaaaaagcaaaacccccuacaaacccaggcaaaaagcugagcccuuguaaucacagcuaagcauauugaaaccacagaggguuuucauaguucaagcgcucacuucccucagcauccguggauguaaaucucuccucauuuguugaguuauauccugaagcuuagcuaucauaagugacauggcuggggcaagagauauacauguuuaaaacucuugauacaaaaugugcuuuccaaacauuccugugauuauaagcucuugugcacugcucucuagauucacaaaguuaucauggccauugaguaccuaccuuagggcaucauugcacauaauuauagagaauauccuuuauaucaaaacaacagcauaccuuuuuuacaaagcuauuaaaguagccaaauuaagaaaauugguguugccuauuucagcaaagguacaguauaaaauauauucagggccuuaaaauugcuauagucucugacaugccauuuuucaguaaaaaguuagaaaauaacauuugugugcaaaauauuuauuauagaauuaaugagagaaaaaagaaaacuguuuaaaugacaaacauuugaggaauagcuuaauaagucauaacgcgaauuuaaccauaaaauuauaauugugaugaguuuuuuauaacuuagaaauaugacuguuuuauuuaaacgauaaacagcauaaauuauauuauauacauaacuacauauauguauguauauauuuauuauauacauauguaaaauaccuauaaaauggaaaaaaaugacuagaaagaaaccaauuuauuacaaauuauuaaucaucucuaguuuccuacucuugucaucaugucugauuuuccuacuagucuguuuuuuuacaaaauaucuaauauuagccugcaaggcuguaaccauuuuauagauagacagaugauagauagauagauagguagaugauagauagauagauaguagauagauagauaguagauagauagucaaaucacagugaaguuugcaauuucaguuuugucuuugauuuuggauuauucuguaauugguucuguuuaauuuauguuaaugauuaggugauuuucauuuguaucucucuauacauggccaugcuucucuuuuucuaauguauuaauaaugaauaaaaaugaucucaguuaauuuguggcuagaaaguaaaucucuugagaaacuuaggugucacaaggguuuuugcaaauuugcauguggagaauccacuguaccagacagagcggcucuuuguauaaaggccuacauuggucuucccuauugguccucacacuucucauuucaaucaaccuuucuuuacuguguuggcaacaagucuuuccuuagacaauuucauauuucucacauuuaaaugaaguaauguuuagugcaaaguggcuuccuuuaaaauauuaguuaucuguuagacuaacuacugaaguuauucauguauuuauucaagugauauuucugagcuucuacuaugugucagccacuguuccagauacugaagauggagcaguggacaaagcagagaggauucccauuuuaugaagcugaaauucuaaaggcaaacaguucacaaagaaguacacaaaggaaugugaaguacaaguacuggaaaugucuuaaggaagaagugugcaggguaaaaagcauagagauuguguaguaggggcuauuuuagauuaguuguucauagaagcccucucugaagaggugagguuugagcagagacugaaugaagugaaggagcaaacuguaaggaggucugaggggaagcauuccagguggagagaaucacacugagcauguccugaggugggugcaugauugauguguucaaggaauagcacaaaggccagcguggcugggcugcaaccaaugcagggcagcauggccugugggaaaucaucaggucuugcaaaacgcugugguucuuacauaucgguaucauccugaugauauugacuggugcgucuugugaauuuccugugggucgggcaucuugcugagugcauugucucauuuguuucucauaacaagcccuaagauaaggacuguauguguaaauugaggucucaagaaaucuguugacuugcccaagaccgcauaccuagcagaugauggagcuaaaucuucuucccggcugggcgcaguggcucacaccuguaaucccagcacuuugggaggccgaggcggguggaucacgaggucaggagaucaagacuaucccggcuaacauggugaaaccccgucucuacuaaaaauacaaaaaauuagccaggcgugguggugggcgccuguagucccagcuacuugggaggcugaggcaggagaauggugugaacccgggagguggagcuugcagugagcugagauugcgccacugcucuccagccugggccacagagggagacuccgucucacaaaaaaaaaaaaaaaaauucuucccaagaacaugaauuucagaguucauauucuuaacuaugcaauuucuacagcaucucacuacaaaucaacagagugaccuuuaagagaaggacucagaaaugugaccaggaaaauguguuucagagacaaaauguucugaagugcuuaucuuugagaguaugguuuacuucauguuguaucuguaggaacacaaaaucaaaaaucuuuauaggguagauagagugaaaaaccugcugaucccugaauaaaugaaaaggcacaauuagacucacugacagggauuuuuccuuucuaggaaugcagguuuaacccuuugaaaaugcugaucaaaucaccaauguggaagugguauuaaauaguuccauuuuuuucaagcuguuuacaguuagguacugaauuauuuauguccgaaaauagacaaaucugauaaaaaugugaaaucuuuccagauuauuauucuggaaauuaauacgaauguuaauacuuuaauaguucuuaugauaaagcuguuugcuuguucuuuguaaagauuaucugagaguaauauguccugauuugggaauguauguuaagaauuacagcaggauggccgggugcaguggcucacaccuguaaucccagcacuuugggaggccgaggcaggcggaucacgaggucaggagaucgagaccauccuggcuaacauggugaaaccccgucucuacuaaaauuacaaaaaaauuagcugggugugguggugggcgccuguagucccagcuacucgggaggcugaggcaggagaauggugugaacccgggagguggagcuugcagugagccgagaucgcuccacuacacuccagccugggcgacagagugagacuccgucacaaaaaaaaaaaaagaaaagaaaagaauuacagcaggaaaaauugguagcugcaccaugugguaugaugcuuaauuugaacaacauaauuucuuacauauguuuaaaaauugcaaauuagcaugaaggaaacaugcuuuagucauuuuuuuucaauugguuuacuuacaugcuguaaaccauaucauuugcauucugcagacaauaggaauaagacugaccacugauacuuccuguuaaaucaaaguaaaugcaguaaacgugguuucagguauggcaaaauucagaggccgauauggugucaggggcucaguguaugucuucaccuaccuuucuucuguuggugugucggugucauucuuaagcugguuuucucuaugugaaggcaaagauggcucccaggagcucuguaagaguuugugugacucuuacagcaguacccguuggggauuaaaaaaaaaaaaaaaagaaauagaacauuucuuauuaaaggcauccagcaaaagcccugaggaugacucagaugacugugaauacucuggccagaucuggaucaugacggguggggaguccuucuugcaccuuuguacuaaggcugggguaggaaugauuugcuaaaggaaaaccaggcagaguugaagaagccagaggcacuggaaagccaaaaagaaacaaauguuauuuuagacauguaaaaauuaaaaucuaauuuuuaaaaaugaauuuucuguuucuuacuguguucuaaauacacuauucaucuuuaacagacaacucaaucucuuauugacaucaaaaaaucuuggaugaucauuguauaaacuauauuucauuuaugccaagaaugcaauuuuccuauguuaauaucucugaauuugggagcuguuauaaucagugguguguuauacuuuaauuggcagcauuuuuuuauuucuuagagcuacauacaaaauuggugacaucuuagacuuaaugaaaaguuguauuuuucacacuauauacuucagcuuuuaauuauguacuaauuuauacauacuaaucauauaaauauguccuuaaaagcugugucuuuguguuauacucgcuuuguaauaguagccauugaauccuauuuguccaacacaaaguuuggcacauaguaaucaauaaagguuuguuaaacaaaugagugaauaaauuugucaauuaauuacuuauuuuuuuuugcaaaugugaguaugcaaaacaucuaaauauaucuguauauauuuagauguguguguguguguguauacacagucaugcaucauuuaacagcagagauacauuuugagaaaugcauuguuaggcaauuuuguugucgugugaucauagaguuuacuuacacaaaccuagauguauagcccacuauauaccuaggcuauaugguauggccuauugcuccuaggcuacaaaccuguacaguguaugacuacauugaauacuguaggcaauugucacacaaagguaaguauuuguauaucuaaacauagcuaaauauagaaaagguaagucuuauaggaccaccauccuauacguggcccauacuugacucaaaaguuaugcgaugcaugacuaaaauauauguaaauauauacacacacacauauacaugcguguauauauagagagagaauaguugaguacauauaacaaagauccaaaaauacaaaacuuacauaagacagaaguuuauuucucugcagcaguugguaaguaugcagggaaagcagguggcugugccccccauggucacccagccugucggguuggacaggaccugucguauucuaugcaagccuucuauuucugguccaaaggggcuacacuauuuguuuccauuuccaggcaagagaaagguauuuuaaaaaggauucagagaaaguuuaacuuaaugcaccaaaacuuguacaaaucauuuccucucacauuccguaggucugaacccaguccacuggagacagcuagcugcaagggagacuggaauguguaggcuauagccccaggcaaccacuugcuagguuagaauucggaaaguucuguuuuuuaaaggaggaaagagaaaauggauacugggcugauaaucucaauaagaaguaaagauucuuggcaaaaguuugcuucucuuuccauuuccuugugauuuucuaauaauaccuaggaaaauauuuuaugagacagugaauauaacuaauacagguugaguaucuguaucccaaaugcuugggaacagaaguguuuuggcuuucgauguuugucagauuuuggaauauuuguauguaugugcauaaugagauauccugggaaugggacccaagucuaaacacaaaaauuguuuauguuuuauaaacaccucaaauacauucccugaagguaguuguaugcaauauucuuaauaguuuuuuuaugcaugaaacaaaguguguauacauugaaccaucauaaagcaaaggugucagguguagaauuuuucacuuauggccucauaucagcacucaaaaacuuuaaauuuuugagcauuuuauguuuuaaauuaggaauguucaaccuguauugaauuaaagguuuccuugcauauuugaacguuagaaaaauauuaauuuuauuucaacaauacguacuagugaauaucauuuuguauaaucauauaauauguuaaaacacuuaguucauccauucauuugggauuuauugagcuagaccaaugguuauucuauuguuaauuuuagucacuagauauucaaauagagagguaugauuuucauaaagcacuauaaaauaauauuuuaguaugaauauauuuaagauucaguguaaauaaaugaucauauguguaaauaaauguuucucucucccuugauagguucuccgaguaguucggcugauuaagauuucaccugcauuagaagacuuuguguacaagauauuugguccuggaaaaaagcuugggaguuugguuguauuuacugccagccucuugauuguuaugucagcaauuaguuugcagauguucugcuuugucgaagaacuggacagauuuacuacguuuccgaggguaagaguuuuaaaaaugcaguaaguuaaauucauuguucuuauuuuaguaauaaugauuaacaucaaaguaauuucacuuuagucauucagaaguauuauccuauuuuugauaacuugggauaauuagauuuuaauauuuaaaauugucucuucugcagggugcagguguuugagaccauuuucagcauugucagauuauauaucaauucuaaaauucuggaaauaaucuaauagaguuagaugcugaaaccugaaugcuaggguucuuagcaccuauaaauuaaaauacagcagaauuuuaaaauaaagcuugcauuuuuguguucaagagaguuaacauauuuuuaauguuuuauaauuuauauauuguuauguuagucagaaucuagaaggaagcuuuugauuuucaauaaaauaaaauucauaggcucuucagauuuuaaaugucucucagcuuucucaguagaauucacuuaagcuaaaaaggaaguuagaaaucaauggauccauaaacaaaagucauguaagagguacagcucuuaaccagaaggaccuugaaauuuaacucuauguggacuuagaaacauaaaaaaauacaaugaccagacaaauaauguauauauuuuuacccuaaguugaaauaguaaggccuauuauaugguguauuaguccauucuuacacugaugauaaagacauacucgaugaaacuggguaauuuauaaagaaaaagagguuuaauggacucacaguuccacguggcuggagaggccucacagucaugguggaaggugaaaggcacaucuuacaugguggcaggcaagagagaaugagagccaagcuaaagggggaaaccucuuauaaaaccaucagaucucgugagacuuauucacuaccacaagagcagcaggggggaaaccgcccccaugauucaauuaucucacaccuggucccuuccacaacacaugggaauuaugggagcuacaauucaagaugacauuuggguggggacacagccaaaccauaucauaugggaagaauaauauugggguaaaaacaacauauauuuuuaaaaguuaagcuuugacagcaaaagggucuguacuucuaauggauagcuuagcuuuauuuuagggauuuuuuuaaaaauccuaugcuaaauuuauuauuuuagcuaccaguguuggaauucauccuuuuauaaugcagauucuucauucaugugccgccaaggauuugucgagugccuuuaaagcaucuggucauuuagguaaucauggggacauaaguccucaagaaauucucaguugaggggaggaaccaguagguaagcacagggcaccacaggccuugaugaaggcagacaccaggugcucuggggacacagaggcaaggccgauucccaggcauggaaaaguccagaaaggcuuaugggaacaggugacuccaauggcuggauguagccaaaggaagugcaagggaacggauucccaucacaggaacagcauguacuaaaugucugaggugagcaaauccuucuuccagaacuuagcaagaaccaucaaugguaagaggaggacaaaaggccaaggaacucugaagucgguugaaagugugaucguaucugucaugccaaacuccuaucaacucuaguagggaaggcaccagguucaagaggcugaagaagagacccagagccagcagaugagacaugggguuucauugagggcuuacauacaggggagggaguccaaugcuggcuggcuggucaggagaacaagaccugcuugcaaaaugcaugcaauuuacauagcauuuuuacuuagcacacucccccagcaaccuccacauggaaaucuuaauucaccccagacuuggggccucaauucccuguguauagccaguguuccacgggaggagauggggacucagauguuccucaucaacaaggagucaaucucuggguuggccacuccuagauucccuagcucagaacacacauucaggugugucuggcaagaagggucauucucgggguaugcuugaguuauugcuuucaggugcacuuacauacgauguuuaagugcugaugagagagggcaaguagcuagugagguugcagaugggugagauaaggaggaugauggcaaagguuccugcagaggugggagaaggcaguauccacagcaagaggacaaagauuggccuuagacagguguugagcugacaggugucgaggugauccucaggacagcaagccaagcugaaaguuacaaucaagacuuuguucccucacugcaacaguacaggcaggaggcaaagguaggcaccgcucuccagcucuccagcguccggagguguugguuaagggucagguggaucagcaggcaugggggagggagggcucuuuuccuugcuaagcaguccugaacaaaagguuccagccauuccugcaccuagggaggggaagcauaaggaaggaagggauaggagaagaaaggaacggagccagcauggaggaaagugccucaucugggcccugaucaggaggccucugcacagaggcaccuggucugggacugcagcuauggccaugaucccagcuggccuggcagggcagagcugagucauaaauugcaagucccuccagaaauggcagugcccuggucaugcaccaugucuaggguggggauggcagugguccccgggaggucucccaggcaaggccuugccaucagaucacacauaggauuuuggccaggagcaggacuccuggaacggaggcuggagggaggcaagccaaaaugauagccacaucauuaggcccaccuucucugggucugccccuucacuggguaaauaaaaagaucagcuggccaucuuuuccaugggaacauggggaugguuauuguaagaguuaaagagguaagaaacacaaaaagcagcucaacaguaaaagacagauuuauuuuggagaauaaacuuuagaggggcuucuggccaauuuugcucaggagcauucucucuuacagacuaaggguauuuaaggguguaggaaguggggagcuuaucgcagguucggaauguuucuaugugagggaaaguuuauugugggguugggauugggaugucugguuggaggggaggcugucucaggguuggcguguuucuggucagaggggguuuaucuuaggguuggaauguuucuggugaugcugacauuaggcauuaggcugauguuugggugcuugauuuggguguuuuuuuaaucaaagggaacuuaaaauggugguguuucuccaagacgacgaucuccugcucugucaauccagucccuacaguuauagaaaggaagaggggugguauauucuuucuggcuacuuccugcugaguggagggucagaggguucuuuggucuuggguugauugugggaguaaugccaucuguagauguuuuuagguaauugugagauguccaugauccugucaguuaaaaaaucuuugaaaaaggugaauuaagccagguaagcacauuaguccuaggcauauuauuaggagagggcccaagaaugggaugguccauguuaggauuuuguuucuaaaccaagaauguauuugguuguuuugguauuccuuucacguuuuagcccuuucuucaaguuuuucagcagcaucucuuacuaggccugauugguugagauagaagcaacauuccucacucagugagaggcagagacccccuuuuucagccauuguaagaucuaaucccagucuauuuuggaggacugcuccaggcaaggagucuaauuggucuucgacucuuauaaggcuuugggcuauaucuuuuaauaaauccuguaguucuguugaaagaacuuuaaaguauguuaaggaguuggccagucugccugcucccaauccaagcccggagguuauacauaaggcagccauuaaaggaaugacuuggaugcuccuccuuuuucuaacauacuggaugaauggaacaggugaagauugauuaggaggaacuaguccaacggagggagaaagauaaacuaggguacagguucuggucuaguugguggggagaaaaagauauguguugguaccgcauaaaaagaacaagccuuugucauaaugcaggcggagauagggaaagaagauaagcaaauuaaagaugggguguuuuuucuuuccugcgguuuuuuacuccagguggacaaggaggaggccagggagacacccacuauaguagagauauaggaagaguuauuuuuuacacauuuaaugcaaucggauguugcaccauugauauugagccauggaaaaaguugggcaccaggggcagcgcaaguuaggcaggaggcauugguugacggagaggcuguaaacuagcugguugcagaaaugcuccauuuguuucaggugauacuugguagucaacguggcuacuuugauggucagagggguguuuaacaaugauagugugauugcauugguuagauguuaaggacccuacagggaaauuucccuccgaggcugaaaagcaaagugaggcuuguuguaaaagggggguguguguaguuaugggcccuucaaugggagggucuuggugcuuaaggcauuguagagaguuguaauagguuugaaauauuuuguuggcccgauuggcccuggaagugaaauaaucucugaacagggugucggcucucucaaaaaaggaagcuccuuuugggaguuuauaaguuaggguuauauuuccuguucaaaggucaugaagggguguaggaagggcuguguaagcugaggaagacagcgauaagcauauccagcacucuggagcaaaggaagaguuagcuuugcagcaagagggauuguguaagguuuauagagcauucuaguuugagagcagugaggagugguuuuauuggugagguugauaugauuagggaauuuauauugaaagaaacaaucaaaaagagaaaaaaguuauuuggguaguaguaaaguccuggaaaguuccuugaagccauagguaccauagaacagucagaaacugauuagcauguauaaugggagcuuuguaaggguaccacugaaggucuguagcaagguugguuaggaagcagugaaaguuugggagagaaagagacauaagcagcuuauguggauuucucuuccuuuuccuccaggauuuaggugaggcgaagggaaguagguccuguggagacacaagagaaggcugaagggguuuuagauuugguuguuuguguauguggugaagggaagucuguuuucuugagagagguauaaugaaaccaguuggggagucccuggaguuuugcugccauggguguaguaaggaugaucugguaagguccuuuccauuuagguguaaggagggaauuggggcuaggacugggaucuuuuaucagaacccagucuccuggcuguaggaagggauuagaggaguuggugacaaguuguggcagguguuugucagcauauucccaaaugaaauggcagaugguauguacaagaggggaaaugagagggguuggcagagguggggcuugacccugagguggaccaaaaggggcaaguggucucccauaugugaguucaaaggggcugagcauuaaagguuuaugugagagcaccugaauuuuuagaagggcuaaaggcaaaaguguaaccgagucuuuaugugucuggagugaguaccuggugaggguguuuuuuagaaugccauucauuuuuucaaccuuuucugaagauugaggucgauaggggauguguagcuuccagguaauuuguagggcuugugaaaguguuugaguaaucugagaaaugaauucagggccauuaucagauugaaaagaaagaggcaccccaaaccuggggaugauuucuguuauuaauuuggaggugacauuagaggcucguuuguugguugugggaaaagccucaagccauuccaaaaagguaucaaccagaacuaaaagaaaucaaacccuuuuuacuggggguauauggguaaaaucaauuugccaauccuguccuggaagguguccccuggcuugauggauugggaaagaagagugucuaguguuggaauggggugaagcuuucuggcaaauagagcauugaugggaaauggcuuuuaacuguuccuuuauaucugggguuauguguuuaugggaauuuaagaaguguuguagaggugaauggcuagcauggaagagguugugaaugucccguaaaagaguuguuuuuuucagggucagguaggacuaauuuguuuuguaugaaucaguuugggggguuugaauugugccccugccaugauuaguuguuguguuugguguucuggauaaaagaaggggauauguuguaugaagggaaauaaguauuggggaauugggugauugguugagacauguuuugcccaguagucagccucaugguucccuaaagaaauguggcuuuugucugauguucuuugccaugaauaacugcaaccuuuucuggaaguagaagugccuuuaauagaggaugaaugagcuuuccauuaaugauagggguuccuauaacugugagauagccccgcucccuccaaauuuaggcauuggaauggaugauguuauaagcauauuuagaauugguguauuauuaacuuguguguuuuuugguaggguuagugcucuuauuagggcaacuaauucugcuuguugggcggaugugcccaaaggcaagggggcagccucuaucacucuucuagaugggagagaguggguaucauaacgcuaucccucaaugauggcauauccugcuuggagaggaggguuuuuugaugcacugccaucuauaaaccagucuggggcucccuuuaugugaguggaaguaagauggugaaacaugguaggagaacuuucaauuagaucagagcaugaguauuggucaggaucuaaaaucgguauugaggguaaaagagaggcgggauuagguggggagcaucuaugaagagagauagcggguugaaggaggguuaaauguaaggcuugcauaugagaggaugagaugggggugagcgccuauggcugaccauaucuuguagacugugagaagaaaauaccugaagggguuuguagaacaugaguuuuugugucucagagauaauuagagaggcuguggccaaaauuuuuaagaaaagggaccagauuuuauaaauggggucuaguuguuuugaaaaauaugccacuguugagaaggagucucccauaaguugggcuaauaguccaagggccugauuaugagaacuguguaaauauagaugaaaaggucuuaggagguuuggaaugucuaaagcaugggccugcaauaaggcacguuuuagaugagaaaaagcaugauaaaggucuggggugggagugagugguuggucaagauuuccuuuuguguguucauaaagggguuuagcaauaauggcaaaauuugcuacccauaaucggaaauaucccacuaauccaaggaaggaaaguaagucccuuuucguuuuaggaaaugggauuuguugaacaccuugcuuucaugccaacagcauuucucggguauuuggaguuaugaucaguccuagguaugaaacuuucggugagguuaauugggccuuccuuuuggacaccagguacccacauucagccaaaacauuuaaaaucuuggugguguguugaauacaauggucaagaaaggggcugcaaaggaguaaacuguccacauauugcagcaaaauccuggguuguagagguaguugggagaggucuaauugaagugacugaaauagugauggcugucucuaaacccccaggggaggacaguccagaugaguuguugggaguagccugugucaggguugguccaagugaaagcauaaagguuuugagaggagggauguagagggauaguaaaaaaggugucuuuggccaggugcagggcucaugccuguaaucccagcacuuugagaggcugaggugggcggaucaugaggucaggagauggagaccauccuggccaacaugguggaacccugucucuacuaaaaacacaaaaauuagcugggugugguggcgugugccuguaaucccagcuacucaggaggcugaggcaggagaaucauuugaaccagggagucagagguugcaguagauuuugcuacuaaauguacuauaagaaaaaaaaaaaauucaaaaggaccuucaaguauuuucagaaauuuuuaaauuuuggaguugugaauaaggacugugggccucuauuuuuaaaaaaugcauuuaagagucuguacuucugucccuacaaguccgauugugcaucaaugccccauugcuuuuuagcuaugugauacugggcaaaucauucuuuacauuuuuauucuucacaaccaagauguaagccgaaauguguuuuuuuuucuucugcauuuuguguauuaaauaauauacaaagaugacacaacugggcuuagaaaguauuucuuaaaagacuagauuacagccuauguaauauauuugaaauugauaauauuaucuguauaaauggcaaggcugcuuuuuagauccauuccugacuuagccccucuauacuugcucuauuuuccagcuauaauaguaaucaaguaguauuacauuuucagaucuccaauuacucaauugcaccauuuugccugauuauuuugaccaucauaaugaaagcagcucggccucucccaggcccccuaaucaguuauucagcagcugacaauggugacagccugaacgugugaagugacuagaaggaguauauuuuuccuuucacauaaauguuacuaaaggugaaauccaugaagaguaauaaaauuuuacaaggaaauguuaaaaaauauuacaauuacaaaaggggucauuaucaucccuaaucaaauaaagcaucaccaauuggucuuacuugccagauagaaaaucauucaggagagaugauuaaaaacauauuuuacucaaggcuagauuugucgucagacgcacaucccuggguuucuuuucccucccuucucuagacauuauccagugguugagugcuuaagguagguugguuaauuacaguauuagccaaggcacaggacaugaccagaacaaauuuucugcaagaaaaaucacaugauguaucgcaaagugaaauacagacuuuaaaaaucagcaauugucuauguuaucuugacuuggguccaggccgucuuggaggcugccucccagcaauguuuauagggcugcagaauggugugggaaaauaaaguguggaagcacaugggaggcuuggggagggcacucacccugaaucugcuucagcacuauuuaccagguguguagucuuaggugacacuuaauuugucugagcuucauucauuuuuaaaaugguaaugaugucuaucaaacaggcaugauaacuaagagcccuacuuacacauaguaagacuuugaagcuuggagagcuugcauaacccacacaaaguuacacagcuggacagcuggauuugaaguugucuacugcuccuaccaacuauuauccauuaggucacuucuagccaagcaaacacacuagaaaguguucaguuaggaaauacuuauugagugccaagaauauaaauauuuugucaaucuguaccuggaaggaaaggccucuggaauaguucaucacaaacuucccagaggacuucaggaaaucaagaaagguauagagguauuaacauuuuggggcacagccugugaguguuaggaaugaucaugucaggaucccaaaccagcaccugauagucucugugccacagcagaaacagcauuugucuaagaagaucccacacaugagacaggugaaaggauguuccaagugacagcuugugaagagguguuugaauggagaaugagcaacaaugcugaaccaacacaaacaucugucauccuuacauacugggugaggcucagcaugccggauuccuuuucccaguauuguucauuccuccaggauccucauuacccuccaucauuccccuuacccuauccaaucagaagcgucugcauaauuccguugcaaacacuuuggcugcaaguaacagaaaacuugauuccaguugacuuuaagaauaaggaaauuuauuccauaaaauucaagagaucagguagcuuucaggaagucaggacuggaucuuucacugaaauucucuuaauuguuguuugaauugucaguguucccccaaaaauguauguugauaucccaacucccagaaccucaaaauauaacuuuauuugaaauacagguaaucaaguuaaaaugaaguaaucaggguggacccuaauccaguaugccugaugcuuuuaugaaaagggaaagaacagacacaaauaugcauaagaggaagaugauauagacccacaguauauuagccugcucucacauugcuauaaagaaauaucugagacuggguaauuacaaagaagagagguuuaauugcucccgguucugcagguuguauaggaagcauggcagcaucugcuuggcuccuggggaaaccacaagaaacuuacaaucacagcagaaggcaaaggggaagcaggcaagucuuauauggcuggagcaggaggaaaagaaagagagaggaggugcuacacacuuuuaagcaaccugauuucaugaugacucacucagugucaugagaacagcacugagaagauggugcucaaccauuccugagaaaccaccccuauaaucuaaucacucccaucaggccccaccuccaauauuggggauuacaauugaacaugagauuuggguggggacacagaucuaaacuguaugacacggggauauggccaugggacuggaauggcaucuacaagccaaggaaugucaaagaaugcuggcaaacaccagaagccguaagauacaagggaagauuuuuuucccuagagcugucagagcacagcccugcuaacaccuuaauuuuagacuucuggccuccauaccugugagacaauacauuucuguuguuuuaagccaccagguuuguggagcuuuuuuaccacagcccuagcaaacucauacagugaccuucuccauggguugucuuccuauguuagcaaaauggaugugacauuuccaggcuuccugaugacaucuagaggaauauguggguccucuguucccaggccuccuccuuaggaccaggaaaccuuuucuaucaucccuuuccuuccagcaaacuugcugucaucucucauuggcaggauugaguaacagggucauuccuagaauuaaaauuacuggcuuugguuaaucacaugggaaggaguagauguugugaagacaacuacuugggucagacccaaaaccuggacaagauuucucucagcucugucuccaaagcugcuccuauauuccccaugcaaacaagguuuguaaauagacgugguagaaagaaagcugguguuuaauuccuuucaccagaaacaucuggaccccagauccuucccaagaugcccaaauagguagguaccugcaaaguagcuagcauagggcuggacacagaguagaucaguuauggauuccugcucucccuguuuuuaugguacuggucaguuucuaucacauaccauugacauuacacaugggucuuacugccuuugcuagucuacagguaccuugagguugagagcaugugcauuccuuacaccuccaagagcacuuaacacugugcagugggaucuguaagcaucaguaaguagagucagaaaggaagacagcuaggacucuaucaguauauaagcccaagagauggagaagggaugcucgaauucuacucgauggaaaaacaaagaaugcuauauugauagaauuuaauaaaacaacuuugucaucucaagccaauaacuuucuguucuaguuuggaccaaacagcuacacugcuaaauagaaauaacaagaugaaauccugauguaaggcaauaugcaacaguuccuguuuuguugggaugaauauauuguaugaguacaauuuagaugaacuauucauucuggaacagccuguacagguccuaagacagauugccauaagcaagaacaaccacagucuuucuguaacaaaaacaaauugcauguuuuuccauaauugccuaacaaaagcucauaagcagcuucaguaagauuuuacucaguuuuuccuccauuuauuauagaaagcaacugccucuaaauuacugaaauaaaugcaguaaacauucacuguccaucuuuaaccagcucuguaccuuuauuccuucugauuucccacuaaaauaauaaacagaccucauauguuuagcgguuguauaaauggggauaguuuuuauuucuaaguaauauauuauccucuauaacacaaaguacuuaaauuuuaguaugauuuauuugauauagguuuucuuaauuuucauucucuaaauguuaauuacuugcucuauugaguuuucacuuauaaaauauguccaaaacaguuauugcacgauagaagcaacaaaugcuauaaaacacauaauuaaaaauuaacuuuccuuuccucuugccaccaaaaugacuagucgugcaguuaguuguauuaaaggaauuaccaaaaaauuugaagaaacaauuugcuccuuaauuuuuuaaauuauuugucagauguagugagagugugugacauuuuuaauagauucaagguuuauuuuaauauuuaaaacuauuaguucaauuaauauugcugaaaucuuuaauuuuuguucugucuuucauguauuuuuaauuuuaucaugaaauauuugaugugcaaaaagauaugaauaauaauaaaacauacuccucuguggccauacuuaacaaacacuaaauugcaauagaccugaagucccugggugccucuuccugaucucuguccucucacucucccauggagaaucacuuuucugauuuugauguguguuuuguuaauaaauuucuuuauacuuuuaaugcauauauggacaucaacugaaaaucauauaucuuuuguguaauuuaaacuugccuuauauggucucauucuguacuauuucuccugcuaauugcuuuuauugcucaauauuauguuuaugagaguuaccuaaaugaguacauggagcuguauuuuauuuauugucauuacuguauaaaaagcaacuacauauuauauugcauauauaauacauucuuuauacagacagaacacaauuuauuuuuucauuuuccugugcaguaggcagauucuaagcugucccccaugauaucuccgcacgaguguccauacccugcaucauccccuacccuucgauacugguaggauuugugaauaugaugggcugucauuccugugaauagguugcuaagcauuuaauguugagucagucauaaauagagauugucaugugugggccuguccuaaucagagguacuggccuuuucuuagauuuaaagcaagaaagggucuucuguuggcuugcauuaggagauauaccuaauguaaaugaugaguuaacgggugcagcacaccaacguggcacauguauacauauguaacaaaccugcacguugugcacauguacccuagaacuuaaaguauaauaaauuaauaaauaaauuaauaaauaggaaaaaaaaaguaagccuccauguugugaagugcuguguggccaagacccugggcaacagccaucaagaaagcaggacucucaguccugcaacccuaaggaacaacccucugauaauaacccaaaugaaguuagaagaagaccgcaagcuccagaugagaccaaagcccagccagcaucuugauuuccaccuuuugagacucugagcugagagcacaguuauauuacaccaugcccacauucugaccuucaaaaacugugaaguaacaaaugaguguuaagcugcuucguuugugguaauuuguuacacaucaauagaaaaguaaugcauccagguguuggauguuucuaaauauuguaaauccaaacaguacugcucugaacauuuuuguacauugauuugugcacaugugaaauaauucuuuuuaggguauguaucugggaauagaguugcugggucuuagaauaaacauauccucauuucucauugguauugauaaacuuucauuccaaaguaguuuuaccaauuuauccuaagcuaucagcaguauaugagaguauucucuacuuuaccacucaggaacacuuggucuggucaggcuuuauuuugcuugaaacacuuagcucuucauuuagccugaauugauuuuuguggcugcugugagagagggaacaauuuuauuuccauuuggauaaacaauugccacaguaccauuuauugaccaaucuauucaugcccccuaguucugcaucauaugccagcugugucauaacgugguuccauaugugagugcccaagucaagaggcacaggcucccuugucauccccuuuugccauugaauuuuuuuuacuggaucuggaucaaccuccucucugagguuuaaaaccaauaacuauauagcuuugcucaaguaucucagcagucuccuccuuucaaagguucaugacuuuguaccuuaucucugacacaacauuaaaaaccaaagucuagcagagaucggaaauucucuagagaaacugacuuuucuugauucaagcuacuucuuagcuuuuggucccuggaguuuuuaauuauuuucuuggacuauucaccuuuaaaaggaugcuuuuugcauuuuauccagaauuuccugggguuuuugaaucauuuuuuuccauacaggaugagaaacugagguucacuaauaaauuuuugagaagaagaaacaguacuccauggacucucagauggauagacuuuuuuaaaaauuauacuuuaaguucuaggguacaugugcauaacgugcagguuuguuacauauguauacaugugccauguuggugugcugcacccauuaacucaucauuuacauuagguauaucuccuaaugcuaucccucccaccuccccccaccccaugacaggcccuggagugugauauuccccacccuguguccaaauguucucauuguucaauucccaccuaucagugagaacaugcaguguuugguuuucuguccuugcgauaguuugcucagaaugaugguuuccaccuucauccaugucccuacaaaggacaugaacucauccauuuuuauggcugcauaguauuccaugguguauacaugugccacauuuucuuaauccagucuaucauuguuggacacuuggguugguuccaagucuuugcuauugugaauagugccacaauaaacauacgugugcaugugucuuuauagcagcaugauuuauaauccuuuggguauauacccaguaaugggagggcugggucaaaugguauuucuaguucuagauccuugaggaaucgccacacugucuuccacaaugauugaacuaguuuacagucccaccaacaguguaaaaguguuccuauuucucuauaugccuccagcaccuguuguuuccugacuuuuuaaugaucgccauucuaacuggugugagauggcaucucauugugguuuugauuugcauuucucugauggccagugaugaugagcauuuuuucaugugucuuuuggcugcauaaaugucuucuuuugagaagugucuguucauauccuucgcccacuuuuugaaggaguuguuugauuuuuucuuguaaauuuaaguucuuuguagauucuggauauuagcccuuugucagauggguagauuguaaaaauuuucucucauucuguagguugccuguucacucugaugguaguuucuuuugcugugcagaggcucuuuagcuuaauuagaucccauuugucuauuuuggcuccuguugccauugcguuggguguuuuacucaugaaguccuugcccaugccuauauccugaaugguauugccuagauuuucuucuaggguuuuuaugguuuuaggucuaacauuuaaguuuuuaauccaucuugaauuaauuuuuguauaagguguaaggaagggauccaguuucagcuuucuacauauggcuagccaguuuucccagcaccauuuauuaaauagggaauccuuuccccauuucuuguuuuugucagguuugucaaagaucagaugguuguagaugugugguauuauuucugagggcucuguucuauuccauuggucuauaucucuguuuugguaccaguaccaugcuguuuugguuacuguagccuuauaguauaguuugaagucagguagcgugaugccuccagcuuuguucuuuuggcuuaggauugucuuggcaaugcgggcucuuuuuugguuccauaugaacuuuaaaguaguuuuuuccaauucugugaagaaagucauugguagcuugauggcgauggcauugaaucuauaaauuaccuugggcaguauggccauuuucaugguauugauccuuccuaucagauggauaagacuucagauggauagacuuuuuaaaaugagcaugaucuagggcaggccaucccaguguuugccuuuacuguccgcagccucacagucuuuugccuuuguuugcauugaggauauuguguccucuuugaaugucauagccucagcuuuacccucccucagucugccacaccacugaaaaucaucuuucacaaaauaucugauauacccauuuaugaugaagauaaauaaaucauguucuugguuuuucauucauaauucuaucaacauucuuuaugcaacacagcuaggaagcauaccgacaugaacaaauguacucacugcccucuuuaacuauagcauugucaagaacccaaggaaggacugaaacaacucaucccauaguagaacacauaagaaagaucucaaguaagccaaaggugacauaugcuacaauagauguacucaguucuaaaguaauagcaaagacauuugggagaguauuuuaaaauucugggaauuuacugugugccuagcacuuccaaauaucagcucauuuaaugagagaaaaauauugcuuccagagaaggaggugugcagagcuuuauaaagauuugucuuuaggggugaauauaauuucaacagguagagauuugggucauggcauuagaugaaggcauuccauauaagaaaaaccaaaugaguaaauuagagacauggagaaucacaggcauggagggacauaugaccaaaggauggcaguagcaaugggaaaccagacauggagggucuucagugguuggaacugugacacaagggagcuuuugaagauuuuuacuuuauuuuuuuuaauuuuuuuuuucuuggagaauagcagaagagcuauuuugaggaaaguuacacuggaagaaauguuauuucuaugaggagguauuuucauugaacaaaauucauuuuuauugaugaaagacaagaauuuaugaucaguugauaaauuucaggcaucuuuggagauauuuuauauuuuuuucugugaggcuguuacugugucaaaucuuucacaguuucauaaaauugagucucaucugaagcuuuaggccagauuguuauccaugguugagcaugacucugcaauagaaacuaacaauuuggcuuauuuuaaagugauaccaugagauauauauauauauauauaguuuauugucauugucuccccccccaaaaaaaacuguaaaauuaauuuucauuauuuccuuucuacuauaacauuaggguuuuuuuuuccuugcuccuguuggaauuuauuuuuguggugacucaucuguggcauaaugaugaaaugauaaaauaauauccuguguacuuccuuuuagaggaugaaucacauaaaauuggccaucuuuuccugcuguuguauauuaauaucauugguccacugaacugcaaugaucagaauuaugacuuuccuugaauaaagcauccuguuuccuaccccuaacccuagaagaguacucuuucagggagaaccuauuuuugcagcucaucuuauuuugguaguuuuucaccaaucaucuuauuugcaauuucccaacuauuuaauugccaucuuacauuaauauuauuuuaauaaucagacuguuccauuguucaaauuuuaaaaauaaaugaaagucauuaaugaaaaguauugucucauuccauuauaaugagcuuccucaaguauguuuucagugaugaaaacaugaccguguuauuaaauauuuuguggauucuugccuacaaaaagaggacaguucauacauuugugucuguaugccuuuuagcucuacugcauaaagaaugucgguggaauuuugaacaacaaaacaggcacaugauuuauguagucuugccuacaaaaaauacagucuguagugagacucuauugucagucucucauggcuacccacaauuuccuaucaauaaaacaggauaauaauacauaacuuagaggauugguaggaagauuaaaggaaguaacaggugcaaaguaguuagcacugcgccugccauguaaacaggcacuuaacaaguaguagcaguuguccuucuuaaaugcauggaaagcccaugucuuagcauggcaugcugaauuccuagcagcacugagguagcccagcauccaaggguaaaugacuggagaauuaauggaauggugggcacucaguuuucuguguuguauagaaaguuuaaaacuuuaaaaauaguccccaauuccaguuuaggagauuauuuuuaaucagucuuuugcgacuuuccagacaaaugcaaaagguaaaaaaaaaucauauuacagaaaaauaagacaaaccgacaaguuauuuccagacgcggaaauagcuuaucauuaacuauuacauauacggaacuaaacagagaccauucacccaaugauauguauauucauucuuucucuuggguauacccuucuuggauguaacacccagagucuuagugugccagaagacuaaaaugccuacuucugcagaggacugucucuaacauuuuuucuaggaaucaauguugaaaucuuaauuuccaggaagcaugaugggauaaagcauaauguguguacgugugugagcaugcaucuggcugagcacaugugcaugcagauggggguggggaaggagagagggacccccucuaagcaaauggaagcuaaugggcugcauccuauaaucuuaaauugugcaauacaaaaggaaaagcagagcaggugggaccagaugcagaaagaaccuuaguagcuaguuuagauggaggucugcaguauugcugcuguggcuuuugcuguugcuucuuuguguuguuauuuuaguuuucagaauuccggagaaaaaggcaacaggcaaaagauaaaaauccugccucaauccaacagaaauguacuugcuaaauuccugugagaacucugcaaaguuggcaauaaagaaugcauauuaauaugaaccaccaaaaagugaauucuguuaacauucuagacaaaugucacauuugcugucucuugggauaaaccaagucauuucaaguugaguaaaaugaaguaaagccagugggauuaugcaaagguacagcaaaugaaaggaaaggcaacacucucuugaagagcgagggagaacuuuccuguauuacucacuagacaaagauuauuaucuucaucuuauaguugcugccaauucaacaauaaauaaaaagaaauguuuauuauauuuggccuuguucuaacagaauauaauguguccggcaauaauuauauccaggucaaauaaauuuaaucaaaauuuaaaguaauuaaaaauaaaacaaauuaagauggaaacaaaaaauggcacuccaaaaccuaaaaggcucaucaugaggacacucauguuucccagaaucccggaccaagcgugacuaauuuuucuagcaaauauacacuuugauagacaaacauguuuauacaaguucuacagugauuaugagguaccaacuaguuccuagagaagcauaauuauuccugaucaaguccagaaagacauuuuucuggauguuauuaaucuuaaugguuacuauaugugauugcuuuuuaugugugagaguuuacaagagccuugaagaaaaauggagagauggauggguauacacagagagagagaggugcacacacacauagauauccacauauaucuaauauaauucucaaaacgacuucauuaaggaaaauuauggacguuauaaaaaagaagcagugaggaacagcaccagaaauugaugagaaccaacaagaaaacauauaaggcuacaauaacuagaaguguaugacuuaggguucgcagacagaugaaugggcaaacacgcauugcuauaaagaaauaccugagacugagcaauuucuaaagcaaagagguuuaauuggcucaccauucugcaggcuguacaggaaguguagcaccagcgucugcuccuugugaggccucagcaagcuuccagucauggcagaaggugaaaggggagcaagcgguuucacauggcgagaacagaaacaaaagagagaggaggcgccaacucuuucaaacaaccagaucuccugugaauuuagagcuuagagcgagagcucacucguuaucauagacagcaccaagccauuugugagacagcugccccgugaccuaaacaccucccagcaggccccaccuccaacacuggggaucacauuucaacaugggauuuggaaaggacacacaugcaaaccauaucaccauauauucacucaaacaacauguaacaaagugucacaaugaaugauuaaaagacauauuaaacaaguuaaguugggaauacuaaagcccucucauacuguguccggaauuguuggguucuuggucuugcugacuucaagaaugaagccgcagacccuugcggugaguguuacaguucuuaaagauggugugucuagaguuuguuccuucugauauuuggacguguccggaguuucugccuucugguggguuccuggucucgcuggccucaggagugaagcugcagaccucugugaugaguguuacaguucauaaagguggcacaucuggaguuguuuguuccucccgucgggaguucuuugucccuccugguggguucguggucuugcuggcuucaggagugaagcugcagaccuucguggugaguguuacaguucauaaagguggcgcaucuggaguuguucguuccuccuguugggaguuguuugucccuccugguggguucguugucuugcuggcuucaggagugacgcugcagaccuucguggugaguguuacagcucauaaaggcagcgccucuggaguuguucauuccuuccgguggguucguggucucgcuggcuucaggagugaagccgcagaccuuugcggugaguguugcagcucauaaagacagugcggacccaaagagugagcagcagcaagauguauugcaaagagcaaaagaacaaagcuuccacagcacggaaggggacccaagcagguugcugcugcuggcuuggguggucugcuuuuauucccuuaucuggccccacccacauccugcugauugguccauuuuacagagcgcugauugguccauuuuacagagugcugauugguguguuuacaaaucuuuagcuagacacagagugcugauuggugcauuuacaauccuuuggcuagacagaaaaguucuccaaguccccacucaacccagaagcccagccagcuucaugucucaauacuauguaucaaaacauuuucuugaugaauuagagcaaggauauuuaaagaaugaaaaauguagagaacaaaaagaaaauaaaaucuuaaucuuggauagucaaaggccaccuaagccuaacagaauaaaaucaauuacaaagaagaaugaauuugaauuuuuaaacaagucaaaaauaaccaccaaaaauauuuucuaaacaaaauaugaaauacaaccuuaacuuaccauuucaguaagaaaaugucaaauggacaagauuuauuugcuauauuugguuuuuguuaucaacaaugcacacugcuggcaaggaagcacagauacugugauauauugcauguggcagugaaaauuuguguaacuuuucugagaauugguuuuuuauuauauaaaaugacacuaaaaagcaucuuauccuuugaucuucuaauugcauuuauaaaaaucucuccuaagaaaguaaccugagaugcauacaaagauugaucuucaaaaaauguuuuuuguugcauuauuuacuguuuugaaaauuuugaaacaguuuuucuguccaaccauaguagaaugacuaaguaaauuuugaaauauagugguuuaucaugcaauuaucaaaacuauauuuuuauagacuaauuagugauguaagucaugagugagagaaauggugaugauaaaauauuuuuaaaaauuuuaccaaacuauauuugcagcugaauucaauuuugauucaaguacauuuguaugccuagaaacaaacugauagaauguuuaaauuacaaaacaaaauauauacauuuuuuguuauauguguauauauauauauauauauuuaaaaaaccuguuguuugaauuauuuuaugcuucauauauuuugguauuuugagauuuuuuacuaugaaaaucuucaaaaauggaaacagguggacugauaaacaaauagauauaaaaccuuacuuuauaguuaaacaucagugagaaaaaaacuauuuuuuaaauggcaaguacaugaacagguaaaguucuaaaagaaagaaaauacacacacacacggacaugcuaguuauauuuacaauaaaacuaauuuagguuuuugacuuguaaaauauuuuauuaaaguaaaauaauuucaauuaaguguuuauucauaaacagcuaucaaguuuauuuuuaagguauuaaaguacuaaauaagcacuauuagaaguguggcuuugaaauuuauaucugcaaaagaccacaucauuuuugauaaagcucuuuauuugugagcuuagugaagagaaaugagaaaucaaaguugauuacacagguuacuuuuucacaugauaagagaaagauacagggagggaggaaggcaggaauugggugagauuuuagaaaaucucagauuuaaaacuuuuaaaaauuaaguauugggcaugaggaaaugagcagagaaaauaguagucauauuuccacauuuguaaagagaagaacaauagccaggcaaacuccaugucugaagugugguuuauuuuaauaugcaaaacauaagcauuucucugaccaaagcugcuuucuauuuaaagcuaaauauaaaaauauuauuuuugagcauaguauugcgagaacauagugaaauuuccuauguagauucugugcuguuuuaguuacggaaauauuuuuaauuaauccuccauuuaacaauggggcauacaucuguguuuuucgaagcacuguuuuguauauauuaguaauuaucauugcacugaaaugaaaauaucaauuucauguacaauuuuauagcacauauuugauugacaaugaaaugcauuuaacuuauaaaaauguaauauggcugacauuagcaaaaucucuuauuaagaaauaggucauaaguacuccaagaaacuugacagucuguucuaugaagagcauuaauucaaaaguccccuauuugcauaaaucuccaggucucauuuucacagcuguuuguugucagcuagacgguugcaguucaacauuauuuuaacauaaucggugggaaguauaccuuucaacuaaaaauaccaugcucugcaagaaagauugucagggguaaaauauaaguucauucaguugaucuugauauuuuuccuuaaaauaaauauuucuaauacaggaacuuuaagucucaaauuacugaaauauuuuuauuauuaaaauauauuuuguaauuuuauauuuucauaaaaauaaaaagguuauguguucauacauaaaaauguuaaucaguagagcuuauuuuagcaaagaguaaaaaauacugaggauaucuauuuuucauuaaucagccaagcauuauauggagugcaauauaggugugcuggaaaaaagaggauuaaaauuuuuagauauugcugagaauaugcauguauguucuuuguuuuauuaauuuuaauaauggaaagggaucagcaauuauuagaucuuaaaugucuuuuaccuguaacacccaagagcacagaaggaaucaaagucaagagaucucagccuggauacugagcaacaccauuugcuaccuguaagcuggaguucuugauuuaaacccuauguacuucagcucuccaucugcaguaggggccauuauaucuacaguaaucacuucacagggucauugcuaagauuauauuaaauaauggacaauuaacuacugugggaauugcaaagcaccauacaaaugcuaguccugguucagugccuguucucauaucauuucaucuuagcugcaaugaaauccuaguacaaauucaugaccuuguccagcugucauuuaugguauaauacauaaaaguuaacccaagcauagccaaggaaagagacaauuggacauaccuacauauauuuucauaacuagcaaaaagauucgcugguuuuugccaaugugcuucuguuacuuuuuuuuucuuuuacucuugaaauuauauuuaaguguagacuccacuuaaaguaauuugcugcuggaauaggcauaauguucugaugucugcuuugcuucuaauuauguucaagcucauuuugacauuuaaggccaauuacaaaagucuagauucagaagacuuuuccuuagucaucuaaaauuugaacaauaaacaguuuuuuucuccucucucuuuauucauuuaagugguaugcuuggcaacaagcauauuuugggaauuguaaaagcaaaauaaauaauguggguucauuuugaaaaaagaacuacuuggucuuucuugccaacauaaaaggcagucacagaauuaacugaaaccaccaguuucaacuuuauuuccuccuaaaucacaaggaauaaggaauuauuuuacagauacagugauauuuuaaacgccuaaguucuauuaacauaaagguaauugacuucaacagaucucuaauuccaaaagaguucauacauagagagauauguauaaaaauagcuacaaaaucuuuaucauuuaaaagucacucauaauuaaacuccccagacuaggacccuacaccaaaauucaguuaguguuccauugcguuuuaacauccagucaugugaugacuuacgacauagagcaaagcacuuaauuuaccugccuccuuauuuucagucaauuugccaacugcaauuuuuacuguugauucaguagaagacccugaugaguugacagcaccaaaaggcaauucauagcaucuauuaguaagaagucacuguagcuucuuuguuuaacuuuuauagguaagaucuggcuuggaaaaauagacuggaaaguauauuguaaaaaaaacaaaauuuuccaauugacugucauuaacaguuaauagauuauagaauaguagaccuuuauagcuggaagauauguaucguguacuucaaagaugaaaggaaauaaugucuuugaaaacacugucaaauuuucaaaauuauguaucuaaaagaaauuccuuaaaaaauaguuuauccuuuauaauuuuugaacuuuauaaaaauggaaucacaccauauaugaccaaacauuuuaagucauaaagaauacacaggaauucugggccgggcacaguggcucacaccuguaaucccagcacuuugggaagcugagguggguggaucaccugaggucaggaguucaagaccagccuggccaacauggugaaaccccgucucuacuaaaaaauacaaaagucagccagguguggugguaggcaccuguaaucccagcuacuuaggagacugaggcaggagaaucguuugaaccuggaagguggagguugcagugagccaagaucgugccauugcacuccagccugggcgacaagagcgaaacucugucucaaaaaaaagaaaacauaggaauuccggaauuuaaccacugugauagaaguugcuuuuccuugggacaauauuuuuaaggcagauuucaaaauuauuauuucaacuauucuuuauauaaugcuuuauuauuuuuaaaguauucacauauauguuauuuugauuuucaaaacaaucuucgagugacaaugggauugcauauuugagaaaggcuggucucaggacggcugaauguuuuucccaaagccguuaaguaagucggugacuuagacucagacgcugugaaagcagaggcugaguacuugguucuugaccucacugaucugcuggcuuacagagcauccuggucugcauacucagcgauucaaucucuaucuuaaacgcagucccucagccauuccuucuagaaaggugaucucuuuagagugagagcagugauggagguggcugaaguuacaccagggggagcagcuuugaaaagcuccuggcugauaggcauguacuaaugggagcaggagcuuuguuggcagugucgaagucccuuuggaggcugugugaggagggaacccauuucccugggauauagcucucuccacagggcagcuggauggcuaggggcagccauggaguaucagauucaccuaggaaucgauauuuuuccugaggguuucacaaaaaaagacagagagauggaauuugaagaacugggaagagugugauugaauuggagggaucugaaauaaagaaauagcuauggucaauggcucuaaccaacaguacuauauuuauacuccaaauuccaaauccacacuauguguauuuagguacaauuuaguuuagccauaguaaguuguggcuucuggagcuuuuauuuaccauaggauuuuaaauacauuucaugucaucuucauugguuuuccuuaaccccuaauucuccacaagaucuucaucccgucaguuaugacuuugccaaccaauauacuuuuuagaaauguaaccccaacauuagguacgaccagcauuuacuguauaucaauauuauccuaaauauugcuguagcuuugaauagcugaauuaaguuuuaaauaaaagcaaaggaauuauaaaacaaaauauuaacggauuaugaggucaguggguuuuucugaagauaaaacuauucuacuaauuauugcuguuugggaaaaaucgaaacaaggagacugaguaaaugaaucauuaaggcaauuaaaaacagaagagaagucacuuuugcacucagugaauaccaucaaggcaagucuucuauuuuagggcugucuuauaguaagauauaacagggacucucucaauaaaaagguugagcuacuauauaaaucaucaaguagauuuuauuuugaaagcaacuuuuuuuguagagaaagaguucuugaaaccaguuaaagauuuaaaaaguugauacaaguuauguuguaaaaucaaaguuauauguggaugauacgaguuguauuccccaccacauuuuaacauuuuuaguguauauauuuuuaaaugaaaaaauguacauuuuacacguauuuuaguacaaacaguaaaaaaaaagucagaaguaauuuaucaaaacauauguuuacacaaaaacuuguauauaaauguucauaacagcauuauucauaauagccaaaagguggaaacaacccaaauaucaacugauaaauagguaaaaugugguauauccauuaauaaaauauuauuuggcaacaaaagggaaugaaguuccgaugcauacuacaacauggaugaccccuggccacauauugggugauuccauuuauagaaaauauccagaguacaaaaagccauagagacagaaaguagaugucuuugauuuccaaaggcugagggagggaggaauggagaaugacagcuaacaaguauguagcuucuuuuggggauaaagagaauguucuuaaauuagauagugguaauggcugcacaaccaugugaauaaacuaaaacccacuuaaucguacacuuuaaaaggugaacuuuaugguaugcaaauuguaucucaaaaaccuauuucuuuuaaaagucaaaaaaaauaguauagaccccuuccauaguuccuuaguccuuuccauucuaguccuuagaguuacagguuuauuguauacacuuucaagcauuuauaugcacacaaaagcauaucuaugugcuugggauauagcaaagggaugguacuauauauucuacuuacucuacuuugaccaaaacccaagauguuuaaccauucuacuuuuucuuaauauuugacuauguuugaacuuaaauugauauccacacauacuaaaauaccaaaauaugcauugagucaucaaauuucaaaggucauccaugauauuuuuuaagggcuuaaaacuccuuugcaugaucuuucagccuguuuauuucagcauaggaaaauacccuugcuuugccuucaccuaacucuaaggaagucuauuagagauauuuagggucagaaauggguucuuggggcuugagagagaaaaggaucuucugcuauugaugaucuggcucugccaugacccuauggcauggguccucaguggcccugugggaagccuaguguaggcaacauggccuagcccaccuauguugauguuuaaggggugcuaggaacaaaagagaagcuguggaaacuuuugcuuaucccccuuucuucccucuuugguggucuuauuuuuauccgacgcucuuaaucucaacuuauaaccggaaaauacagcaccaaagcgugagggcauuuaggggaaaaauguuaucuguuuuggaaguaauaucaaggaagaucagggacaaaugcagaacuggaagcaaggacuaagguuggauuuagcaggauuuccugaaagauuggauguaggaugugaggaaaugagaugaaccaaagaugucuucagggucauuggccugaauaacuugaagaauagauuugccauuuucuuggcugggaaggagugcagaaagaacagguuugaaaguggggcaugaggaguuucauaugacacaucaaauacuugagauuccuguuaucuaacaucuguccaaguaaaaauguggaguugauucuggagguggggcuggaaauauaacuguggaagucaucagaacauacaagggaugugaaggcauuacaauggaugagaucaagcagguagugaguauugagauauaagaaaagaucugaggucaaguacuggagcucuguaacauuuagacauuaggaaauugaagagaaaccagcaaaggagcaugcaaagggcuggcauuggauuuuguggcucuguagugcagugcucuggcucuuuuggugacugaaagaugcuuguucacugcuuuucucuguguuuucacccggagcaucccugugacauuucuauauauauauauuuauuuauacucuaaguucuaggguacaugugcacaacgugcagguuuguacauauguauacaugugccauguuagugugcugcacccauuaacucgucauuuacauuagcuauaucuccuaaugcuaucccuccccccuccccccaccccacaacaggccccagugugugauguuccccuuccuguguccaaguguucucauuguucaauucccaccuaugagugagaacaugcgguguuugguuuuuuguccuugcgauaguuugcugagaaugaugguuuccagcuucauccaugucccuacaaaggacaugaacucaucauuuuuuauggcugcauaguauuccauuguguauaugugccacauuuucuuaauccagucuauaauuguuggacauuuggguugguuccaagucuuugcuauugugaauagugccacaguaaacauaugugugcaugugucuuuauagcagcaugauuuauuuauuuauuuuuuccaacucuuuuuuuuauuauacuuuaaauuuuaggguacaugugcacaaugugcagguuuguuacauauguauauauaugccauguuggugugcuguacccauuaacuugucauuuacauuagcuauaucuccuaaugcuauaccucccaccuccccccaccccacaacaggccccagugugugauguuccccuuccuguguccauguguucucauuauucaguucccaccuaugagugagaaagugcaguguuugacuuuuguccuugugauaguuugcugagaaugauaguuuccagcuucauccaugucccuacaagggacaugaacucaucaauuuuauggcugcauaguauucuaugguguauaugugccacauuuucuuaauccagucuaucauuguuggacauuuggguugguuccaagucuuugcuauugugaauagugccacaauaaacauacauaugcaugugucuuuauagcagaaugauuuauaauccugugaguauauacccaguaaugggauggcugggucaaaugguaauucuaguucuagaucccugaggaauugccacacugacuuccacaaugguugaacuaguuugcagucccaccaacaguguaaaaguguucguauuucuccacauccucuccagcaccuguuguuuccugacuuuuuaaugaucgccauucuaacuggugugagauaguaucucauuaugguuuugauuugcauuucucugauggccagugaugaugagcauuuuuucaugugucuguuggcugcauaaaugucuucuuuugaaaagugucuguucaaauccuuugcccacuuuuugaugggguuguuuguuuucuucuuauaauuuguuugaguucauuguagauucuggauauuagcccuuugucagaugaguagauugcaaaaauuuucucccauucuguaaguugccuguucacucugaugguaguuucuuuugcugugcagaagcucuuuaguuuaauuagaucccauuugucaauuuuggguuuuguugccauuccuuuugguguuuuagacaugaagucuuugcccaugccuauguccugaaugguauugccuagguuuucuucuaggguuuucaugguuuuaugucugacauuuaagucuuuauuccaucuugaauuaauuuuugcauaagauuccucauacauuccuguugugcuuucacccucuacucucugguucucacccuguucucauauauccaaggaagaugauacacucuaauuagaaacaacaacugaacucagcucauuauuuucaaaaucuuucuucuccauuagguaaaaaucauugcagucuguuuauucaauauguuuucuuuuccacuuaaauucuguucaugcagagacugauuccugggaacaucaaugugcuggcaacuuugacuuuguaauuucccuuuuguugucccacucaacugcauggcugaucuccauucauuuguucacuuccagagccuacuguuggcaaucugauuuuucuucauaguuucccauuaaaauucacuagagaugcuuuugauuuacuuauuucuucccuggcaggguagaguugcuuguuccagaucaccucauagcaaacuggaccauucucaaguaaacugcucaucccuggugcaguuaucagcagggaggcaucugcagcauuaacagugauugacccguauagugauguuuaauaugugauaauguuacuagcagcaaacaaaauagcacuuguaaacacaguuguuuacucauacuuacauguauagguuuggacuugagggguaaaauagcaaaauuacccaacuccccugcuaauaaaaccuaaggaaaugaauaaaaugaccugagaaaauuauaccagcauaacuacaguaaggaagagcuacaauuucaugccauuuucuccgaauagcagcuaggaggaaagaaaagaagagaaagaugaaggaggaggaaaaggaaagggucgcggaggaggagaagagaaugagagagaacaugaauauucuaggcucaucccuuaagacugucuucuggaagaaguuaagaagaaauaaacuuggaaaaacaacgaaaccguauacucaaauuccccaaucugugaagucuguggccaaagggcuaugcagagcccuggaaagugauaagaaccacucauguauagaagccacuuguuccagaggcaaaauaauccacuagaucucaccauuuuuauuuuuuucagcugaggaggcuugagagugaaggcaaaaugucauaccuucugaaaaugaaucaucucccauucugcuacaaaaauguagcauaaugaaaauaugaagagacaaaaacagaagcuucaagaguacaggaagcucaggauaaagaggggugucgaaagccccaggaguuguccuauucgcccauacagagaaccaaaaccaacaggaggacauugacuucucccucaccuggagucaguggagugggaaugauggcuggagagaggccagugaauuuggggaagugaacacuuaggacugauuaguucuggcugcaauaaagauuuccugaaccuaccugaauugaagaaauaucugaagccugauauuucaagcauaauugcccauacacagccucagcuaauacuucucucccuguaccccucuccucauacugaaacaguaaaacacagagaagaaaaccucguugauaaauugaaaaaggaugcuaaugagugggaugagauaucuggaauaauucucugccccuguauuagaaagaaugaaagaucuagauaauaauguuaaaaguggaaauuuuggcaacuguggaaccagucuagaaagaaauuaguucaaauuaaaacagguagugagaggaccccaagaauaauaucuaugagaguaagaaucaaaugguuucugggcaauugaugguuuaaagaaagaacaucugcaggauaguaagaaggguuuauucuaaaugauaaguguaaugugugagaaucuggaagcuacuugagauagaagaaagaaagaauauauuuauuuucccaaugagacaugugagaaauagucagaaaaucucagcaaaaacaaaaccaaaccaaagauuguauuaaaaaaaaauggcucaaauaacgugaguuaaauuggcccagauucugagcaauuaauggaaaguaaggaagguuccauuuaaccuugaccauuuacugucuaauagagucuuggagggggaaguauaauuuuagaacauuaccuggcccaagagugagcaauguuuucauaggaaacauugacuaucaacauauugauuaucaaccugcugagaagcacggaugacccaauuaugauagaaaaacaaaauguaaauauugucaaacuugaggauauaaauguauacaugacacgagauggaaaaugaaagcagagagaagaggugaccugacaaguggcaaugguaauaccuucaucucacacuggaaggggucaagucuuucuaguuugauggaaaaagaaaucgagauuuacauccaaauuugggagugguuaagggaaguggggagugauguugugccugaaugaaaucuucacauaucauagcagaagucuaugucuaaaguggauaaaucaagaaauccuaaauagggauaggcauaacgccaucagaagugaaaacaaaaaauuccugucucauuacuuauaccaaaauaaauuucagauuuaaacugauuuaaacagccaauucagguucaacauguuuaaaauaauaaagcaaggaaagugucaaacuacugcauaaaaccauggguaaauuuaugucuaaucaugcagugagagaagucuuuuuaagcaaaauaaaaacacuuaaaaggaaugacaaauuagaccacacugaaauuuaaaacugaucuuugcaaaaauauaagaaauguauaggggaaaaugcacugaacauacauggcagauaaaagauggguuuucuuauuuguaaagaguugguggaaaccaauaaagaaaauaaaauggucaacagggcagaaaaauggaauaacaugcgaauagguaguucagagaaacaacuuccucucugccuucuuuccacugaaacucuacuccugugcauuacugaggucaguugcuucauuuucccaaaacuguucuugauucacccaagaggacuaaauuggcucuucucuguugccccucaguacuuuaaccauauuuugcuuacacaccaaaguuacuauucuucccuuucuuuuuauuuucuuuuuucuuuugagacaggaucucgcucuguuguccaggcuggagugcaguggcacaaucucagcucacugaaaccuccgccucccagguucaagcaauucuucuuccucagccucccgaguagcugggauuacaggugaccaucaccacaacuggcuaauuuuuguauuuuuaguagagacgggguuucaccauguuggccaggcuggucuggaacuccugaccucaagugaucugcccgccuuggccucccaaagugcugggauuacaggcgugagccaucaugcccagccaguauucuuccuuuuugagaauugauccuguucaucuuuuucuuccccucucaauuauacaauucuuaagggaagaaacuaugucuuacuccacucaauccccaaugcaucaaaccuuuaguaaccacuaauaauccuuguuugaauaaauaaagagcacaggcccuacggacaauguaagucaguaagugcacuugagucacuaucucaagcacacuaccauuugaauuuaaauuucuggauaaaaaucuccacaaaacugauaaggcacccuucaagcaagacacaaguuaauuuucagccucuaauagaaguauuuguuggcacuaccuuucauugguuuauucauuucagcagccauaaacacacagaucccauugucacagaaagccuuguucgcaaauauaauuuagugcaucucacaauaugagcuuucaggugguugagcuguguggaaauucgauuuuuuuuucucccgagacucugaaaugaaaagaggauaaccccagugcucuugcccacaucgcuuaucucacaacaacagauuacaaucccauaacuccacguucccaagcagcuacuguguugaucaaauguaaugcaacagaugagaaaacaucagcugguucaugcccaagacagcugaaaggugcacuuacauuuuuagucuccagauaccaaaauaaaucuguugggcuuaaucaugaguuguccugcuacuuuuggggaaagaaagccauguccagugaaauuucuuuuauacuggcaggcauuuugacucuucaccuauugcuguugaaucuccaggauauguacauguuuucacaccgauaccuucauugaagaaaauacagcaaucugauauuuuuaugugaaucaucuuuggaauucguguuccucaccuuuggauacaauaaauauucaagagaaaaaaaauacaggaaaaaaauaauugcccucaaugaugaguucugaaauacuuauaaggauaagugauguguugaaaaauucucaaaagcaauuuuagaaggaauaauuuuugcagagaguggcugucucuugggcaccauaacaagaaaaauaguauauugcccuuggugauggugcggucaaguaucaauaacaacacgcuucauauuuucaugaacaaaacacuucuucauaagguaaugagauuauagaaaaaucaacucaagguaaaaauaauuacuuugcacauggacaaaggauaaguggaagaacuuaucuucuaguucgugguucauuuaacaauuaauugcuccuuuuucaaauagguccacuguguucugggccuugaacaguguaccucuaagaaaguuuguuauccuuacugaaggaaauuacaguuaggucgcuucucagccuuuuggcuaagaucaagugugaaaauuauacuuagauuacuauguaauuaggccugguagauccuggguagacuucacugaaugcaggaugcaauauuuggaaaaguacuuacuuuggaguccuaaugccugggugcuacuucuauuagugccagaaauuaauagugugacuuugggauaaucacuuaacaucuuugagccucauuuuccuuaucuucaaaaaaaaaaaaaaaagaaggaaucagaugaaaucaucuuuaccagauuaggucuaucuuuaggucccccaguguaacuggguuucugucuuggucucaguccauccuugcauuauccuggacuuuauuuauuggaaucccaauaucugagaauucaauuuaugucuuuaucguacugaagucuauaaagauguuuuuaaagagucacuagacuccaguggggcaacuugcuccagauaucaucauagucucauuaaaaaguauuuauugacuacuaauguguauaggauacaugaguuggagacucacagauacacauauauuuaauuagaaaaauauguaagaaugaaacuagccaaagauauuggcagaaagugugugagauuuuuagcuuggcuggccuuuguuggaaugcucuauuuuuuauuucuuuuuuguuuguuuguuuguuuuuuuggucuuggcuucuuccaugaucuugacccugugccuugaaacuuuuuuuaaaucaugaaaaauguguuugucuucaagcuguccaguguggcaauaucacuuagaaauauuucuuuuuuaaagagucccauguuuuuaauaugauagcuaaaauaauaugauagaaagguaccauaaaaauaaaauuauaugccuuuauaugccuuagacaaguguaauucacuauaaaaauaaguuucucuuagcagcaggaacaaagaaaaaguaaucuguugaaaauguuagauagcuugcugaaaggaaaaaaauuaacggcaaaaaccaaagaucuugaauuuguuucuaauuugcucaacagcauuuacugcgaacaaaacuaauuuuaauucaggguaauuauuuucuuauuccacaucaaauaguuaaauaucacauuuuuaagaucuuuauucuuauaucuuuccuauguguugaaucaagacuguucuugcccugaucagauaaaaaucaauaauauugagaucaaagucuucaaacaucacaugcuaauuugaaguuguaugcaagccuaaagcuaguguguaauaccuuuguucuuuuccucuuaggcauuuauguccauguuccagauccucacccaggaaggauggguggacguaauggaccaaacucuaaaugcugugggacauaugugggcacccgugguugccaucuauuucauucucuaucaucuuuuugccacucuggugaguucagcauuuuuuuuucaauuauaucuuggaauuuauaaugggaugaacaucaacagauauuuggccuauugucaauuucaaaaugggagccaaaggacuaaugcagacuaaucugguuggaugagaucccuccuuccauucuaaguuucuacacaucaaagaacugcuugauuuguuaaguuagauauuuucuccaucagguaccaguguuuguaagagggaaaacaagacagaacaaaaugaaaaucucacauuuacauaccaauuuaaguauccccaagcauucacaccuagaugaucucaggaucaaaccggaacuccauuauuauuuuuuuucucauguagagacacugucuucaguuucacugcauccucuucacagcuguaauuaaacugaagacagaagcuauagaccucagggugcagucaguuaauuagaaaucagcacagugguuuugugcuaugugcgacuggaaaaaaacacauggaaaaaaauaaaacacauugcugcaaguauuguaaaagcacaagaaaacugaauaccaaaguccaguaagaaccgacuucugucacacaagcagauuuuucucuucaauauacuuccauuaaaaacaaagaaaaaauguuaugaaaugcagccugugacuuacuaaggaauguaauaccaaaugcucaucucuauguaauaaauuuguucauauuuaagaagcaaaccuaaguucuaacaucacguuagaaguuccaaguugaggacucaaauguuucccuuuaucaggaauacaagaaauaaauacaacugcuacuauuguuuuuggcaauaugucuuacaguuacaaaauaucuuacaauauuauugcuaaucuuuggaacacccgauuagauaguauucccaguuaacagaugauaaaacugauacucagaagaguuuaguaauuuaucugaugucacauggaauguaaauaugaccagaguguucccaggucugucugaucuagauuugguccuuagucuugcagcuaauuauuauugcuucccuggauaaugaaguuuaaaguugucugaaaaaaugucuuugucaaaucaaacuucugccaaagaaucacucacaucaaacaaauuacauauaaucucuaaggucaguuuuaauucuaaauaucuaugaaugaaauaaguccuugauaaacuagauauaacuuagaaguuguguuugcuauagacagacagaggcuuucaaaacuaagacauguccaccaaaaaguuaaugagaauucauuguuacauggugugaagucaugggcucaaacaguagaacuacauagacauaguuuuggccuuuuuauacauggaguugacuuuuaaaaguuacgcgaaagauaggaacauugugcaauaggaauggaagccuggcuugcaaagcugaaucuggcugugcugguguuugcacaacacuuagcccuggggucuuugcaucuucccuuccaggaccuuuaagccugugccauuuauucauucauccauucauuuacacaucauuuaugcguucaacuaaguuuauuaagcuacuuguguuuaaguuacucuaaaacuauggaauugcucagacuguugauuguggguuaaaugcaggauagauuucauugaaaucaucuaugucagggaauaucaaucuaauuauuuuauaguaaucaaccuaaucguuuuccuaauaaagcaacaaaaugguuuacuuuccucacugaaaauguuucacacucagauauauguuugauucuuaaaucagggacacaaaaaaugaaagcuggaagaaaaaacuagccuauuacauuauuuaguaaaguaauauuuuuucaagugaaaauucuacuggggucacuaauauaauaaaauaaaauauuaaaacugguauauagccuucuugggcaaucuaaaucuucuuuaugggcuaaaauauggcauugguuauagaucacuuaaaguucauccaaggacuccugggguucaccugaggcuuuaggaauccacagagcacaagaugaaaaccaaucucuaauucuacucuuuccacuuacugauuuaaguaucuacccaaaacaucuguucuaacuuuuuuauugcaauuuucaaacaacaguuauaaguuaaaacugaaaauugaaauaacuuguucuuuuauucacacuuuuuaaaagucuguaaggcaauugagaauucagaagucuacauguuaacgagaacaguuugguaaauguggugucguacaagacuaugaaauuggaaggcaaaaauccagauucagguucuagcucugcuggucacucgauaucugauuucugaagacucacauaacuucccugaucucucuguuguuuguaucggaaagugaggauaauaauucacaauacacccaguuuccaagguugucauguaucugcgaguuaacccuguauuucugaggauguuuuagagcaccagcacugagccccuuuaaauguagauaagacgguuugugcauuuaaagccauauauuaauaaauguuaaauuuauauuauguucagauauuuuuaauuuaugcaaguaucauuuauuaggguaucauuuaugccccuuccugaauuaauuuccauucuucuucuuucucuccuucccuauaccucuucucccaggcaaugacucugauaauuuuaauauaaauucauuuuccaauuuuuagaacauauuucacuaaauuuaacauucugucauucaguagaagacucaguuuguguaacacuaaagagaaaaacaauuaaacuauacacauagaggauaaggggcaucccuacuucagaguuuuuaaaaggugaaaguaaaugugcaucuuaaaaucaaugaaaugcagagguuucccacacauauaugcauccauuaaaaauauaguauuuauggccagcacgguggcucacgccuguaaucccagcacuuugggaggcugaggcagguggaucaccugaggucaggaguuaaagaucagccuggccaacauggugaaacccuaucucuacuaaaaauacaaaauauuagccaggcaugguggugagcaccuguaagcccagcuacucaggauacugaggcaggggagaaucacuugaaucugggagguggggguugcagugagccgagaucaugcuguuguaccccagccugggcaacaacagugaaacuccaucucaaaaaaauauauauauauauacacacacacagacacacacacacacguguguguguguauauauguguauauauguauauauguguguauauauguauauauauguguguguauauauguauauauauguguguguauauauauguauacauauaguauuuuaaacuuaagguuaccaucuaaauacauuuuaugcccaaaauucugaagauuaauauuaaguuuucuuaguuugcaaagcacugcuccagucaacugauggccaucccuaggggaguggucugguaauacauacuucucucccuauaaguccaugcuggggccaaguuauacauggucauguguuucccuccuuaucaauuauuuguggcagcaauuuuuagaacaaaugguaucaaacucaacauauauucugcaguuaaauuuuucacuggcuauuuuuuucugagaucuuuuuaucuuacuccacaugaagcuaauuuggucauuguuauagagagccguaugguacuccgcggacugugaauaugccauauuuguuuaucaguucccuuucugauggcuauuuaggcuguuuuccaaaguuguacuuuuauaaugcugcaauacauuuauguaucgugcccacuuaugugaauuucucuaggauauauguccaaaaguagaaugcuuagaucuuagguacugcccaaauugcucuauacuagggaccugcaagcccagauaccaaauccagcccaccaccuguauuauacaaccugugagcuaaaaaugguuucuauaauuuagugguuauacagguacccacagaauauccucaguauugccucaugacccucaacgucuaaaauguuuacugucuggaccuuuaagaaaacacuguggacuccugcucuauagauaaauugugcuaauuuacccucccaagugcaauaguugagaauuccuguguucuuacacucucacuuagacgucacauuguuugacaugugagguuuuggcaaucuuaugagugaacacugguaucaauugggcuugcauuuuugcauuuccauaauuauuaauaagggagcaccucuuacuauguuuauugaccaucuuuuuugugacucaauuguuugcuuuaccuauuuuccuaaaaacaaauuugucuuaacucauuuauuggauauuuguuggauauuaaucucuugacuauuacauguguugcgaauauccucucuuaggcaguauuuugucuuccaguuugucugugaugucuuuugacauucuauauauuuuuauuucauuuuuaguuaacaaauaauaauuguauauauaguaguccuccuuuguccccaagggaaacuuuccaagauucccaguagauaccugaaaccauggauaguacagaacccuauauauacuauguguuuuauuauacauacauaacuuugauaaaguuuaauuuguaaaugaggcauaguaagaaaucaacaacaauaauaacaaaauagaacaguuaugacaauauacuguaauaaaaguuaugugaauacgcauucucucucugucuccaucucuccuuuucaaaaugucuuaauauuuucaggcuguggcugaccacagggaacugaaacuacagaaagugagacaguggauaaggggggggccuacuguauuuaugggguacaacgugauguuuugauacaugcauacauuguggaaugaucaaauuaggucaaaacuaucgguuuuucacugauggucuguauuuauuuugaccucaugcuuaaggaauucuuucccaccugagguaauacaaauauucuccuauaucuucuucuaauuguuuacaauuuuugcuuuucaccuuuaagucuuuagcucaucucuacuuacuaguuagauauagcauaagcuagaugaaauauacuguuuaaauaaaacucaaaucaauuuuucucagauuuauaugagaaacugcaagguuuagaauauuuauuugauuuaucugauuaugaagucuaacacaaaaaagguaaacuguucaaacuuuuaaauuucuaaauuauuuuuuaaaugauauauaauuuaauaaaaggaaacacuauauaacuaaauuaaaacaaagauuaucacuucuauacuacccaaaaaaagucuaauacugaagucacuuccccaguucacaaaaaauuuugcuuaaaacauggucagcaguuguuucucuuuuccuuuguacccuuagacuaacaguuacuguaaugggcuuuaugaagugaguucaauuugauuugauacaguuuuacugaaccucuacuaccacgugcagguacuaaccuacguccuggccaaagugggaaagagcuuaauucauguccucuuaggggcuacaaauaauuggaaauuagcaauaacgaacacagacaggcuaaccaacaaacaaauaaaaccagugguuccaaggccuaaagaugcaaaugguaagagaggcauguguacauugcuacuugcuaugugaucaauaaacaucugcuucccaguuguucccaaucugccuuaugagaaauaucaaaaguaguggcagugaaacagcuggagauagucugugggcuaacauauaaacacaugcgugagggugacaggucuguguuacacacacauugcaugccccuaaaaacuaaacuucacaaguuaaaauauuccauaagccugucuucagagcugaacuuaccuuaaaaugagcauuuuuguuuaauuguauguuuccuuuuacaaaaugcuacaacgcauuuuaacccaaaugggugagaagggaaaaaaaaaguagucuguguaaacauacaagcucugaugugucuuuuguucacaccgaacaguggugccauacaacuugaugaguuccugauuuagucuucccagggacaggcaugugccaagcagcgaaaaauaaaaugugugguugcagcuuguucuggaauaaagaacagcaggcuauuucaucaccccugggggcaccaauuuucagcccacaaugaaaaucaagcugaaguauauagcaaaugcauauucauaaccuccauguauugucccuuucaaacaucucucucuuccgccagguauguauucuguauuucuguccugacugauugcaguuuauugaaugcuuguuaaauucaucuuuuuccccaucuuugccaaugauuuggggauagggacuauggaagaccuaacaaguugaaagacuccauuuuuccugcaauguuuuucugucuauuacuguuucaaaggaaagcccugugaugugaauacugaaaagaaagaaaauguaauuaagcguucauuguggguagucuuuuuguuaccuuugaagugcugaaauuaacacagcaaucucuugauuuugccucgguaguggcagcuugcugagaauagucauauuuugcugacacaaaugggcauuccaaaguguaaauuaaauaacuugauuguauagaauucauuuaaaagugcaucuguguugaacguaucccauuuuacacugcgcugauuacauuugacuuuuuguugacccauauaaaaagugaaauuguuucauaccacaggcggcaagacagcuuaggauagggugauuauaaaugguaaacaggaaaagaaaaacacaagagugugggacauugauuccugcuguguuucuaguguauauuucaaaauaauuuaaagauaagaaauuauuaauaaaguucacagcaaagaagaaaauaagauuaaaggugaaauuucagcuaaagggacaucuuuaagcuauauaaaaggaaaaaaaucauaaaauuaaacuuuauaaaaagaaagaaaacugaaaagggaaagcuauauaggguaaggucauggcuaucugcagagucagagagaauguaaaauaggauauguugcugcagggagagaaauuuucaaccagaaaauccauugugaaugacaaggcugcccucuugcaaaaauaaaucauacuuuucagcuguuugaaucaugcuaauccaaaagucuuauuccgagggaaugagaacuacauuauguuggacaaaaugaucugcaucacaacaaaauuggaagaaauaauuauacuugcaaaugcaacuauuucaguaauuuauugaauuugacugaaauuuauuguaguuaaauagaaaaaaaauaaauauaucuguggucacauguauaaaacuuaaacagagcaaauaacuaccacagcauuaacugaggugaaucugggcuguuucagaggagaaaaaggaagaggagguauuagagaaagaggagcgucauaaagaauauuagagaaaucaaacgccugugagacccugguccagguaccaguuugaaccuggaaaauuacgcuuuugaaauccacuaagcugaaaggucaaaauccuauuauaucauucauaaauauucugagagagacuucccagacuucagcaggccugauaauguggcauuuuccacacugaaugcauugucaaugcuaaacauaccuuagcaaugggcauuauaaucugagggaaauaaagaauuagauaucugaaauacauuguuauucuccacuuuuucauugacaucacugauucauaauguaucaauaucggucauaaaauuaaaaaguggauacauacaucagcuguauauuacacaguaggacaaaugcuguguugcauauuaauaugaucaaacgcuauagaccuguuaaaagugccaaauaguaaaugcaugaaaaaauagauauuuggcuuucuuuuuuacagcauuguacaaacuaaacaccacuguguugaaagcauacauguacuuagcaggguucaagaggagaugaaagguggugucauuagccuuuuuccccugaaauuauaucauuaaaaaaaaauagggacauaguauauccugcugcaguauaaauugaaauaucgggccaggcgugguggcucccccuauaaucccagcacuuugggaggccgaggcggguggaucaccugaggucgggaauuccagaccagccugaucaacaugguaaaacccugugucuacuaaacacacaaaaauuagccuggugugguggcaggcaccuaaaaucccagcuacuucggaggcugaagcaggagaaccacuugaacccgggagguagagguugcagugagcugagaucgcaccacugcacuccagccugggggacagagagagacucugccucaaucaaucaaucaaucacucaauagaaauaucacauaaaucuaaauauuaagaaauaaauaaugcaaagcaaauuaguugcauaauuuagaacagucaaaacacaaagguaaaaguguuuuauacauaugaugacacuccugugauuuaauguggcaagucccuguaaaauuccuuuauuacaucaauaccguuuuaauaugaaccuguaaaucacauuuaguggcuauagaaaaaccuuuuggcacagcaacaugugguaguguagguaaacauuagcugaagguaauaugcagacaucgcuguaauggguucugauuacuaaugagcauuaccucagcuuucuguaaaaacagaauaaaugagaacacucagagaacugaaaaaugguucuuccuuucagaaugagggcuugucacccacucccaugacuuuccauaccauguguuggcaagugucugacacccaggucgaccugcucuuucaguccaaauccacauugcacuggguuuguaggaaaauacuguaucauugauaacauaaauuaaauaugauggacaccaagcugccauucuuccuucacuucuacccuuuaucgcagugcuuauugucaccuuauuagagucugugagaaaagaaccgcaaagucauucucaccuccuggcaaucagcuacagacucacccugcaccuccugaaucuucuguuuccauugcaaagacacagccaaagccuugggucagacuucagucaucucucacccggagugccaguugccaccuuaucacagugcccuacaugccagggacaguuugaugaggaucaaucugaaaguccacauucaaauagggcuucagcggaaacccaagcccccuaccacacacauacaucuugaaccaguuucuguuuuguaaguuugugcuuuugucaugccacugucaaauuaauugaaaaaugaugccuaaacaaagauauuugcugaauaaaauuagguuuaugcuacuuucaagcaaacuucaaacuuuauuauauuauuuuuaaauuuguugccuccccaagaguuuguucuaauucuuuaaguuugggccuuccuguugugaagucacgcagcguuuucccagagaagccaaagcucuuccuuuaggagucuugccuucuccuauccacagcaaauaucaaaugcaucugccuugaggagucagugcagcuggcaugccguggcucucucuguccugcucugaggguggcuuuucucuguuuaucccaaggaaaaaguauauaccaguuucuuguuuaaccaauguaagaaaacauuacauaucuuuuuuuuuuuuuuuuuuuuuuuugagauggagucucgcucuguugcccaggcuggagugcaguggcacgaucucggcucacugcaagcuccgccucccggguucacgccauucuccugccucagccuccggaguaacugggacuacaggcacccgccaccacgcccggcuaauuuuuuuguacuuuuaguagaaacgggguuucaccauguuagccaggauggucucgaucuccugaccucgugaucugccggccuuggccucccaaagugcugggauuacaggcgugagccacugcacccggcuagaaaacauuauauaucuaauaacauuuugucaaacugcacuuaaccuugucuaguuacuauuucagugagccaguuuauuuuuuuguuuuguuuguuuuuaguuuuuggagacagggacuugcucugccauccaggccuagagugcaguggcacauucacagcucacugcagccucgaccucccaggcucaagaaauccucccaccucagccuccucccaaguagcuggggccacaggcaugcgccaccaugccugacuaauuuuuguuuuuuuuuuuuuugagagacaggguugcccaggcuggucucaaauuccuggggucaagcaauccugccucagcuucccaaacugcuaggauuacacgcaugagucaccaugcccagcugagccaguuuaaacuugcugcauuacaugcauuaaaaacaaaaacacacacacaaaaagccccagaacuuuuaaaaggaaaaauuuagcagaaagaaacugaugucaucacuuugugauuauuccagccucccucucuuauccgugaccucuguggcacucaagacgccuguccauccugccuuccucuccagccuccaaacccucugccuggaagccagacucuggccagacuuacucaccaggcccucaccacaccaccuggaaugcguuccucacagcucuuuuccaaaaucagucuucuccuuggcaucugcguggcuugggagagcauccuuggcucucugucauugucucacaaucuucgauaaguaguguucggaaagugccccccuggcccaugugcccagaugggcucuccaagucuaaaugcuucaaaaugguacagaacuaaaugugugaauuuaugauggggcuucauuucugguccuccuucuucacacuugcguggccgcccuucccauccgcucuccaauuuucuuucacguuucugcuuucugagaagaaauaagacugauuucugggauggagcaugagagagacagaugcagagagagagagagacaaagcguguuuccgugggagaugcccacacaccucacuugggagcaucggcaguguugguacccacacagguguguuuugacauccaagacuugacccuaauucuucuuggaaccugauggggagagaaccuugcugggggccccacaugggccaggggcagccagggcagaguugggcagcugccugagaguucucgguggagaggcccggaauaucccacaagaacaagucuccguuaguuccaaguggaaugacagcccuuucugaguuucccugaguugagagcuaauacauguguugugggaacaacagcccaagccaaaggccacgcggaggccaggcguggugacucacaccuguaauccuagcacuuugggaggccaagauccacggaucucaugagcucaggaguucaagaccagccuggucaaccuugucucuacaaaaaauaaaaaaaaaaaaaaaaguagccaggcauggugguaggugccuguagucccagcuacuugggaggcugaggugggaggaucgcuugagcccaugagguggaggcugcaugaguugagaucacaccacugcacuccagccugggugacaaugugaggcccugucucaaaaaaaaaaaaaaaaaaaagaccagguggagaguauaguggauuaaaugggccccuacaaaagauaggaccauggcuuaacccacagaaccuaugaacacgaccuuauuggaaaaagagucuuugcagauguaauuaaauuaaggaucuugugaugagaucauccuggauuaucugggugggcccuaaguccaaugacaagcguccuuguaagacacaaaagagcacaagacacagagagaaagccuugugacugguguuagauaaaggccaagugacugguguuaacaaagccacaagccgagggacagaggaggccaccagcagcuggaagagacaagggaguauucucccccguggccuuuggagagaguguggucuugccgacaacucaauuuuggacucuggccuccagaauugugaucaaauaaaugucuguuguuugaagcuaccaacuccgugcacgguguuacaguacucuaggaagcgcauauggaggacaucacugggaaucagagcucuuagcuuugggagcugagaugguggucaagucagcagaaagaaagccccaaacccccuguacagccucaucaguuccccugaugggggauggaggacauauuacccagcuuguaguggguaaccuugaccuuaaacuacccuaaaaagaaaaggagcauuuauucaaauguaacugagcuugaaaggacugaauggaacugauguagcaagauaauguuuccagcccccaacagaaauggagggauugugcaccaaauucaauucauuuguagaaaaaccaagaaauuuauuuuagcuuugcauaacuaauuuuaugucuguauauuuucagacauuguauagcuauacuacaugucaggguugcucggggagaauuaaaugaaaaaaaagcugcaauuuguugagcuauuauuacauuuguaauauuuuacaaacgagagcaccgaaacucacugugggcuggcaguugccacguggcucauagcuggcacagccuguuugcuaccugagcucucugacuccaagcacagugcucucuucuaugucugcuuaauucagugauaaacaucacugcagugagugcaauauuguauuuauguaucagaccaggcagugccucacacauccauggaguccagucaacuguuugucaaauuuaauagaauaacauagccuugcuguccuuaaguagccugcccucuguccaguuugggggauauaauuaagaauaaaaucuccugccaacccacgaaaccucuccuuaaagguagaggagagagagcccaguuuuauuauugaaaaagcucuaacgcaggcugcaaugcacaucacuggcaaucugcuaaagagaucacggaggcagaaaauaccucccucuuuuauaucaccgcuuuccauacguguucucaagauagaaauaacuaguccucaaguaagaaggcuugacagcaccacuuguuaaauauaguuuauccuaaauucaccugguaagugggguggccaucugugggagcugauugccuuuauccaaaggaaaauuaaaacuucucauauuuccgugacaaguagguagguuuacaacuuggagccagaugucuaaacucccacccucuacggagaaggggagacggaggcucuugucuuccuugauguuuacauuacuucaaggagacagcccucaaggaaaacauucuuuuagguuguagaacuggugagaagcuuauuuggcucuuaaaaguauuuauauacaucucaaacagaaagggaaagaauuuacaauuccaagucuuauaaaggaaaugcucuaagaaaagggaggcgaacaggaucccuuccgaccccccuuuuuuuagauucauguuuguacuuucacuagagagagaggaaacaugauuaaauuaggacacagaacaaugccugcuccagugcccaggugugagagaagggguauaagauauccccuccugcagaaggaaaccagcaggugaacaucucagaauucggggugagaaaucaagacaggggaagguagacucugccucugauauuacuuucugucgucgagguauugggaaaugggcugaacauggagcaaacuuuaaaauguccaguuuggaaugaugucugguucagaauaagccugaugcccaguuaccagugguguaccagucauggugauguuaauaaaaacccucuggucuagaucauucuguaucuucuucaaguuaugguaagacuccaaagggcauggcuguugaaaagaagggugcuggcauuugucccaagccaagcauaucccaucauaauuuaaucauguugauauacucauuaaaauugaaaaagagcuagccauuaacuucugcauaauaacuucucuagcacuggcugaauuaucucaacuuucugaccuucaugcuuaaccaccuaauauuaacaaaugggaauaauucauuaagaagaaaacugaaaagaaaaauaugaguuagaaaugaaaaagaugaucaagugaauaugggacuuaaaaaaauucaaaguugaagagggacuacagcguaaaauauuuuuaaaaauuaugcuauuuuguuuuauuuuauuuaccuguucuaaaagaagcauacauuuuuuaaaaacugagaaaaucauaacauuuuuuaaaagaggaaaaauuguauuacuccaauacacaaaagcaaguaccauuaauauuucuaaaguaccuccuucaagcauuuucucuauuacuccguuauaugcauaguugagcuucuaccauauauauauauauauauauauacucguauuuacuguuauaauguguuuucaacaccauaaaaauucaccaguguauuagguaucuguugcuguguaauaaauuacccacacauuagaagccuaccaggaaauagauguuuauuaucucaauuaguuucucaagguugggaaucugagacaggcuuagcugaguguuucuaguucaaagugucaugagguugcaguugagauguugucuacagcugcagucaccuugaaguuuuacuagggcuggagugccucuuuccaagaugggucacuccaguggcuguuggcaggaggccucaguuccucaccacauggaccucuccagagggcugcuugagcauccucacaacauagcaccugcuuccacagagcaggugaucuaggagagaccaaggguaaagacacaguguauuuuauugccuagccucauaagucacacacaauuauuucugcaaccugcugaugacacaggccagacauauucaguguggaagggaacuacacaaaggcaugaaccaggagucuagaacaacgcuggaggccaucuugaagaguagcuaccacaugggaauuuguaauggcugcauguaucuuaucacauaaaucucuauaacuguauugacuauucaugcaaaguuggauguuauuucuaauauuuccuuauuacaaacaacccucuaauaagcaccuguguauauuaagcuuuucaucaauaguucagaucacuuuuuuagaauauuaucacacaagugggauuguugaguucaaaaaaaccuuuuucuuaauuuccuuuuuaaguaaguugguuucauaaagcaaguuaacauauuauuucaaugaacguaugcauuuuauuucauguauuugugauaaauaccuugaaaugccuaugcaaugauucaucacugcauguuuauuuugcauuuaaugaauuauauacucaauauauuuuagguagcuauauuauacauauaauauuuugauacuuauggcauguggguuuuuucauuguuauuucaccauuuuauagauccuccugaguuuguuuguugcuguuauuuuggacaacuuagaacuugaugaagaccuaaagaagcuuaaacaaguaaguagugugugggggauuuuuuuuaaaaaggacaaaaaaccaggggcaaaccauuugcuuauaggcaauauuaaaaauuugagcuucaaaguaaaaauaaaauguaauaaggcuaucgaaggugguaaaaugguguuaaguuuaacuuuuaucuaauauuaacaagggaaacuuucuauuacucuauaaauauccuaggaauaguuuuauuauuuuugaauaaaaguaaaaugggcagaguauaguuaauuggauuuggagacuguucuccuucugccauuaaaugaagguuguuuggaaaugagaugccucaaggccagauuuugcauaauuauauguaauagucuuuaucaucaucauaaaaauacuacaaucaaccugccuggucucuagacacuaaaggacaauuuagucugggugcccauagugaguauaagaaacagaauaaaugaucaaauguggacccaguuauguaugaaaacagacgggaugucaucauggugaaaguuauaccccagagaaugaaacuagaaauaggugaaugcuguguucuuaauggcaggaggauuacagcuaucgucaaucauuccuauagcuucuguugcauggaggauauuuggcuugaauauuuggcucuaucaaagaguacagacccuuugagaagaagagcucgcaagagagugggacaauggguggaacguucuuguaucacccuccccaaaacugagagaauaguugagauguuaacuaccaaacucuacccaacuguuagaauguuauaauguugacagaaccacaccuguuauaauguuaacagaaccauggcucugaaacuuuccauuuggaauuauaagcaggcccuccauauucagaauuucccaaagcucucuauuuuuaacaaagcaaaaaguauaaccuauuuaaauuuuuuaauuuuuuuuaaucuaucucaugaucagguuaggcauuucauuuuauuacucuuaccuuuaaagccuaugcuuuuaacagaggguaucaacaaggaaaaaaaaaaacagaacaaacaaacaaaaaaaaauuguuaugaagauuccuacuuggagcauaccaagaaagguuuugaguucuuuaccauccuacagcuacccaggcaaaugggcaucuucccggcucugcuagagaugauuucuuccccgucuuuucacucuguggcagcagugauagauucuucaaaugagaguugggacauuccuuuaugccaucaaugaaaauacuuuguguggcuucuaguugcagaaaaaaauaucuaauaggugaauucaagauugaaagugaccagccauauaauuagacaugaucaauaaaaaucugcugcuguagaaccacuuuaguccaugcuuuacaaaucugguauugagcugucacuuuuccuucaugccaugguuauuaugcacagauauguacuauccucugagacaguauguuacaauguguauucuauagauaaaauuuaaaauauccaauuuuuuuuagcuagugcuaccgccagguuccauaugcuuuuaaauaaccauauaauuccagcccucauuuguaaaauaauuuuucugcuggaaagcaacaaaauaaacuuguauguagcaauuuuuucaggauugugaauucaaaccuaaggauacuuugcaguguucauuuuuuucaacauuuuaacuuauuuauauauacacguauaugcauagccuacuuaaauuuuuugucaucuuuauaucuaguggucacaauaggcauuucauaucugacccaaagugaagaagcaacaauaaaaagucaggacuuuaauuggcauugacauucuuccugggcuauaaaguuuuaauaaacuauauggcccuucacuuuggguaaaugucauuauuuauaaaauggcuuuuaaucacuugcuagauauuagugaagcuuuguguuucuggaaauucuguauaucagaacugguuauccaauugcacuagccuacaauuuggaccauauacucuggguauuugggcauugaaaacuccaaucauaacgcagcaauuccauuuuuguuaguacuuuuuacacuauucuuuauucaugguuggacugaaacuauguaucuauuaaauucuucuauuaauuucauacuugaaacucguugaaccugaaauucauuauagcaaauauuauuaaacuaaguuaaaguguuccugguuaacuuucucucauuuuuguaugauuauguuuuguuuucaguaguuuuuaacaacggugucauuuuuuaugccccugauuuuucuuauuuucagugaucuuggccuuuaagguagggcucauuugcauauuuuuaaaaacacacacauucucaugcauucacuuucauauacacauguggucauguggauaccugaaacuuuagacugucuuuuacagauucuuuuaaaaaacaaugaaauugguacccuaaauauuuguuucaauuguccauguacaaauccaguccuuaagauuuaaacuuauguacucuauuuuuacuacucccagauagagaguagaguggaggaaauguucaaaaaaaguauuugauuuucuuaauguuucaaguuucagaaagcgcuaugcauuccaaauuccaucuuugcuccguucaaacuuuuugcuucuuuuaccacaucugcuuguauguagauucucauagcuauggugacauugguugaauucuugcucaguaucaaguguuuuauguuuucacuuauuuuucaaaacgacccauucaaugcagguguuauuauuauguccaucuuacagaugaggaaacuaagacauagagagguuaaguaacuugcucaagguuacacagccaacaaaugucggagcuagaauuugaaccuaggcaauuuggaccgaaagcccacacucuuaaccucuaaacuguauugauucaaacuaaagcuauauaaaggccaaacaugagucaugcauacuggggagggcacucauaggacuaugaauuauuuguuuauaaauaaugauguuguagauaacaaaggcauccucauauucaaguaacuguuagaaugaaggacaguuucugagaauagcggugaaugcagcaacccaaucguuaaaacuauucacauuaguucuuuguuuccucucaaaacucagaggaucuaaucagagccacuggaguuacagucuugcugcgcgauggcaaacgccacucaaggugccacuuugcaaugaucuucuuggagugaugauccuccucagacgccuacauaacaggcuugcagcauagcagcauuuuagugacuuuaaugucuuuuauuaucgauauguuuuuaacuguguuaauauguaaaaguugguucauagauuuuuuucaagaguaauaaaaaccagggccuguucgcucuaaaauggggguguuggccaggcgcgguggcucacaccuguaaucccagcacuuggggaggcugaggugggcggaucacgaggucaggagaucgagaccauccuggcuaacacggugaaaucccgucucuacuaaaaauacgaaaaacaaaaaaauuagcugcgcgugguggcgggcaccuguagucccagcuacuugggaggcugaggcaggagaauggcguaaacccgggaggcggagcuugcagugagccaagauggcgccacuguacuccagccugggugacagagcgagacuccgucucaaauaauaauaacaauaaauggggguguuaacaugcaacacucaguagggcucaacagaggaagaggaagcagcccucauacaggggagaggagaggccgcccuuaagcuaagggugugagauggugguagaaagugaaaagguacuagugaagaaauuauaauggaaaagaaggaagaagugaaguaggaaaacaccagauaugaaauaaagaguaugacuauaacucagggauaaaggugcaggaauguggccaaauccagaguuaggaaugugagcaagucaguggccaaaagucaaagcccaccagggcguuccccucagaagcucccugagggcaggcaugggcugcaugauggauugucggugggcccguguucuccuggaagagaagcauggcgcuguaugucuuuucccauuauuuuucuaugcaaccuccgugugcaucagaggugguuucuagccaaggacugcugagcucuaggcguccucaugagaagcuauggugucauuuuuaauacuucaggaagcuggaagagaauugugcauucacuuaauauaagcccgcaccugcuaaauaaaaugucaaguuuaauacuuuuagcuggaaaccugaaaauucuaaguggcagcacuguuuccuuaauacuauaguucugaaguguuuucauauauaguuuccuuuaagcaaauuuguuuaaagcuacaaugaauuucuuauugcuuaaucgaggcauuuuggcaggaaagaaguuuggguuuuagaauccagaggagaaaguaaaaggacuuuuugcacagaaauuuugagaggcucugguguguuuauucccaucaccgccucuccaagacaucaccagugugugccgugauggucaccucuauggcuuuuccuuugucacuucccacaaucauguuccaaaaacucaccucaaucauauaaccauaugaaauuccucuauugccuucccuguguguuauauauaugacacagcugauugcuaauagcaauagggcagcguaaucuuuucauagcugccaucauuuacaugacccccauauugaaguacguagaaaccauauuucucuuuucagcauccccaaaagccaauacagagaccucggaaaaaaauauauauguguguguguguauaucuauuauuacauauauguaauauauguaacauauauguauaugucauacauuaaauacaaaaauauauuauaauuuuguauuacauauauguaauaucuauacguauauguauauauuaaauauaaagauuauauuuauaaauauauguaauacaugacauaaauuauacauaauguguguaauauauguaacaguauauaaaaauuauauuuuuuauauuuaguauuuauacacacauauauauaaaacauuguuucugcaugacauuuaaaaauuggcuaaaaaugagauuguggugagcugaggagauuccugauaaaucaguugguauagaggcuacaacaaaacccuugaccuaaaacuucucugaacggaagaguugaugacugugaagcucaagugaugcaggaaugacacuggggaauguacacagaguuuugcaagguuugaauaugaagagaauucuugcagcuuuaaugauuuuugcaaauuuggugaaagacagauauaaaggguuuucuuuuaagugguauaaaauucauuaagcuuugagggaagaaaaaacccacagaaaagccugaggggaggaaucaucgaaaagggaaguauagguagucuguuuagauuaaauucagagcugugaaauugaaaacuguuuacccagcccuguauccagucucacuugaauccugguuccaauuuaaugauguuuggucuuugcuagaguccacugcauaguguuggauagauauuauauauuaagaagcuuuccuuucuuauugacugugacuuuuuuaaacaaaaaccauaaauaucuuauauucucuuuuguuaaaguaugagcucuaggugaauguuuuucuuuagccuuaagcugcaugauaguugauuuuaugugucaacuugacugggcuaagggaugcccagauagcugguaaaacauuguuucugggugcaucugucgggugguucuggaaagauuugcauuugaauugguagccugaguaaagcagaccuccuuccccaaugucguuaaaccacuuccaaagcuuugaggucccagauagaacaaaaagguggaggaaagcugaauuugcugucugucucauugccugcaccauguaaacaaccuucuccugcccugaggaauccugguucuuaggccuucaaaauguugcccuggcuuccaaaggucuccagcuugaagagagcagauagugggacuuaucaucagccuccauaauuacaugagccaauaccuuaaaauaaauacugauguauauuuuauugguccuguuucucuggagaaucuugccuaacacaccugaagcucucauuugcauguccauuuugucgccuauauugaguucauuccagauugagggcgguagcaagguggcagggauacugcuggaagaugccauucggcugagcacugguugcaucuccugauguuaguugaaucuucaaucuucucagcauuuugucagucucucaugaaugaacucaaacuaauguaauuuuaaaagacugauauaacugcugcaggagcaaaugcuaucuauugagaacuaccuuguguaggcuacuuuauauuaaauuaucacauuuaauccuaaauauuaaagacguggcaacuaacauucaggggagugaauuucucacccaaguccacacaauucauaugugccugggucagagccacaaaggcugucugacccuaaaccaauguccuugcugaaaaaggccaugcugccugcagagaaccagcuccuucauuuauaaugaaaagcauaucuagguguggauuggaugagaugcuuauccauuuuuuagaucagcauauuuucucccuguggguauucaaagaagaagccaaauuauaaucagacuauagcuuagugagccaggaaucaggauggagagggaggcgagaaagguugugugauuuaaauacauagaugaugguuugauagaugcagcaaaccaccauggcacauguaagccuguguaacaaaccugcacauucugcacauguaucccaguauuuaaaguaaaaucuaaaaauaaauaaaaauauuuuuaaaaauacauaauggcauaggcuaagauaggcugagaucaacugaguuaucucuuuuacaguugagauauuagugaccuagaaacuaaaucuacucauucugugaaacuggggucuggacacucaucuacuaugcuauagauauuguguuggggcuagggacaugugauggucaggacacuguuucuacccucaaaaauaacuccugagccagugggagaaaaagacaaguaaacaggcaguuuggguucaguggugaugauuauaaggauaauguuucggaagcacacagaaaacaucuaaagcagacugugaaaucagggacguuuucucacaagcaggugcagacugaaaucuggagguugaguagugcuaauccaggugaagaggguuggaggaagauggcaugaaggaggguagugaagaccaagggaacugcagagucuuuuuuaggugggaaaaaaacagaguggcuuucucgacacuaagaguuugcuguggcuaauguguagagcaagagagaaaauuguuaacuggaaaaauaaggagauaccagcacaggaaaugcuugagcagcacuaagcauuuugauauuauucugaugguauugaugccacagggugucauaaucauaccuacauuuuggugucagugugaaaugcacuggagggcacccagacuggagauggaagaauccguucuugaggcaaguggugauggcagccugaaccaaaggaaauaggaaugagagaauaucgaaagcgguggaguacagagaagaggauuuagugacaaauuggauguaggaagugagaaaaaccaggacacagggaugucacccagauuucuagauuucuuuaagugcgcugaugcagaagaaauacaagagaaagaagaaaugagaguuuuguuuauuuggguuuuuuuucgggggaagaaguuuggucauauuuucccugagaugccugggaaauaucuaugagacaaugucuauggagagauacaaaguuuaaagcuuagguggaauaucuaggcugaaauagauacugaaaaagagcaaaaucaacaugcagaugguaauuuaagccuuuagagagcaggaacuuaccaagggaaggaugguucccuaagggguaauaaauaaaugguaugaaccagugaggaggagccaaaauguguaugagaagucacagcacaagagguaagaggaaagccuagaauguguuugucaccaagaucaaaaggugaaagaguuucaagagagauccuuguucaacgaucucaaagacuucagagaggucaaaaaaauagucaccauggaaagcaaucccauuuacaguagcaccaaaaagaauaaaauacuuggaauaaacuuagccaaggaggcaaagacacauacccugaaaacuauaaaauacugaggaaagaacuuaagccacaaauaaagaugaauucugacuuacgaugauucgacuuaacaguuuuuguuuuuguuuuuuuuugacagagucucaaccuuuuccuuaggcuggagugcaguagcaugaucuuuggcucacugcaaccucugccucccagguucaagugauucuccugccucagucuaccaaguagcugggauuacaggcaugcaccaccaaauccaacuaauuuuuguauuuucaguagagacaggguuucaccauguuggccagggcuggucucgaacuccugaccucaagugacucaccugccucagccucccaaagugcugggauuacaggcgugaaccaccuaaccuggcaacuuacaauuuucugauuuuaugauggugcaaaacagauacacgcucaguaugcuccucaacuuaugauggaauuauauccagaaacacucauaguaacuugaaaauaucauaaguuaaaaaaugcacuuuuacaguauuuucaacuuauaaugaauuuauaaacccuauuguaaguugaggaacaucugcaagugaaaagacauucuguguugaagaacuggaaggcuuaauauuguuaaaauguucauaccauccaaagcaaucuacagauucaaugcaaucuuucguaaaauuccaaugacgcuuuuugcagauauagaaaagaaaucuuaaaauucauacgaaaucuuaagggauaccaaauagccaaaacaauucugaaaaagaacaaacuugaagaugucauacuuccugauuucaaaacauauuacaaagauaaaauaaucaaaacagugugauacuggcauaaaggcacacauauagaccaguggaacagaauagagaggccacaaguaaacccucacauauauagucacaugaucuucaacaguggugucaagaccacacuauggggaaaggacagucucuucaacaaaugauguugaaaaauuggauaccacacacaaaagaaugaaguuuggcccuuaccuuauaucauauauaaaaauuagcucaaaauggauuaaggaccuuaacaaaagaccuaaaaccauaaagcuccuagaagaaaacaaggcaaaagcuucaugacauuggaauugucaaugauuuauuggauauggcacagacagcaaaagcaaaaauaggagacugcauuaaacuuaaaaacacuugcacgucaaaggaaacaaucaauagagugaaaagccaaccuaugggauuguagaaaauauuugcaaaucgugugucugaugaggaguuaauauugagaauaugaaagagcuccuauagucaacaagaaaaauacaaauaaucuguuuuaaaaauaggcaaaauacuuaagcugacauuuaucuaaaaaagguauacaaauggccaaguagaugaaaagauguucaacaucacuaaucauuagagaaaugcaaauagaaaccacaaugagauaccacuuuauaccuauuagaauggccacuaucaaaaaaaaaaacaguuuggcaagaaugugaaaaaauugcaacauuuguacuuuguugaugagaauguaaaauggugcugcugcugcggaaaacaguauggcaguuccucaaaaaauuaaaaguagcaugaucauaugauaaaauauacuucuggauauguauauccaaaagaaaugaaaauagaaucucaaagacauauuugcacacucauguucauugcaguauuuuucacaauaacagaagguggaagcaacccuaguguccaccaguggaugaauagauaaacaaaaugugguaucuacacgcaaggaaauaucauucagccuuaaacaugaauaaaacucugacacaugcuacacauggaugaaccuugaggacaucaugcuaagugaaauaagccagucacaaaaagacaaauucuguaugguuucucuuaugugaguuuaucuaaaguagucaaauucagagaaacagaagacagaaugagaguugccaggggcuagggaggggaguaaacccauuguuguucaauggguacagaguuuccacuuugaaagaugaaaaaguucuggagaucuguuguacaacaaugugaguauguuuaacacugcugaacuguacacuuaaaaugguuaagauggggcuaggcgugguggcucacgccuguaaucccaaaacuuuaggaggccgagguaagcacauuguuugagcccaggaauuugagaucagccugcgcaacguggcaacacccugucucuacuaaaaauacaaaaaauuagccuagccggacaugguggcgcaugccuguagucacagcuacguagguggccaaggugaaaggauugcuugagcccaagagaucaaggcuucagugagcugugaucaugccauuacauuucggccugggcaagagugagacccugucucaaauaacaacaacaacgacaaaaaugaucaagauggcaaaauuuauguuguauguuuuuuaccacaauuaauuucuuuuauuuaaaacugaucauauuaacaauaaggaggugguuagugaaggcaauaagagcaagcucagggccuucgaugauacagagcuggguugcagaggauagggaaucaaugacggguaaggaagugaagguggaucaccaaccuuuuccucaaacgccucauacucuguuuccagauagaccaccugguugcuggcugauucuuaauuuuguuagauauguuaacaccauuugcuacagugcuacccaaccuuuugccauugugguaugcauagagaaugauauuuguacaacacgcugaagucaauagguaggaagcaaaagcagcuggaaauaucagauaucaaggauuccugaugcuccagggaacagcugcccaggagcgagaggaccguacccugaagaaccuauaaaucauuaguggcugagaguugaaaaacucugcauuucacucaaaucuguugaugcuaccuaacuccacuugaagccauucuuucaaucuuuuggucagagaugacucuuuugaggucaguuuauuauugcccauaacuuuccaugauguaaaucucaaaagaucagcuuauagagcauuugaucugcuauuucugaaauagcuacuuacuuuuauaauaaauucuuacuuuuauaauaaauguuagacuuuuuauaauaaauucucugucacacuaagacauaaacagcaauaaaauugguuugaagaaaugaaauggcuaagacagaacaguuuagaucaagguuuaagccaagaagucacaacagaggcucagaauuugggaauaucaauuaucaacauaaaaacaacagccuaggaaucuagaagucauucaaaaaguagaaauaugggaggccaaggugggaggaucgcuugagcccaguaguuggagaccaaccugggcaauauagugagacccucaucucuacaaaaaauaaaaauuaucgcaguguggugguccauaccuguggucccagcugcuugugaggcugagguaggagaaucacuugagccugggaggucaaggcugcagugagcugugauugugccacugcauucuagccugggcaacagagaaagacccuguccccccaaccccccaagaaagauaaagauagaaacagccaacuggauuuuuacagucaaauaaguauaggugggagauucaaaaagucaguucaaaacagaaguaccuguuagaauugauguucuccugauaugaguggaauucugucccucaaauagguacguggaagcccuacgccucagucccugugaauguaacuugauuggaaauagggucuuuguagaugcaaucagguuaagaugaggucauuaggguggacucaauaugacuguuguccucauaaaaagagaagagacacagacacagacacacagagagagcacugugugaugaugaagccacagaccagagugaugugguccacaaggaacacccaggauugcuggcaucacaagcagcuggaaaagucccauggaguagaccccccucagaaccuccagaaggagcuugccuugcugacaucuugaucucagacuuccagcccccagaaauaugagacaauacauuucuguuuucagccacccaguuuuuuggaacuuuguggcagcggcccuagacaacuaacacaccuccagagccuuguucucuggacucaagaagaaacgaucccuucuaaagcuggcaaguagccuggcugagagcauggggcagcagggaacaauggacguacccuuggaauccuacgccagccugcgccacccuggagcagcuuucucagcaguuggaguuauuuucuucugccuuucuuugauuauaggaaucaaaccccaucauaguaaaauuuuauagacuugagacuuucuuagaggaaagguuucuguaagcccuuccaaaauuucaugucaugugugauuaacucaaaccagaaggacauuguuuuagagaccuuuucuuugccucauccauggguacucgggacuguuuuguuagcaugaucucucuuaccauggaacaaacaugaaacuacacaccuaagauuguccacucgagucuacaaugguggguugucgguuguaucauucuuuaauugugcuaauucagaauuauuuucauucuaguuuccacagcacucugcaagguaacccuucaauuaaaauauauauauauauaggccaggcauggugacucacaccuguaaucccagcacuuugggaagccgaggcagguggaucaccuguggucaggaguuugagacuagccuggccaauauggugaaacccuaucucuacuaaaaauacaaaaaauuagccaggcguaguggcgggcgccuguaguccuagcuacuugggagacugagacaggagaaucacuugaacccaggaggcagagguugcagugagcugagaucgcgucugcgaaucuccaucucaacaagagugaaacuccaucucaaaaaaauaaauaaaauaaaauauagugggauuuggagggaagaugugcccaaacaggagagaagcucacacuucaacuccaacugaacaccacccacugcuuaacuguaaggaugcuauuuuauuuuguuuccuuuaaucaagagaacaaaauuguuaagaagcaugagcuuacugcacuguaccauugaaaacagcaaggaugauaaggaagagcaaccucgcagcacuuuuucuuucagauccugucacaggcagugggaaacuagauugcaaugguucuaagagaaaagcaugacaguuuucaguuuuaugcggugccuggcaguuguugaauuacaaaaaggcacucuuauaguuguguuaagauuuguugugaggaguuagaauagugagguuuacccuguguggaccuacacauuaaauaggaacaugcuggagcuggagucauugcccugauuccuuuugaacucaacuuucacacaguccguuuggaucuuuuuucaaguaauucauguacuuuuccguucuucuggaagcauccucacaaucugcuuuaucauccauucuucaaauauuugagucccuaccauguguacaacgcuaggccagguacaauaauaaguaaguucuuugcucccauggagccuucuggucuaauaggggaguuggauguaaaucaaguaauuaaaauaauuccuaacuguguaaagauugagaugagcuuucuucagaaaauaacaucauuuaaggagagacacucguagaagaccccgacacaaaugguggucaggggugaggaugaagaaaguuacaggagagcuaaguuuugcaagaugagccuuguggacuucacggagguguggugggucaggggaggggagcacaacuccagggagaagggaaagccucugugcacccagaaugcaggaagaccaggguggagugguauagaguaaguguggaaaagucagcagggcaugaaccaugcagugccuugagaaacacgguaaggucauuuaccauuuguuuuuuguuuguuuguuuguuuugagacagucucacucugucacccaggcuggagugcagugguacagucuuggcucacugcaaccucuaccuccaagguucaagcgauucuccugccucagccucccgaguagcugggauuacaggcgugcgccaccacuccuggcuaauuuuuauauuuuuagaagagacgggguuucaccauguuggccaggcuggucuugaacuccugaccucaggugauccgccugccuuggccucccaaagugcugggauuacaggcaugagccaccauaccagccagaacauuuaccuuuaauguuuaccuuuaaccugagccacugaaagcuuauaagaugggaggcaguggugaaccagagagcuguuuggaaaauaaaaucaagagggacuuggugauagguuggauuuaaagacaugagugagagagucucaaagaugauuccugguuucagguuucuacaguugcaugaaugaaaugucauuaacugaguuaagaaacacuagcauacaaccguauuugggggaaacguucaucaacucagccuugggcauguugaguuggugaaucuuucaagaugucugaacagagaugccuaauaguuguguauaggucuggaguucaggggagaaggauggcugccuagagauauaaauguggacauucaauguaauucucaauuauuuauucaggugcuguucuagacauguggcguaggucaaugaacagaacagacaaaaaugacugccuccuuugagcuucaguccuaguaaaguucuccauguuuucauaauacuggaagguguaaaucuggaugagauuguauagggugggaagaaaaaauaugcuggagccuugaggaagagcaacauuuaauaacugcugguguuugccuuuaugguaacucaaccugucucuguuuuccuccuuguguauuuucacuuucaguuccauugcaaauagucaacauuuucuguaucucagguucaaaacuugaucaauaagaacagauuuggucgauccagcuaaucaauaugauuccuuuuaggcaggaauuucaucucugauugccucgcaaugcuggccagucuuauagaaagucccugucuuuggcccgguuucuggcucaaccagcuuugacaagggugaugaguuacuuuguaccauaaggcaauuuauaaggaagaaacaccuucauaaaaaaaaacaaaaacaaaacaaaacaaaaaacagaacaggcagacauuuggagaacucaccugcauauuacagagagauuuaauauguuuaucuauugcaugccacuguaauuuaacagucuaggcaaagguaacagaaaagaggagcugagauaauccagcuccuccccaaccacucauucaggaggaagcagaugugagugccauuguaggguccugagggaguauugguucccauuuccuagccugccccuccuccccacgcuuggucaguuacaccuucauauggcuccuguucucacuuuaccucucugcuuuaugauaagcgcagauaaaaggcaagagacacagacaaagcgaaaaagaaggaagagggaaggaaauuuagaagggaccuugcaaacauuuuccuuccacugagugguccacaggaggaaacaaugaaaacuucucucuccuuugggaggccaaggcgggcagaucacaaggucaggagaucgagaccauccuggcuaacauggugaaacccugucucuacuaaaaauacaaaaaauuagucaggcauggugguguguaccuguagucccagcuacucaggaggcugaggcaguagaaucgcuugaacccaggaggcagagguugcagugagccgagaucgcaccgcugcacuucagccugggcgacagaaugagacuccgucucaaaauaaaauaaaauaaaaauaacaaaaaauaacaaaaaacaaaaaaaaccuucucucucacuaacaaagagaugugauuuuggagaaaugucuucccucucuuucaguuuuaccaaaucuaacuuggguaucuuuagauccggugugcccucuuuucuuugaugacacgaguccuaacuccuauauauugucuuauaugauuguuuuaugucauccaagcuggcacuuauaucaucucccuggucucauaggcauuuaaaucugggccccugcacuagacccugacaagaucucuucuagaucuaaaauucucauccgggaaagagucgagagcugucauuacugggacaccuguagcuguauacuucauuaugacagaucuguuguuuauguccagugucucuucugauuuugggguguucaugcugcaugguuuucuaauauacguaguucuaauauguucucuguucauuacugcgaauuucugcuccgaccccuggccaccuacacaaaccgcaauccccagcauaggcaacauguuaguaaccacccggagggggcgacugcaagccaugaugaagagcugggucuaccauguaccugaccugugcugcaagcucuggcacuagagcuggggucacagggcccuagauaaguaaucuccucugagaauagucagauuuugucaauacauacaauuuucucuuagcagaaaucuugguuguauuaauaaaugcugucauugacagcauugcuuuguauuuguacauggaucaaaugaaagaauaaaagucaggaaagugaugauauucauuccuugccauuuacuuaauaugccaucaaacuuucccacuuuccuauuauuuuuucacucugggaguuuaggaaagggaauuauaugacuaccuggauucucauaugccuucaacauauuuuuaacuggaucauuucaucuuacucuggauuugugccuaaaaucucagugcuaagugcucuaucuucuaaauugagauuccaccuuccaaagaugacuggugguccucuuauuccugauuaucuucccagcucacacucccccagaugaaauaaggagagugcugugggaggaaaguugugguagaaucaucaguagcaguguuuacggagagagauuauuccuccuuugccaaagcgcaagagaggacuuccagagaaucacuuguaggagugaggaguaccagucaaacagaaagagacuggcucuucuaucuggaagcuuggaaacccguagcucuacucaguucagccacuagauuacagcaagcugaguugguugugaaaggaagcuggcaucuuccuucugaagaauggugcagauggggguagagugaaccugcccuugcgugacauagacaguucugaaagucagaggccagccagaguacagcuagcaguagcuugucaagaaaggacugucaagaagaauauuuucuaagauuaaugcugggcugggggaaccccaccccuuucuccuucucugccaccucagacagugcagaggggagcucagcggugcccaugacagauguuagaggaagguuggggaggcagagggcugcacaggcagaggccaagccaagacaugcucauucaggagaggauuaaaggaaggaccuaaggaagacaagauucucuuucucuuaggacgucuuuggcugcggaagaccagaguaaaacucuccuuauacaaaaaagaaaucacacaaauuauauguuaacccuaucaacaaaggacauaagugcugaauggguguagauccaaaccaaacuagaagggaggucagugguuuccuaagauaauaccuucugcuccuaacucuccacucugaccccaacuuuggaggagcuacacccaaaagaagaagauguggagcaaugaaagaaaagacaguugguugcucacccuguaaucucagcacuuugggaggcugagguggguggaucacaaggucaagaguuugagaccagccuggccaacguggugaaacccugucucuacuaaaaauacaaaaauuagcugggugugguggcgccugccuauaaucccagcuacucaggaagcugaggcaggagaauugcuugaacccaggaggcagaggucguagugagcugagaucacgccauugcacuccagcucugggcaacagagcaagacuccaucucaggaaaaaaaaaaaaaaaagaccauguccccucccuagcucaaaaccauaugucauacugucauguaauggggugaggaagaagggagguuugaaucagauaugagacuagacugcacugaaguaaauuuuuaauaaccaaaguugaccaaaaaguuagggaauuaacuagggauaacaaccagucuuuuauccucauuuauaauccaacuuuccuauaauugaggaugacugauuucacuguuggccuucccuuacauuccacuuggagcauuacucagugagagguagggcauccccaggcacagugagaggugagacauuccuggcauucugucaccgugaaauuuccaguccucaucuuguguuuucuguaauucagcucuaaagccagccauuucuucaaagagugcugauuuguuuuauuggagaaugguauuuagggaccaaaaaccuagcacuagguuucucauuguuuccaguauaucaguguuucuaggcucucucagcaagaagagcagggaaauacauguauguguacuaacucaaguacacacauacauguauuuagcuaguuuuguauauauuuaccuaucuaugcaugugucuuacauaaccauagaaccaucugccuugauaacuuguacucagguauuaacaauauacuaauuuuguuagauuguuacugggacaugagugcaguauauacauguuauuuucuuuaauguuaucccuauuuccacuuguuuuuaauaaaauauguggauuaaugugaauuuucauaguguaucuaauaagcccuuuuaucaacauaggagacauuuaaaaacuauucauuugaccacagacauacacaaaaaugauaauuggaaaugcaugauuguggccagaaaagaaauuacuuaagggaauaggacacugcugggguccaagaccccaauguuaagacugcauuccaaaguacguauuuuccaugccucuaauuuaaagugucauauuuauuugauaguaaauaccauuacugauacaacguuacaugcacacuaagugcaacaaauaagggaauuuucuauagaaaaugagagccagaguucauaccaucagagaaagaaguuauaaaugagcagaggggagaugccacaggagaaccuguggggcuagauuaggaguaucaguaagaacucagcuuauuuuaagagagaggauagguagguaguuacaugcauauauauauauauaccugcauacauaugguuggaggguuauguaagauacauacguagguaaauauauacaaaacuagguaaaugugagagaguguguguacaugaguuaguauacauacauguauuuccccgcucuuucugcugagggagccuagaaguaaggauauacuagaaacaaugagaaaccuagugcugggauuuuggucccuaaauaacauucuccaauaaaacaagucggcacucugaagaaauggcuggcuuuagagcugaauuaaagagaacacaagaugaggauaggacauuuuguggugccagaaaauaaagaagagcuaaaaaggaaaaaacaaacaagcaaacaaacaaacaaacaaaauagauagaaguaugucugaagacuagagaagccgacugaaagugcccccaguggccaaagcaggaagacuuugagcaaugaaaugaauaaggaaaguacuggguuauaacccaaagaauacaauaaauagucacaaauacauauuuauacagauacaugauugaauaaauaaauaaaggaggagggacaacugauucucucagaauaauuccaaguaagaaauguagagaaauagaaauaauagaauaauaaaugaaguaaacagaaaauugccauuaggaaacuauuguuguaauugccacagacaagagcugaugaauaccaaaauuaguaugugaaacuuuaaggagaaauaaaacauuugcauggccucaaaguguccucuccaagucuuuuuuuaauuauuguagcagcuuuaacauccacccacaaauucuuugauacuccuccuuccuaagagauaaagcuuuaauucuucuaagugucaguuggagucagugacuugcuucaagccaauggaguaggaaaagagaaacacugaauguaacuuuauaaugcagaaaccuggcagacaucaccuuacccaaguaaggacaguuaaccucaaugucauauacacacugauaugacgagaagggcguaucaucuccaugguauuugucccaaaaauguauaagcucagucuaaucaugagaaaagaucagacaacccaaaauugggggacacucugcaaauuaccugacugauacuccucgaaaccaucaaagucauuaacaacaagaagaauuagaggaauugucacagccaagagaaacuucagaugugacaaugaaaugcaaugugguuuccaggaugagcuccuggaucagacgaaagucauucgugcaaaaaccugggaauucccaauaacuucuuuaguuaaaaguauuugaccaagguuaauuuuguaguuuugauaaauguucuaugguauauaacaugcugggucaagguauacaggaacucucuguacuaucuuugcaacucucaugugaguuuuaaauuacuucaaaauaguguuuuuguaaacaggaugagaauuuucuaugguaagcuguaauaaugcaacauagaaauuagcuccuguguugccuuguucaaagauauguacaucuguguagcuuucugccaugaauacguuguaucaaguuuauacuuuauuauucuuuuuugaucuuaaaaagcugggaacacacacuuuaucaagagccaaaugcuuuuugugauuuuguuucuaauagaaaaucugauguaacuugucauuacuccucuuucaucuuugccaguaauauaacucaucugaaaucggcagacuugcuugugcuggauaauauagaugauuccauauuguaaaggcucuaagaaaacaauaauagaaugaagagaaauauuacaaaugauccucuucugccuguugaugggacuccguuaguguugccuucuuguucucaucucaucaccauuggauuaucauuguauugugugcacaauuugaggccacagggccacagagaguugugcccuuaauuaaaaaugcaucaugcuaguaggggaaaagcacacguaauuagaaaguuauagugcaaaccccugagcaaggugcaacagagggagaugugacuaaaugcaaggugcacagaggaagaugugccuaauuugguuuagaggcagguccuggaagaugugucuaaaaaugaugcauaaaauuuucuuaggaaaacgagagaaaauaucccauauaagaggaauaacaggcacaagauucacaaguaaaaguguaccaauugcuugaaaguguuguuuugguguggcaguauacaacaguuuuagaagcucaagcucuggaaucaggaaaauuguugucaaauuccaguucugccacuucuagcuaugugacuucaggcagcuaauugaagcuccauggaccuguuuccucaucgaugacauugcauaauauggagcuaauuaugguaccgacaucagggagcuaauuuuuaggguuaaauaauauuagcauaaaguguucagcaucauauccagcacgcguguuuacugcuucaccuaccaguuguuauucugagaaauauuccuggagaagaugguuuuggaaggauuuauaagaguuaaauaaguguauugcaggcauggggagcaguaucuucaugugacaucccugugugaggggggcacagaccuacagguuagagcauagagggcaaagcacuggaagacccgcuuaugccaugcuaagaagauuagaauuucuucuguacauaauugauagucuuugcauuacuuuaaggaccagagggacauaaagguauuucuuuucuagauguucuaaaagauugguuuaaagggaaaaaacuaagacagaaagccaguuaggaagguuucaggagucucaacgagaugaaauuuggaugaccaauugaccauuggauucagcaaaaugggaaauacgcugacuuugccaagagcagccccacugaggcagggggggacaccugagacaggagaggcuggaagaggggugggaagcgauauaauggugcuguaagcaucucuuugaagaagcaaccuuaaauagcaaaggaggcaugaucaggagaaaugguuuaacugccuauuuucguuuucauuuuuacaaccaagagucuugagaaaacaauccaaucaacauagcaaacgagaagaaauuggggaaagagggagagguugaguugucucagauuagccagagggaagggacucaagcacacauaugugucaccccauucauaugggugaaguccuccuccuguagagcaagcagucacuguggcauggugauagcuuugguuuguauagcacauuucccuugaguaauucaaauuacaggcauauugcuaucucacuuacacgucuggcauuuauaugaaagacuaaagauccucauuuuuuauuugagaacacugaaauccaaaggggugaagagauuauaaaacugaacaaaaguuuaaauccaugucuucuuacuuuguuuuuuacuguuuuuacuuaugcuaucucugauguuuuauaaauuaaaaaaaagagaaaaauuacaugggaguguaugugcguguuuguguguguguaaguguguguguguguauccugaauucccuuuggugugacauuuuucccuagcacuuaacgaagaaucaucucacaauaagaaccaaguaucuaguugacaugaaacucuaauauaauuuccucugaaguggagcaaaaaagauauauacuuuuuuuuaucacacugagcauauuucuaugacucaguaaauucucugauggaaacaacugugucucaguggaguaacaaaggacagauauaauauaaaauagagauguuugggaccuagaagaauaaaccuacaaaaucaaucuuuauucaucaccacugucucuaagaaauuauuaauuacauuaaugggauauuaaaggacaauaauaugagcaaaaugugcucauucaacauaauuagguauucuggauuugaauaguuuuuuuuuucuuuuacuaauucauuagaguuguugguuagcuuagccuugcugcaaauauuaucuauguuguugcacaaaguaaccuucugaaggacauuuaaagcuuguaagaucuuaaggguugugauaacagcaugaaaguaaacauuuuaugcacacuucagggauaucauaaguggcaggaaugcaacagucuguuauaagugcucugcugagcucccaaaccaacaaacacaaaacagccacuuaauugcccagugcauccgccccuccgaaaacagagcuucucuucauacuuacuuaagggacaugcugcuuggacgaaugaguaaccagccaggauacagcacaugcaguuaaucagcuaauguuaugaacauuuuggaugucagcuaucacauaaaaauguagcuuuuauggcccauaggcuaaccaagaaaugagcccuccaauuucuaucuguggcuucagucgaugcguccaaauaauugaaaaccccacuuugaccuuggauauacuggguguauuaaauauuuuuguaaaacggggaaaaauuagugacuuaaacauguuuuuugaugaaacguuugaaaacuguacaguaucgcugucuucuaugcacuaauuugacuugguugccuuuuguccacagcagaaaagacagugcccacccaccugaagaaauucuguauuggauuucacaggccagugagggauauucuuuguauuugcauauuaagguuuuauaauuacacagagguauuauuaaaaaccaacaugugugaucauuauuccagaugccccaucuguuuugacugugcgauuuggguuguaaaaucacauauacaaauuagcaagagaaacucccuugaaaaauaauaguuuacgccuuagcaagacucuauguucugaauugcuaugucauauauauagauacagaaaaaauagcuaaagccacuguguaaagaagcaaagagacuucagccuuaauuuauucacauaacaaagaggagggacuccuuucuucugauugaagauaaugugguuauuuuuccuauauugaacaaccaaaaaauauucuacaguuacaucaacucacaaaucuaugcacaguuuucaaacuaacacggacuagauuucaaaaugagaaucucccaagucugaauguuuuuuaaauuguuuucuuuugggaaaucauaccaaaaaauuacaaaaauuuuuauuuaauguaauucuucaauucaguuauuccucacagcaaucagaaaggaacugaaacugaauaauguuugaauauuuuaacagaagaaagcacaggcugaaauagggaagauuuaagcgaugaggcagaacacaguaugugucgugcagagcaauuacacccgaagucucuugagaagucagggaaagcagaggauuucagccgcccgauguguaaugauaucucagccaggcagaugcugagccguagaauagcacugagcuuagacgacuucuaguuuuaaagcucaagguuugaaguuuguuucuuugauucuaauuucauucuugcaaaugugcuuuucuuuaccaugugaaugugugacaaagcuaucauuugaucucucgguugcagccagacuucaugcucagcugaggccauuauaaacuuccuuuguacuguucuuuacauuagauuuuucaauaugagaaauaaaauccuaggauucucuacacuguguucuuuuccuucaagaaucaugaucuuaaaaacacuuuuuaaauggacauuuacaauuauaauuacuuuauguuaaaagaucuucuuuucuugguauaguauaaugaucuuaaaaauucauaaccacuucuuauaauauauauuauucauucauuugcaucaaaguaaauuuaaucuugcaaaaucuuugcuuaaaugcaaaaaaggggaaagaauuuggauaaaagguagaauaccauuucauuacauuuuaaagaaacuuaauaguggcuucaaaauaacauguaauacuuuguguaucauggucaccucaucccccaccaccaacacacacccugucuacucccaucuuacucuuucuuccuuuuucugugucuguagcuuggucaaaaucauggguugggaaagacgucaaaguuuugguggcugauagugccgaaguaagaauggaauaauuuugcuuaacugcaucaucuucccuuuugaaaaacuuuuaacugaacucuaauauacauauagaaagagguauaguauacauuuuuguaaacugaacacacccagcacccugcucaggaaauauugacugugccuuagaagcuccuuuccauacucccucccgcuccccgccacccccacccaggacgaccacucugcagacacccggcagcacacgucagugccaccugcugguuuaacuuccuccacguggaauggaguacauacaacaguauguacucuguuguugcgucuggcucccuucacucaauguuauguugugaaauccacauuucuuacacugagauguaguucacucauucaaauauuuaaauaaacccaaauguauuuucccacucaacugcuagugggcauuuggacaguucacauuuugggacuuuuaacaacugacacugcuguggccaagggagggcuugugccuugugggugugcacgcaguucuugcaggcacgcaccuaggagaggauccacagggcugcuggauuuaccugugcucauuuuuaguugaugcugcuucucucuuaauaacagcaaagagugcaugggaacugcuguccagaagaacaaguccuugcuuuuaggagguuugauucagugccucagccaugagauucaaaauacucacccuucaagcagccgcucauccuucucuguguuaacuggcccuuaaugcacaacuguagggcaaugaugccagguuugcacaaucgugaagaaccuucugagucuccaaaaagagcuucccgucuguucuuuguaguuucacagcgcaaugaccaaguugugcugaguucuaauucauuuauuuacaaagaguucuauuucuacucccuagaauguacuauagaaguaaauuuaaaaugguaucuuguuccuaaggagcguacaagcuuuggggaguguaaauaucucuaauaccaauuagaaugcgggugaaacccauuuuuaaaauguguaaacaaggugacuguugguauccuacauauguuaaacaauauauucaaggauauucgauaaaauauaacuugccauuucuccaacaugucccuuuauaauuuuuuuuuuuuuuuuuugagacagucucgcugugucccccaggcuggagugcaguggcacaaucuuggcucacuguaagcuccaccucccggguucacgccauucuccugccucagccucccuaguagcugggacuacaggcgccugccaccacgcccagcuaauuuuuuguauuuuuagcagagacgggguuucaccguguuagccaggauggucucgaucuccuuaccucgugauccgcccaccucggccucccaaaguacugggauuacaggcgugagccacugcgcccagccuacaaaauuuuuauaucuguacuuugucuaaacauucauuaguuugucaacgacagacaucaguucagguuaaacgacacaggagucuaauuuuauucucuucugugaaucuaaggacacgcauacuccacacuaacaaauuuauucaaucaaucaauagauauuuuaugcuuaucucucuacccuucaggauauaucuaaaaucuuuucuuuuauuucccaguugucugcuggagaguuuagcuuagaguugaguuccgccaccugaucaauaccauuauuccuucacugaauauuugcucagcucaccuuguguccagugccaugccagccacugcccguggaauaaugagcagagcccugcaugguuccuguccucaccaaguuuacagucucagggaaaagagaacuguugugcaaggggucacacaauauagugucaaacgacaguacgaguaggggguuuaaggcauucccccaaaauuuuuguccagcuggauccucagaaugagaccaucuuuggaaauugggucuuugcagagguaaccaguuaaguuaauuguucuggaugguccaguguuuggcaucuauaaggaaaaggagagggggauucagauucagagacacagaaacacgcaggcccagaaggccauguggugacagaagcagggaugggguguuacagcuacaagccagggaacuccgagcauggcugagaaucaugagaaacaagagaaaggcaaggaaggacucucgccuggagccuucagagagagcauggcccugcuggcgccuugguuuuugacuucuagccuccagaaugcugagagaguaaauuucuauuguguuaagcuaaugaucuagugguaaugugugacaggaguccuaggaaacuaauguauuguggauucaauugacccguaagaaauugcagauguucaacugcuuugagccacacaaacagcaauauuauaggauucauccuaccauguuaugagcuuguaagaggaaaacuuugucagagaaagcuucugugaggaauuucuaguggaacugaaaucuagaaaacaaguagaauuugauggaguucaagagaaaaagaggaagaaaggggaacccagcagagggccagcagagggccggcagaggugggggaggcacagagguucugaggcagagggugcagauguuuccaagcaacugaaggaugugacuggaacccgguguggggauagagcuagcugaggcuggacaggcagggaggggccaaaaaaaggccucugagccuagauugaagauugagauuuugaccaggcauggcagcucgcaccuguagucccggcuacucaggaggcugaggcaagaggaucccuugagcccaggaguuugaggccagccugggcaacauugcaagaucccauaucuuuaaaaaagaaaaguuuauauuuuuguuuuuguuuguuaaaacaaaaguuuuuuuguuuguuuguuaaaagcaguggguagccaggugugguggugcaugcuuauaauuccagcgacucaggaaacugaggcuugaaccagaaggcagagguugcggugagccaagaucgcaccacugcacuccagccugggagacagagcaagacuccaucucaaaaaaaaaaaaaaaaaagagagagagaggaagaaaaaggcaguggaaugccauugaaaaguuuuaagacagagcgugagaaauggcaauaaccgcagaaugaagagcagauuagaaagagcugaagcagauggagaaagcacugcaggaaaugcaggaacccaguggugcauuggccagggaggcacugguggggaugcaggcagugggcaggccuagaggcuuuuaggaaagaacucuguguucucauuucaaugauaugucccaauuaauauaccauuugcccuugugucuguuugaagacauugaauucucauaaaauaugcauaccaguccugauacaucuagagcccccaagucaacucuucugaccacgugugucuauucugcugcccgugaagucucguggaguagaaguagugccuucauuuuuuuucuuauuucucucuuugcucuauaccuuguguuuccgagcacucuguuccuauaucugccagaguggccauucuauuuuauuaucauugucucuuuauagaacuaucuacccaguuauacugugggcuccgugagggcgagugcagugacuuauuucuuuuuauauccccugagcuuagcacagaaccugaccuguaagauuugauuuauaagugacaguaucaauguauaaauaaaugagucagcaaaugcaugaauuaacaauacuuuauuucugcucugucuuaucaccuuuggccugauauaccugccuuacacucugaucugaucuaauagauuaacugcuuuuucuacuucugcucuauuuaccacugacaaguauuuuucuacuaguuguaucaacuuuuagaaaacaagacucuuccugguaaaucucuuuacucguguguggaaucauuuuucuaacuguguaccucucacagagaugcuacuacuuuuuguuuugugucuuugggagcuaauuccuuaccauugucaucaucauaaccauggaacuguugagaacgugccauuuugcacacauuacugcguugagcacuccaguuaggaagggaggaaggcaacgaacagcagugacuccuucuccaaauaagauuaccaucuaagacagaaaaaccaaaggcuacccacaaaaucaaaucagacuuacaaauggcuaagguaaauguuuauguuacacaaaacaaaaacauaagagcgauuucugcagccuaauaagaaaaccagaaaucaggauguauaaucucaucaugagcucacaaccaauaggauaguugagucauccaucauauugaaaugggaauguuuccccaaaaagaagcccuccuguucuccuuagccaauuuguauuuccacauauaggagggaugcauugccaucucucuuccuguuuuaaaagcucucuuggccucuaauucuuaucuuuccauaauuccuaaaacaaauuauagaguaaaaccauacccaacaaggagguaaaugaguggaugauuuuugaaacccaccccccaaaucccuccaaaaaggcagccugaauuacauguacucuuugaaaggcaucaguguuaaaagaugcaguuugggaagccgggacagaagacagggcagacguggggaaggguguuccacucugcagaagguccuggagaaggggagagguaaacagaaguaaagagggacuccaagagacgucggcacugggagagaaaaagagagcauaggaaaguauagcaugaauucuggaagccacaguccaccuuuguaguaucuuaguucagccuuguuccaguuuaugauguuaaaccugagcuucccugaaacucaauuuguagaaauauaaauauacacucuuaaauaaauccauuugauugucauuccucacaaagauaucauauggcauuuaaguucgucguguccaagcauguuugcagccaaauggaaaacucgcugcauggaccaaaugugguauuuguguuuugagcuuuucuguuuuaaucugcuaggcgacauaaccaauuuuccugccauugucucucuuuacaaaugcuacuacuuaguaugauucuguaguuaauuuuuuuuaaauuuuucaugguuuuuaaaaauuuuuaauucuagcguuaggcauguguaaacaaauuuuauuguuuaaauaugcaaguaauaguaaaccauuaaaaaugucugagaugaaaagagacuugucuuugggaauaaaaugacauaaaguuuuccuugaauuuuuuucugguuuaguuuuuuuguuguuaaguuuuguuuuuguuuuuucuguuaacucaaaaguuuuagcucauagagcaauuuauggcgggcaagagagguauacuugguaggccuuugcugccaucuacuggcauuucauguaauuacuuauugcuuccauucuaaaacuaauuuuguguaacguauauaauaguauuauagguucccccuuuuuuucuucuuuccaauuuuucuuuaguuaaagcaaagugaagcaaaugcggacaccaaagaaaagcucccuuuacgccugcgaaucuuugaaaaauuuccaaacagaccucaaauggugaaaaucucaaagcuuccuucagauuuuacaguuccuaaaaucagguaccaaaauacuucuuuaauugcauauuucacauauauuguaaaagauucaucaucuuaaaucugauuuaacccuucuuuuaaguauauguggguuggguuucuuucuauuuuauugucaucuuucuacuaccucuaccucuauuuaaaauaaauaaauaaauaaacaacuuugacucuuuuaagcaauguauucacagaagagucacuuuauaacugcaguagccuaagcaagaaggcugcuucccaucgcuucucucugggaugacuccucgggaaugggacaucccaggaaacuggagaagcugcucaguguugcagggauggcagguagacaucaaucucagaccccaaccguaugagacuaaaauugccucuguggcccuuuuauuuucaagcaaacagggaaaccacagcuggcccaguuuguguacuacuacaguguuuauggagccuaccaugucagguuaccauauauaauuugccuuccacuuuuuaaaagaagaaccguggcguuuuuccacucauacugauuugauuuucuaccacguuugcccuccaguuaagcaaaugcauaaaagaugcuuuaaacaccuauuuuuaauaauaaaaggaaauucuucuaguuauagcucaagaaauuacaaacagaauuacaguaauauguuacuagcuuuaaaaauaauucugugggggguuauaaaaguaugagacuauauauggugccauaauauuuaaaauucggguagaaauauauuugcauuucuaauuuuaaaaaacaaaauuaauugaauuugguaauuugaagagacguuacuugaauuuucguuaugcuuugaagaucagaugaacgcacuugcuuuugagucuuaaaauguaaaauucucucuuagucauucuuaugauaaauggacauuuagagagagcaacuaauucuuccaagucuuagagggggaaaaaaaguguuuuauuaccacaauaagauucaaaaaacugggcugggugcgguggcucacaccuguaaucccagcacuuugggaggccgaaccgggcagaucaccugaggucgggaguucgagaccagccugaccaacauggagaaaucccaucucuaguaaaaauacaaaauuagcugggcgugguggcgcaugccuguaaucccagcuacucuggaggcugaggcaggagaauugcuuaaacucgggaggcggagguuguggugagcugagauugcaccauugcacuccagccugggcaacaagagugaaacuccgucucaaaaaaaaaaaagauucaaaaaacuaccaucgguuacugaguaauauugcuugaaaguuauuucaaggauauugcuuuuuaagcaggagucacugaguuucaggaagcuguugcuaaugaaauauuuuagucaugaucuaguuuucuaugaucuuuuaucacugcuuuaucuuugcucaagcaaacucaucauugcaaaaugcugucacuugcucccuuccacuaauaaugccugaugcacauauacuucauuugcaaagggagaguuuuaugaagcaguuuauugaccgccagcaacaggacacauguugccuccugagaagccucccgaccaccucuuccuccuccugcgaccacuccaaacgcucagcaauugaggacaacaaauacaucgaccaaaaaguaagaucugcuguuucgaauaaccaggcuucuaaaaagcaucuauguuugagaaaagaaccgcagaguucuuuaggguccuggaauccaauuucucaagagaauaaugaaaauaaaaugauuucauuuguaaaagauaucaugaaaccuaacauuuuuuacucuaugcauugaaauuuugcauuugcccguguaagcuuuugagcugcgccacguggcagccaugcgacuuuguaaacaucaagagccucccaaaucugcauuuucucaggugcggaauaaagggcugggaucuccaaggcucaguccagguguaaugaccugccaucuccugcaaguacaacugcuuaugucuacuuauuacaucagagaggauacgagagcauguuucucuaaaaucggucgaaagaauugccauuuauucaaugcuuaguauguggcaggaacuuaggugcaagagcuuauucauguucuaguuuaccuauuucuuuaucauuugaaaaguagaagggaaaauuuuuuucagauuccacagcaaaguaucaguagggaaccacauauaaauaaagcaaauuuagguaauaauuuuaaagaaauguacuuuuucauuuauucacuuuuaaaaaaaauaauauaagggcugugugccauggcucaccccuguaaucccagcacuuugggaggccgaggcggguggaucacuugaggucagaaguucgagaccagcuuggccaacaugguguaaccccaucucuacuaaaaauacaaaagucagcugggcguggugguggaugccuguaaucccagcuacucgggaggcugaggcaggagaaucacucgaaccuaggaggcagagguugcagugagcugagauugugccacuguacuccagccugggcaacagagugagacuccaucucaaaaaaaaaaaaaaaaaaaaagacauagaauguauuaucuagguauaauaaguaaacauauuuauauauacacacauagacauauaaauguauauguguguauauauguaugcauaguaucaaacuauauauaucagcuuggucacauaaucaaugucaguucaguuagaaaaugaaagauuaauaauuguccuuuaauauuaaagagauuaaacaguagaguuugcaaaaacaucuaguucacuugcaaguauuccacuuuggcauuccuagaguguuuuuuauuccuuuacauuguuacugcccuuuuucuuuugcuuauagugaaauccauauuucucuaugaucaugugacaauaaaaugccaacuguuucauccuccaggaucuucuuucucuccgcuuucuuucccuucccacagggaugaacccuuuggaauucccucaccuuucucuuuaucucgccuccccuuuuucuccucuuucuugccuccccuuuuuccuccuuuuucaccucccccuuuucuccuccucuuucucaccuccccuccccuaaugugauacuacucccguuuaccucucccccagcucccagguucucugcuguaguucagucauguugcucuugcugaaaaugaugaugauuuucuuugcaggaugucucuucuuuuucaaggauuuccauguguugauuuuccuucagccaucuagagaugcuauucuacuaucuuugcagaauccaagauuguaaaugacaagucugaugccaaugucauuuuuuuuuuaaguaauuagccuuuugguugguagacuugguuugcuuguuucuucaggaaaacuuguaagauuuucuguguauccuuggaguucagaagcuuucuuagaauauaccuuauaugucuuuuuucaucagaacugcuccaacuagagucuuuucagcuugccaacuaagauauuugcucagggaaauuuccauuuauuuugcguucaauuguuacucuuccaucugcuucucucuccccugggauugccaucucucuauuuuuguucugugcuuggucuuccaggacacuaauuagauuucaacugaggucauccuuugcuucuaaauuucucgugaaaaauuaugauauggacauaugacccuuaacuauccuuaaaggcuugcauauuacccuuagcuguccuuagaggcuuuacuuuuaucuuuuauuuuuauuuuuuuagagaugagaucuugcuguguugcccaggcuggggugcaguggcuauucacaggcacggccauagugcacuauagccuugaacuccugagcucaagugauccuccugccucagccucccgaguagccgggacuauaggcauggccaccaugccuggcuuuuuugauuuuuuuaaauuaaacuuaucaccucucuucuucacaguuauaauccacucaacacugugcauggggcauggaagcagaaggucauaugucaguggauaaacaagugggaagauagugccuuggcuucagccagucagucugaaauugcaguuugcguggacuagaaagcagguuguuuuguuuuguuuuguuuccaaagcagauuguaagccagaagucugggcuguccuugugaccacuuaucuccaggaagaggauagagagcugauuuccauuauggccaaagucacaaaaccaugacaugcuuuuaaaaaucacugguaacacuaccccacuggaaacacaaaauugaaauaugaguuuauuuucucucuaaaaggaaaugugauuguuucucacauuuccugaacacaguauuuugauuuggugaggacaaagauaaaaagagucuugagaggcaugugccgggcugaggaggagucuaaagagaauguggcccgccccucugugcgcccgcccgaagcgaacccuccccagguacaguuggaauaacacguuuuaucccauacaacaugucuuauugcucccacuuggaaaguggaaugucaaaaacauacuuuuucuucaucagaggacccuauuaugggaguggcaagacaacugcuccuguuacuauccacgcuuucuuaaagcuuugauucgaucuagguugucagaaaaguagacuuaauucuuuucaggauccaccauuuucagcaauaguucccaccaguucuugguguuccucauaagaccuuaggauuugucaaccuuguugagugccccugggccagggaaaucuaaagcagaaaaucccucuucaaaggauuucagugauaaggauuuaauggaagcacaaauugcggagacagcauucuggcauuuguauuaugaauacggcaagccuuuuucauuuuuauuaagaaacccgaaagccacuuaaaaacaagagcgcauaaacacagaacaaaaauccccgucacagacccuaccaccauuaguuccccuuauaaaguauuuuucagcgagcacuuagaaauuuccauuaaaaucccaauugccuuuggaaauccuagucacaguaaagugacaggcaggguucuucacucuacgugaaaaaaaaaaaccacccagcccucugcaaauugugcaaauugaggcuguguuuccucagugacugguaugaaagaaaaaggacauuagaggcugguuuaucggugauucucauaacaugaacaaaggaacaauaaaauaaaacuguucucuuaaugguuaucuuguaccaggagaaacuucugacuucacuaugcuagagggaaucaccuuucucuuuccagggaaaauagugaagccccaggugccugaagacugcaaguucagggagaaaaaaacaacaacugacagcaaccccagaagggggcugggguuugaugaagcauugcagaaaacacaaaagcacauuaggcaagauuuucucccaguaauuacccaagcuuugaacagggaugaguaauucccauggcaaccucacuuugcagaaaccauguuuuuaaaaauagcccugguggaucaccuuuauuauacaguuuaaaauaccuguccuucucccagaaaacaaccagcaaacaaaaaucuuuaaaaucuuggggcugacccagauccuaaaaggaaaagacaggaaagaguguuuuccugccugucguuugagacuccauagaaacgaccuucccaaguggucauuuccccaucccuuuauccugcuaccuaccguuccugugagcaauugugagagguuccuuuucuuccugauucaaggauuuugacaggggcuuuuccaguuuccaagcagaaagaaaucaagcaacaauuucuacuuguauuuuuccuccauauuauugaaauuaaacucuaguuuccuuaagcagaguggugauuaauaaagugagaucugaacuugacuuuccaguaacccuguaauaaaagcagcccgcucuguucuccgaagugagacauccagucaaggucaaggucucaccugugguugagucuacagcgucucacugcccuguggccugaggaugguucugugcugcugucuuggcugaugcaccauuucuuaugucagaaccugcaauagccugggaagcaugagugaaccuccuggagccaugcuaggaugagggcugucccagcaccuccaccucgugccccuguacuucccagcauagaaucagagcccacauaauaaugaacagugaauauuuucucugacaguagggcaauaucugcccacccucuugucagccuccuuucugcugaagcauaugauaguucuuuaauaagccuucacaaugaacagcuaacuuauguacaguaaagaggaaaaugaucauuggaaugacuauguuuuguuuacccauuuuauuuuauaacucauuaacauucauucagucauucaacaagcacuuauagagcacccguuauucaucugcuauucucugggcugugggaauucaacagugagcaagaugcgaacuguacccuuuagaagcucauaguccaaugggaggaaaugcacauacaugcaugaaaguaaaaaguauuacuggaaccaugagacagaacccccuaaguuccccuuacagaagaagugugauugauugauaaaggaagaaagcaccccaggcagagggggacauauaugcaaagguaugcaaagcaucaggugcucgauguuugagagaaauuggguagaagagugauuaaguggugcagguuccaacccucaucaguaaaguggagauaauucucauuuucaagguuuguugugagaaucaaauaauguaauaauguuaaauaccuagcauugcaccugggcuagcauauguucugugccucucaaaccagacaagaaagguuacuguuacuaaacuguaccaugaagucagacucagcaaacagauuucuauucaucaguuaggacaaaagacuuuuacauaaauuuaaccuucagauguaacagucuaguugagugcaauauauuaauuacugaucaauuuccuuaugguaccuaagucugauuuuuuuagaguuugauuuuuguugauauuuuaguugcuaucccuauugucuacacggugucuucgaaucugaagaaguaaauuaggucauucugguaagauuuacucuuccguuuuuuuuauugccauacagcauuuuauaauguucuauaugauuauagagugcuugauaauuuguucuuguaacuccucacauagcaaguuacucagccugaucuauaauuuccaggaugaaugaauguuuguucaccuuaaaagagagagagagagagagagaaugaacaaaugaacgaacgaacacagccuguuuucauuuuuagggcuuuuggucuuuugaaagaauuuuuuuuuuaaauaauggcuuagcuucucugcaguaccauucaagauguaucuccaggaaaagagugacagaugacaugaugcuaccauguaaccauggguuguaucucaaagggaagaauugguguuccucaugucaaauaugaaaacucuguacacuucucucuagcuuaaaaaugcuuuaguagauaauggauucccaauuuagucacaauaauggaaagaaauaaaaagaugcguaagauuucaucaucacuggccaucagagaaaugcaaaucaaagccacaaugagauaccaucucacaccaguuagaauggcgaucauuaaaaagucaggaaacaacaggugcuggagaggauguggagaaauaggaacacuuuuacacuguuggugggaccguaaacuaguucaaccauuguggaagacagcgugcuauuccucaaggaucuagaacuagaaauacauuugacccagccaucccauuacuggguacaugcccaaaggauuauaaaucaugcugcuauaaagacacaugcacauguauguuuauugcagcacuguucacaauagcaaagaccuggaaccaacccaaauguccaucaaugauagacuggauuaagaaaauguggcacauauacaccauggaauacuaugcagucauaaaaaaggaugaguucauguccuuuguagggacguggaugaagcuggaaaccaucauucucagcaaacuaucacaaggacaaaaaaccaaauacugcauguucucacucauaggugggaacugaacaaugagaacacuuggacacaggaaggggaacaucacacacugggaccugucauggggcagggggaggggggagggauaguauuaggagauauaccuaauguaaaugaugaguuaaugggugcagcacacaaacauggcacaugcauaccuauguaacaaaccugcacguugugcacaugcacccuagaaccuaaaguauaauauauaaauaaauaaauaaauaaauaaaacgaugcguacuauaaaaucaaaccauuuuuucuucuuacuggucuuugcaguaaauucucaagcuaaaaccaaauaucugugugugugagcacucacccuuucauccaacaaucauuuuugaggaccauuauaugcaaacaguuugcugggcccugaguaaacaaacacaucuuucuauauucaacuaacauuagaguaggaauucccucucaaugauuauuuuugcagaauauuuaauuguguaaccauuuuuagguuggaacuauguaucagcuguuuguauuccuuaguaaaugcgcauugagagucaaaaguaaaucagucuaggauuaagaauuuuuuauagguaauuuaaaagauuuuuaaucgcauuuucuguaucaugcacaaaagagguaucaaggaguuaaggccgcugcuaaaucuaucuuggaaauuuacauuuugcucuucuuuuuaaacuuuuuccucuucugacuacaguuuuacuuauaaauugucucuucuaucaagugucaugcuagucucaguguguuguauuuguugcugaugaugguguugaguccaaguccugcuuccuuguguugccacagaccuuaaauuucgaauuucuacacccauaaucccagcacuuugggaggccaaggcuggcggaucaccugagcucaggaguucgagaccauccugggcaacauggugaaaccccaucucuacuaaaaaaaaguagcugagcaugguggcacacaacuauagucccagcuacucgggaggcugaggcaugagaauugcuugagcccagggggcggagguugcagugagccaagaucaugccacugcacuccagcuugggcgauacagcgagacuccgucucaaaacaaaaaaaaauuuuggaauuucuaaauucacaaacagguuaaaagcaucugacauuuacucuagaaucacaagcccacucaccuucuuuugucucugcagauuuccaaucuuugccuuccuguuuauauuagauauaaucauaaagucauuuuguauuuuacuuuuguaauuaaaaucuaucuagcguauauuuauaguuuuguuuguuuguuuguuugagacggagucucgcucugucacccagccuggggugcagcggcacgaucucggcucacugcaagcuccgccucccggguucacgccauucuccugccucagccuccugaguagcugggacuacaggcgcccgcaaccacgcccggcuaauuuuuuuguauuuuuaguagagacaggguuucaccguguuagccaggauggucucgauuuccugaccucgugauccacccgccucggccucccaaagugcugggacuacaggcgugagucuccgcacccgggcauuuauaguuucuuaucauuaaguacuguauauuaaaccuaucuaaauuuguuucaguacucgaagauauugcuuuucccucgauuuuugcacaguuucauuauuugauguguaagauguuggagauuugaccaagugaccccaggcuacuguguuaguggccgaaacauugucauaacauucacgugcaaaaaaaaaucagauccauuaaguuuuaaauuguuuaguuucuaauauuacaagcuguuccuauauaucaaguuaguugauucauuucaaaauaagcagucccucuuuguaauuuuuacgucauucauauuucuuauuuucaaggacuaacuacauuaaaauauauaagauagaaaaaguaauacuuuaauauuaugaaauuaauucaauuuucaaauauauuucaagcaccaacaaugcacagugcuagacaaugaaagaaaauguaauaaacaaagaauacauuauacauauccuaaggaguuuacaaucuauuggaauuuacagaaagauaaaaagauguuucacacagggcagggaucaacuugugcugggugccuaggaguccaaaggaagagcgaagauuugguguaugcauggcaugcacacacgugcacaugcauguuuauaugaauauuuuaacuccuacacauaguguuuuuacaggguucagaacacaugauauugaaauaaguuacaauaggaaaucuuuuuuuuuguuuguuuguuuuuuugagacagagucucgcucuguggcccaugcuggagugcaguggcgcgaucucagcucacugcaagcucugccucccagguucacgccauucuccugccucagccucccgagcagcugggacuacaggcgcccgccaccaugcccggcuuauuuuuucuauuuuuuaguagagacgggguuucaccauguuagccaggauggucucgaucuccugaccucgugauccacccaccucggccucccaaagugcugggauuacaggcgugagccaccgcaccuggccuacaauaagaaaucuugacccaucaucuaaaauucucuucacaaaauucacauuuuaagauacuguucaaagcuucauaacaugauauuauaaugguauucaccuuuauauacauccauaaucaacauuuuaaucuugcugaugcucacauuaaucaccuuuuaaaauuuuuuuucuaagcauaaugucaauuccagagaaaguuuauuuuauagaaacaucuugccacacacaugaucugucguaugcacuuugggauuaauuaugaauucacgggugcaugaaaauucaaauacagucaaaugagauaccaccuucgacccaugcaauuuuaaguaauugcuuauucccaauuacuauauuuuauuugggagacuuauucaauaaaguggcucguuacaauaauuacacuacaacuuucuagcagaaaugacauucaucaagccauauucauuggaccgugguuuugugucuuauggucauauguuuuuauaaccacuuucccauuuauuauuaaccuguuaauauuuguaaagugagaaaagaaaaauggagccacucaaacuuuuucccaguuagaaacagaaauguauuguuaacauuguaaaucaaaaaagcuauugaauauuuauaauacuuguggugugcuuugucaaauaaauauugauggcuucauucugaaggugguuucuagggucaagcuaugguucuuuaggucuaagcauugccgcauccuaaaggaaucuauauucaagauaggucugugguuacuucugggugauugaauuaaucaaauuaauauucugauugauugagaguuuugauggaucccagauuuuaaggaaucaguaaguguaaaauauaaaaacuaugaucauacuagcuuuaaugaguuaggaaauguauugaucucuuucagugcuucagagucauuauucugaaaaucaauuaugcauauguagaacaaacaaaaaguugguuaguuucgauuuugcauuaggaugugagaauagcaagaguuuauaauauguguaaacaaaauauuucaagucaagcagauaauauuuuguuaugauauaguuuagaaaaugcuuuuuuauacuaagccuagugacauuuuacauagacauaaugcagugaaaagauuugaacacugaagcugcaugauccagaguucuaguaauaauuuugcaauuuauuaucugagugaacuuagacaacuuaauuuuuaugagccuuagaucuuuaaucuggaaaaaagagauaauaauaccuuaccuaccuaugaggauuaguuugaagauuaaguuuaaaauauguauauaucaccucagcacagaucaaggagccaagaaauacagauguagaaguuauaaaauguacauuuuuaaaugugcaaugggcaucuauaaaauucuucauucaaugacuagagaauaacauucuaauucaagaacacauguaugauuuuaaauguaaccauuuaccacagacuucuaaauauauacacaucaguguccuagaaaagauauuauuugaccaaaauguaacaaaaucagaaaccuaauaagaagaaaauaaccacaaaaaaaccuacacauucagaaauuuaaaacuauuuucaaauaagcacagaagaaacaccaaugaaaauaagaaaauaucuacaauuaaaaaauaaugaacaaaagaugcaucaaacuugugggaaguagcuaauggcauuuuuagaggaaaaaauuuagcccugaaugaauaucuaguaaagaaauaaaggcuuaaauuaauccuccaagcauucauuucaagaauuuagaaaaauuaucaaccaaggaaacacuaagauagcagaaagaaagaaauaauaaagagaaaagcaguuauuaaucaaauggggggaaagaggugauaaauaauaucaacauaauugaaauuuuguucuuuggaagcaguaauaaaauugauaaaucuacuuuaaaauucaacaagaaaaaauuaaggagccuucuucuauaaagaugacagaggcauugacauuguuuuuuaaccuugaauucccacaugaaaacaaaaagaauaccaagauaucaaaaccccaaauccauaguuaauauuuaccauaaaacucgguaauccacaaacccuaaauaaaagcaaguguugacaaacagccacaugauuugcaugauauuagugucugugggaggaaaccaagcuuaguuacagagcguccaauguucauggaaugguagaacaucuucuuugcuccauucugaaauaaaaaguccaggaguggaaucaaaauugaacaggccaggaacaagagugauaaggauaaaagcagauccagacaaaauuuguggggggaggaggauugggaaacagagcuuggaaauuccagaaagaaagcuaccauauuugaucgauauauuaaaacaacagaagaggaaacucugaaguuagaagagaaauacuaaacuguuugggaaaacuaauuuuguauaaaaaugaguaaggaaaauuaucaaagccaaauucccugcaaacguuauuauaagaaaaaaacagcagaauacugucucucacuguagacaaggaaagcaaccuacaaaaacgugcucuaaccagcucaaacuguagcauacuauugaaaaauuaguuaaaagacauuaaaaauuacauaaggaugaaauagcaacauaaauaaaaguuagaaaaacucagaaaugaggugccagaacugagaaaaguuauaaauuaaagcaaugaaaacuaaacgagaaggaacauaaagagaccucagaugauucaaaagugagaaauagaaaauggagaagagggcauuuuuuaaaaucaaagagaaaugaagaaagagaugaaaaugauuugcaagaaaaaugacaaauugaagaaagucaaaaauccgacaucugcauuauaggugucccuaaggaagaaaaaccacagcaagagaauaaaacguauacuaaacuuuucugaaacauaaaaagauaugaaacuauauauugacagcacacaccuaaaaauauuggaguaaaugauuaaaaacaauacauacaccagacaaaugacaggucuuuaaauuuuuuaaaaauauauuaucuagcccaaauaagaacaagugauuuauaaaggaaagaacguuagauuaucaugagauuuuucagcagcaaugcuuuaugucagaagaaaauagaguaacauauauaggaugcccaggcaaagaauaucugagccagauuuuuuuccauccugaaaacugacuuucaacuuucaaggucagagaaacugcuuucaagaucuaagaauaugaguaauguaagauacaaguaaucuuguuucaaugaaccuguaaucuacuaaaaaacaugccucagauaaccuaaaugaacuccaaaagggacucuuaaaccauuuggcauaaaaauucacauucauauguaacaacuaacuacauaaggacaacaugaagagugaaauauguaauaauuauuuguucuaauauggauagaguacagauauacaaaugaggaggugaacgggaagaagauaugcaaacccuuaagauauucaguaguuuucuugguuguguauuuucauucugagacuauugucuaugaaaugugaaauaaaacugagucacuguugagacaaucuaauucuggcaucccuggugcucuugauaaucaagagugcucuuuguggagaaaaaaggagauauagauaucauauagaaaagcuuagguaaaaauaaaaauccuaaagaaaacguggcacguauacaccauggaauacuaugcagccauauaaaagaaugagcucauguccuuugcagggacacggaugaagcuggaaaccaucauucucagcaaacuaacacaggaacagaaaaccaaacacagcauguucucagucauaaguaggaauugaacaaugagaacauaugggcacagggaggggaacaucacacacugggugcuaucgggguggggggcaaggggagggauagcauuaggagaaauaccuaauguagaugacggguugaugggugcagccaaccacugugggacaugcauaccuacguaacaaaccugcacguucugcucauguaccccagaacuuaaaguauaacuaaaaaaaaaaaaaaaaaauccugggucaugaauuuaaauugaaaacaucagaauaaacccaggcaaaauauuugaaacagugaccaacuccauagcagugagcaucuaugggcucuagauauguucuugaaacaccauuuuuccaauuuuccaauaaguaaaccagggcuucuugaagaaaaugguugauuuugaauaggaaguguacaagcugaccuuggagcaucuugucauacuaggaacaaggaagcuuugucaaagacuacgagggucauauaaaaagaaccuacagacugaccaacuugaaaaacucccaaugagcacaguagagauaauuugacuaacaguaagaaaugguaauugacauggacugaaauccauuaaacauuaaauaaguuuaaaucuugaguucauaaugacauuuuuuaaauaguaauugguuaccuugagcgaugauagaaaaucaaccauguaaaauuaauaaguaaaagucgauaaucaagcauuuaucuuggcuuuuccauaccaguuuugcuacuggguaaccaaauaauacaggagggaaagcaccucauuauaaaacuaucccaacuaauaaaugaaaaagaaaugacaguuuugcaaacggaaugaagucaagggaucuaagaaaugaacaucaagacccguaacaucacaaaaagaaacacacacacucuguuccuuucgauggaagaaucugacaccaccuauggccuugccaaagggaugaaaccagagucuguaugaugaaaccucuggauccagcugccgauuuucagaaaauagaagacagaagaacguguugaacuguaccaagagugugcuuucagcaaaauccagacucucucuuggcugggugcgguggcuuacuccuacaaucccagcauauugggaggccacggcaggaggaucacuugagcccaggcauuucaagaccagccugugcaacaugaagaaaccccaucucuuaaaaaaaaaaaaauguuacuuagcuauaugugauggcacacgccuguagucccagcuacucagaaggcugagacaggaggaucgauucagcccaggaggucaagacugcagugagucaugauaauuccacugcaugcacuccagccugggugacagaacgaaacccugucaaaaaaagaaaaaaaaaaauccagacucaaaaacuauaggucaaauggcccagguuucucuauuuuaaggggaaaaaaggguaacauguagauuaauuagaagacaucgccaaaaaaucagcaagauucauacauuggaaugucuuucagguccaaauuauucaaucacaaauaacucuaugggaauugaguugaagcuuuugaauuauguguuaaaguauguaauucuggaaacguguuuuaacuuagaaguucaagacuuaaaauaucucuauauuguugauaauuuaaauuuaauuuacuuguuuugaguuauuaauucugucaaagaauuguuaucugaggcaguuggauguuuucaguuuccaaacaaaaccgaagaaaaucuucuucaacgaaucuuugacuuuuuucaaaguaaacuccuuguaauuccaucauucauccccuuccuuuuuauucccacaucucugauauguuuacauccagaaugagcaauuacuggcuccuuucauagcuguaauuuacaauuucagaucugaaauuacucaucaugaaauggaucucuguauucuuuguuuugcuaauuauuucaggugauugucaguaucuucuagagccagaagagggcacugcagagcaguguagcucugagcucuuuauguuuagcacagucuaggaaugcccuuugccaaaaaaaauucgcaaagcuuuacuauagaaguaagaaaaaagaagggaauaacuagauaaucacuauaggccuucuuuauuuaguagaaaaaagaaaguauauaacgaucuaaauacauaucuaggacaucaaauguaauaucauauauauauguauaaguagaugaaagaagacauauauaugugugugugaguccuuuccuucuuuuaagaacaucccaaaggccagguguggaggcucacaccuguaaucccagcacuuugggaggccaaggucgguggaucacuugaggucaggaguuugaggccagccuggccaacauggugaaaccucgucucuacuaaaaauacaaaaauuagccggugugguagugcaugccuguaaucccagcuacuagggaggcugaggcaggaguauugcuugaacccagggggcggagguugcagugagccgggaucacaccacugcccuccaaccugggcaacagagugagacucuuucucaaaaaacaaaacaaaacaaaagaacaucccaaagcuaaaucugauguuuuucuauuauaauauugauucuccugcuaccucuggcauuaguuauaaaaacaguucucaaguacucuccuguaugaauuaauacuguauuuugucuuaguucaaauucaggacaaaggccauucaguagccuuuuagcaaucuugugcagggcagaaaucauuuaggcaauaguguaccagauauuaucccaaaaguuuuuccuaacgugaaauugcaggggcaguagauaagugauuggauucagacucucaucuuccacugaaggaaagacaacuaacacaugucauuguccuuucaagaugaaauaagaguuguggaaucuggaguccucucuuaaaacucacugucacaggaccucugugccugggucugucucaggacuauguguguucuuaggugucuaaagagcagaugcuccacgaugauggggccaccagcugagucuuccaucuccaaaagcggcuccaagcagcuuuccuuaggagcugagcugucaacucaagagagguuaaauccaugucaaaagucaacuuuuggccgggugugguggcucaugccuguaaucucagcacuuugggaggcugaggcagguggaucacaaggucaggaguucaagaccagccuggccaauauggugaaaccccaucucuacuaaaaauacaaaaaucagucgggcaugguggcgggcaccuguagucccagcuacucggguggcugaggcaggagaaucgcuugaacccaggagguggaaguugcggugagcugagauuacgccacugcacuccagccuggauggcagagcaagacuaucuuaaaaaaaaaaaaaaaauuaugccaaaagucaacucuuucaggaggggagaaguaggaaaguuucaagauuuaucauuggaaauagcauguaugugcuaccaagaaaauggaaguuccaaauaguugguauccacucuugucuccuuguccauacauuaauuuuucuccuaagaguucuagugaauaaugaaaccaauuccgguuuuucauuuuugagcagaaaaaugaacaaaccaccuuuccucaugagggggaaaucaccaguauguucagugaugcugaucuuuacuacauaucugcuguaaaauaugaaaaguggauugcuaguuuugauguuaucuagguuaucauuugugacuaaaaagaccuguuuguuacucugguucuucuccacuauggcuuuauggacacacugacugacauuauagcauuuguucauagcuuuguuuguagaauggggugcugugaguuuguaccucaacauaccuaacccuuguugaaaagaaacuaacuaggugaucuauuuuuacugaauacagaguuuucugucuucugaggguuuucuuuccccccucaacuuuguuugacacacaguaugcccuguagggcuucuugccugguuucaagaucuggcuagcacagcacuuauacagguaguuuguaccaaauuaacuugcccugugcacacauguccacuucaguccuucacccaguaccgccuuugccucuaggaaucuuagccuuccuucaaggcccaguauaaccuccacuuuuucauugaagccuuugccgacuaguccagacuugcuguuccaccgcagagagcuccagccccucugaucuuguguuuucuccuuuacguaucaucuagcacugugccaucuacugcacuguacuugucacugaugaucucauguguccuacccuugucuuccuaucuaggcuauucacuucuagaaaccaagaacuccaaauucuauuuacccuaaaucuccuauggucacuaauaucaugcuaagugcucaguaaaucuaaucuauugaucaaaaugaacaggucucaauuacuaucuucagucugacuacuggaguuacacuuuccuguuauuuauuauuuauucuaguuauuuauuauugugaaucuaguuauuuauuuauuauuaugagaacauaguggcccauuugccuguuuucucuuugcccuucuucugccugcuuuaacuccuuguacaccuuccaccaaucuaaaaucugcaacuagcaagccacacagaacugagcuuggggaguauaucuuugaauuuacagucagcauccaggaugguuuucuccuuaguucucuucucuggaguaauuuuaucaucgccaacuaggaagagaucuugaaugcccauuucauucauuccccacaccugcaagcaaaacaacuccuaaacucauuguucagauuaguguuagguuacaggccaagaaccugcagcagacauaauguggauuagagaacauugcgcuaaucaaagacaaauaaggaguccaguaugagggucaacguuaaagucuuuggaaacugaaaauuuuauucagacgaaggccauuaucagagugaggcacagccaaugcaccauccguggcugggacguggggccccacaaguuuguucauggugcugcccaaauaaaaguaaaaauagacaagaauugucaauuguacgaugaugcuuuagcgaaacauauucauguuucauguuuuaacaaugucaucuauugaaugauuugacaguauauuauuucuuaacauuccaaaacuaaaagucauacucuuaucauuuucagcuucgcaagucuguuuucagcaucagggcaaggaaccuucuggaaaaggagaccgcagucacuaaaaucuuaagguaacaccaauuaauguugacacauauuuaaacacaagugggauuauauuaaucgaaaaauagcuuuuugaaaaaugaauuaauguucugggcaucagcauauacuuucugccagaaaguagcuuugaguaucuauguacuuauaaacaauguaaaagacauauugaugucauuucuaaaaaaaaauuuuaguagcucaguaggccuuucuuucaaguauuuaaacauaaaugauaaguauaaacauugaccaaaaggugaaaauaacuuacuguuauuuuuaacaguuuuauaucuuuugugauauguaaaggagaaauugcaaucuaaaggauaaaugguaaaaggguaaacuuuuucauuauaguucauuacacuauuaagagcacauuuauuaaaaauccggaaauaauaaaaaguauaccaaucuuagaaugccuaugaaaacauaugcuuuuaaugcuacuuucuagaagaugcgcugaaaugaaguaucaaggaggaaaacuaagcaaccgacuugaguguuuuauaagacuauauguuauauuauggaguaacaugaugaguauaaaaacacauaggcauuuagaauaucauuuauugguacauauauuacauagacauauguagaugacacaacucaagauugggagcuggagguaggaucgcucgcaaggcgaguggacagauucaugccaggaagcccccugcaaaccugcggugagugauaaggaguucuagcucccuucuacuagauuuauuacuaggaauagacauuaaugcauucucuccagaaugcauauuacuauaacuuggaagacugugugagaaaauaaagcuuaguauauaugaucuuuaaaacuauucuuacuuuauaauacuaccuaaaauuugugugcaaaaaaaauuuccuaacucaucaagacaguauuucucucaauauuggcugacguucaugcauagaguuaaguauguguuggaguagcugucauaggaugaaaauaagcauuucuagggcuuguauauuaucaccacaaaaugugaugagauaaacagacaaggucucauugaaauagacaaccugcgccccaacuuaggcuuacucccgacuggcugguaacuccauccugguauuaccaucagaucaugcagugaggcuggccuugaaccacacauguuacaucaggaucaugauuccagcugcaccuacaucagacagguucaugguaggguccuacagcaaggcugauccacucacuaaaaagagaaauucacccucaagccagaaacuaccuacaaggacaucauaauucucagucugcaucgaguaucugccugccaagucaggaacuacagggaccuuacucaccuguccagagccacugccuugcagugugaaugggcccucugugugaauggguucccagagacuuuccaaggcagaugcagaaacagauacuggcaaggaagagauuuccagaccucacuucccuaggaacucuuccuuaaaacugaucuaucacuuuaccuuuuucacccuccuguccuuauuuaccccucucucaguuuacaaaagaaaggugaaacucucacucauccggaaacuauggcguguauuaaucugggauguaaaauccucuggguugccaagcaaaaggaccguucccaccuggauuucuccaaaaagagggucccauggggccgugccuuauuauuuauccaggugacaguuuuauggauaacuuccuucccaaagcuauccaccuuagauuaggccuuagaaauaacaugauugucacaagggcaugugguuacauguuauuugaauugaaaaauaaagccagacuuuuucugacagauucagcugauugguucaacaaugaaaacugauuuaauaagugcccaaugucauaaaauugaauagauuggauggcgaagagucuccaauauuuucuuaaaauuauuuucaagcacaaacacaauaaugcuagaaauuacauucuucuauuuaacguggugcaagagggauauaguugcugauuuuuaaauauacagaaguguuuuuguuuuuucaauuauauaauguacaugagcaauauuuuuaagacuaucagggaauauagacaccucuaacuugccuaacaaugguguaguuuaggggauacccacagccaauaaauaauauuuuacugcagcccagcauacuacagaaugagaggcagcaccuuaaaacuaccugagcuauaucaccuuuugaaacucaggaaauaaaaagccauaauuugaaaaaauaaaaaaccuuagaauuuuuuaaaauacaaauuugaucuuagaaagccauuuuguuuuuucuucugugcgaaugguuucuucauugcuucuaugcuaguuucugcaugaauuaagggcaagugcaaaaaaucaaacugauauuuugggaauacuuaucuuuucaccacuaaucguaguaauaguaauggcaaugauaccauaccugcauuauaaugugauccaucaguuaaaaagucaagaauagauuggguccaugucaaugaguguuuguauuguuuuauacuguuuuucaaggaacaauaacagcuaaaaggaaaaaaagagggagaaaaagaauuuuuuuuaaaaaaaaaaaaaaggaaaacauuugcaguaaccucaggacaauugauucgaauaaccuuccacaaaauugggaaggagaaaaagcucuccaccacuuuuucagugucuuuuuacugccucuagggacuccgcucuccuaggcuccaaccuugcugucgauuaaacucugccaagguuccuggauaacuuagcaguggggucucccaggaccauuugcauuuugaaagaaggcuuuuaaaaaaugaaagggcuuuuaagacaaagaggaugcagauucugucuuuuaauagaugggucuaucuugauauaaauaaaagaaaucuggaagagacugccguuuuaguguucuauuccucuuaacuuucuagguguuuuuaauuucauagaauuauugucuuuagucuuauccaagagguuccucgccagggagguaaguaacagcaguauagggaggcuugaaaaagagaccugagcuggaucauuccggcaaauaucacagguuggcauucguccuaauuugugugcagauagagauaaaucacaaaaaccuuaaauccagagugauauaagaauaggaaguuuuuaugaaauauuagcgucuugagauaacuuuccaaaaaauaacaaguauuugggaaaaaauaaagcaaccccuugacuuaagguuucuggaggccuggcuguguaaacagacaauuaauuucaauucucagcucucuugucuauuccaugggagcuaggaggaggcgaucuucagggccccugaagaucuaauguaggauacuggacuugguguuaaauccccccuggcugggaucaggcucugcuucucuguaacauugaacaccucacuaaucugacccucaguuuucuuaucuaccuuaaaaagauugucugaauaaucuauugaccaagcaaaauuuaauacuuauuccaguaagggaaacugccacuuuguuuucauaaugucucagaagggauaagugagagguggauauauguaagguuuuggguuuggguuucaguguuuguaggauggaggucuguuuagacugggcagaauucuugauaugaguugaggaguauugaagaugccugguauggacaaguaauaguuacuguucugaagacggcagugcugugguugaggaccagaaagagaaagcgaccugccuggugccucuccacugcuuuccauguucuuucccccggcuuugguucaacauuugaguaauccauucuuuacagcgaguuugcccuucuauuuucauucuccuucuugacuugggugaucuaagagaagaaaaauaaauggugaccuuauguuguccucuucacacaugaaauuuauuuuuucuuuugugccuuucagauuuuuaaccagacacauguauuaccuuuaacaaacaaauacaacugacuuuuauagugguuuuuuuuuuuuuuuaaguuuggcauugauccccauuggguagagucuucacaaaaaauccuaaugaauaccaacuauuuguaggugacuagcuugaccaguugagugaccuacugucuggagaaagggguuggcccagcagucuauaguucagauaaaugaauuugugggaagugccugaaaucaacggugaaguugcugacuguuuaacagcuuuaccuuccuggacaagucaagucauauugacgcagaggcucagcucucagcccuggaaauuaagcuggagagcugccaggggucuuaguucucaggggggacccacauuuccaaauauccaucuuccauuugaaacaggauccacauuauucuagcagaaaguauguuauauacauuacuaugaacaggaaauuccagcccacagaggaagaagucuuucagagaggaagggcccuagagccugagguauguaacucacagguagaaucacccauuucuauguauaaucaucuuuaauucauguucuuguacuuuugaaaauuaauugauguuuugagaaauauaaaugaauuuuuugauauauuugagaacucuuugaugagaaaaaaaaaagugggccauuuuuacagaacuugaggcuacuggcccaugcuaaaaugcagaugauucacuuggcacaaacaggcaucugaguuguuguuuuuuaagaguuauccgaagaggauguuccacuaccugaauuauaaaauccaggauugcuauuaaauuuauuguuguucugacuuagacuguaucguucagcuccacuaaauaaagcuucuuuucaaaaggcagugaccuuuucucucaucaggcgaaauaaaaaacaaauagcaauguacuuucaaaagcaucacuaccuuuguugagauuuccucuaauucaaagcccugaaaucgagcaaaaaaugcauuaucguuccugcaaggcugaaugaauagagaaauguuaaaauaaaacaauuaaacauuuuacauuaguuuagaaaguuccauccuugugugguuugccaugaguaccuccuuagugaggacaauauauuuauaaccuuucgaaugcucagucucguaugauguuugcauucugacauuugguuuuauaacguaacuuucuuugccaugcacuuauauuaauaacuguuuaagucuuaaggaauagucuuuaguuuagugcuacuuacuacagaaaaaaauuaaacggauuuaauaaaauacauagagauaguuuuucucuuaucauuuuaaaagaaucauuuaaugacuauaaauacaacuuauauacuacuuacauauauauauaaucacuauguauuuauuaaucugcaauuauguaaaugacauuagcuggauuuuuuuuccugaaagaaagugccccuaagaauucacgcauucauucgagaaauaucucuguagugucucacaugccaggcauuucacaccauuugcuuuuucccauuuggaaaguucuccuuuuauaauuauuguuccauagguuagccagcuauucagcaacuuuggauaaggucauauuauuucucugcagcuccgcauucugggcagaacuagcaagacacccuguacacugcugggagggccugaguaccuuacagcguccccuggaccuuugagcucagcuccucaguggaaagggaaggugcuggacugacccuacagaugagagaaagaaacgacagagacccuugcagccuaggguuugugccaaccccugagauagcagcaauuuuuuucuuagcauuugguaugaauaaccccaaguuuuaagaaaauagaguaugagaaugaaugucauaaauauuuaucuuugcaauucuaugaagucugccugguuauuguuggcuuuuucuuaagauuuuccugacacuuaaaaacucugauaaguuaguugaaagacuauuuggaaauaagcuaaguagauagaugaaaauuaacuguauucagacaaccauaaacuaaggagacaagauguguagauauauguuuuugcauaaaacauaaaauaguaaagauuuaaaaguggcaaaauauaacuaaaacaaaaauaauauauucuaaucacauuuuuagauaguaccugauuugcgguaaucaaaauauguuauauuuuauugagauagcauaugauuuauagauuguuuuuaguuaagcccaaaagugauuauaauaguguuauggauuagaagggcuacuauugaguuuuaccaaacagaugugggaaguuuuuuuuaauagacuauuuuuugagcaguuuuagguuugcggcaaaauggagcaaagguacagagauuucccauguaccuucugcccccacacaggcacagucuccccaacuaucaacauccccaucagagugguacauuuguuacaauugaugaaccuacacugacacaucacuaucacgccaagucuguagcugacacuaggguucacuccuagaguacuauagucuauggguuugaacaaauaugugaugauguguaucuaucauuauaacaucauacagaguaauuugagugcucuaaaaauccucugugcuccaccuauucauuccucccuccccacaaacccuggcaaccaaugaucuuuuuacuguuuccacagacauagaaaugcacauagaaauacauagauaugugucuccauagacaugcauugauguugauggcagcuuuauuccuaauugccaaaacuuggaagcaaccaagauguccuucaguaggagaauggauaagcaaacugugguacauccagacaguggaauaauuauucagcauggaaaggaaauuagauaucaucauggaaagacaugguguaaacauaaaugccuguuacugaguaaaagaagucagucugaaaagucuacauacuguaugauucuaacuauauggcauucugggaaagauagaaccauggagauggaaagauaucuuaacaaggucuuucuuuuguuauuuugucacuggagaguaaaguaguaaagaaaaauggaauacauaucuguugaaaauuggccaaugcaguuccugcagcauuuacaaaauuucacuuuuauuguaguaaaaaguucagccuuugcauuguaauuugcauguuucggagucaguaguuggguuacuaaauuugaagcccagugaaugaugcgggguugcagacauuuuuuaugcugaaauuuaauagaugcacgaaaggcauggauuucucaugaguuaauuuuucuuuuuuguuuauaguauggguauaagugcguaagauaaagacauucaagguuuauuuuauuuucugccuacaaugaaguucuggucgcccauguauuuacaugccuuucuaugaaaacauuuuuaugaauaacacaagauugggaagaacuaacuggcaguugcuaugaaagagccagauccauuuacucaggauagggcugacucacaaaggagugggguauccacuaggauaaaaaugcagcuuuuuccucaucucagcaagaggccauuaccgacgagcucacccauuagcauccgcuguugucucuacuugggaagaucacauugucacucuaguggagucagguaagagccauuuccaggaaauacucauuaucuauucucuuaguuauacagucauaguuuuacauaauuaccacugaaagacuauuuuccuguugucugcuaaugugauuacauuacauuaaccaaccuuggauaauacuuuuaaaugaauuacuuguggaguucaagauuugagcaaaaucccucaaauguaaugcucugcaaaguuauacugcaguuccuuuagaugguaauuacguuuaauaccagacgguauuguguaaucuaacuuuucuauaaugagugaaaauaauuugaagacucauaggccucucccuuucauuacagaauguauaggcuuuuuccacacccuuguucugggacauuaagaaagaagacauggagacaaagaagaaaagaaccggggacccccugcuacugugucuauaaacaacuagugguguuuaaaggcuaauaaagcuccaaagaucucucuuauaaccauaaucuuugggccaauuuuaaaauauuuuagauggagaaaugucaagaaaaauagagacaauuucaagacaugauucucuuuccccaacguccauaaaagauuauauauauauauauauauauggcugucauauaaggagcaauugaaauuccacagcacaaaggcaaugcagggggaaaaaaaaggaucaaucuuucauauuauuuuuucucaaaggcuuggcaagaaaccagggguaauauuuuugcaacugggaauguguguuugcugaagaauauucccacauuugaaucauccucagggguccucaucuuguuuuacuuucaaagguagagagggcauaacauuaaccccaacugggaaaaggaaaaugccucacuguaauucuccuccagggaacaggaauaaagggauuacauaugccugcauaaugaagaauuuccucacccagacaagacaaaagacuucauuauuuuucaccagacacuugaagucuugugccucccaguugcagaagcugaggaggcaggccaguuuuuuauaugaagccacuagauggaguuccuaagaaacuggccuucuaguacuugccauugugaaaagaucuagggaagauguuaaaaaccuugguaccugacacuacccagucuuuccucuaagaaaagugagacugucccugaagaucacaguauucuuccaguaaaauuagccuugccuuuacucugggaagcaaauaaaugagcauuuucuuucugaaaaugcaccuccuuuguccuuacaugagaccaaaaggcaucucaauacuaaugaaaaauguaaaguggcaaaauauaacaaaauggaauauucaaguucuucuccuucuggguaggucuguuacuucguaacuuuaaggauguaugcaucucauuucuuauauaaaauauuggaagucucaaauuuuguaguuacucacuauuucggcuugcaaguauuagauuccuguaagaggagguauauggagacuauguucccagcaacagaucugaucuccaguuaaagaaauugaacuaaguucaccugcuacagccugcucugcucccucuuggcuuucaggcuucccuaauagcuuucacauacaacauagagaaagauguaugaaguuuuuagucguaagaagcaaugucuuuuuuuuuucauuacugucucuucuaguguagguaugcagcccauuauucuugaguggcaucauauucuaacuugagauaaaauuaagauuauuuaacuugccccuuuaaaaguauauuuuaaacacaugcuguuuuguccgugauuauuuucaugcuucaaaagcagggagugaucagaaaagaaaauauuugaucuucacggaauuucaagguucauucauuccacaaauauuuauugagcaccuacuguggauaagagcugagaaauaaucaugaccaauuuuaaagaaaacccuacucucuuagagcucuuuggagcauggcauaugugacgaacuaaaagaacaaagaaaauggcauggagagaacgagguuccuccugguaaagaugagaccagaaagggagguuagagggacacuaaacggggcugugcaagccaugcugcucguuaggcuuagucuuuuuaaggcagugauaauaaccgcauucgugaucuauugcugcaggacaaauuacuccaaaacuuaagugauuuaaacaacacguuuuucaucucacaguuuuagucaggaaucugggcaucccuuagucaugucucucuccaagcugcaugcauuuggacuugaaugggaagagccccacucaaucgcaugguuguuaguggauucaguuccucgugagcugugauaugaaggccucaguuccauccgguuugcuggauuccuccccaaguggaacucuccguagagcaccucacaauaugcagcuugcuucaccagggcaagcaagcaagaugggaagagcaagucagcgagagagagagagagagagagagagagaaugaauaugcuauguagaguguuauaacauccaccaugacgcgggaaaagauacaacaggaaauaauagcaacuaaaauucaaagaaagcguugauguuuccaaagcacugucacauucauaaucaucuuuacuucuuccagcucccugugaagucagaaggaaaggcauuauuguucucugcauuuuacauaugggaaauggaggcuuagagaaagcacaucaccugucuaaggucccacagcuuauaaaagcugaagucagaagugugugcuuuuaaagcuuauguuuucucaacucaucuucuccauuaggcuuccagacaaaggcagaacuuuccaucagcagcugcacugcagggugcacuucuuugaaccaugagaggcuagcaaguuagggauggggucacacaguccccacgcaccugccgcuacccucccuacucaccccuccccaccuuuucacuuacucauucuguucaucaggcagcaugagggccagaaacugaacuuccuaggaaugggaggcugagugauaaaguggucccuaaucaacucacagccuaguaaggggaauaacuaaugauaacaaaaugccaugagcguuaaacaagcuugguuaauaacauacuguaggaacauggaguauaaaacaagucuuuuuuugugcuuucacauaggugaaauauucauuucucauuucauguuacuuuucagagcccauuuauaucagucugucauuauacugugcauguuaaaacacuauuugguauuuauuucaugguuugccuuacuguauaugcuuaucuauaguaacauuguauucccuuuaaaaaauaauaaagcaaacuuuuaccaugcuuuuguaugaaccugggcacauuggauuagaguauauguaaccucuuagcaggucugauuguguccaacugaaguucauagcuuucugccaacacuguuauuuuccaaaauagcaaaauuucuuacaugaccaacaaaugugacaauggcuuaggcuguacaaggcuguuucauuaugcagaaacguccuaucaugggaaucuuucuauaccugucucaauguccaggugagcucuaggccaaagggucauaaaacuuccuucccauugccuugcuccugcauccaccguccaaccucagguuuauaacuuccaucugcgguccuucccucauucaccaggaaccuguguguggccaguggucuccuuguauaauggaauaagauuuuucagaauguucucguuagacauauuuauauaucuguagaaaaguugcuucaugcuguuuaguaaaugaaaaauagugauuauuuaggguuuguuuccaagaauacauuuacauucagugaauuuguaugauuuuucauagauauucaccauaauuaucuucauccacauuaaaaacauuuuuaaggacuuaaauaugacauauuuaguaaguucuuauauaauguauuacuauauaauaaguucuuauaugauguauuauauaaguucuucuguaauauauguguuauauuuaaauacuuaaaaaugcuucuauuauacauguaucauaagagcugcuauuuuaagugcgcuaagcacauacaaaucuuuuucucaaagaucuuaauucucagacagaugguaaucauauucaaagccauucaagaaaugcauuuuaagaaacauaaaugugaaaauaauauguaaaaaauggcagaauuguguguucagguguugagcaaauagaguaucauuagauuugcauaucauaaaaucauugcauuuucaaccugugagcuaucuuucagagcaaggcuuucucuucauuuuaccaaugaggaaguuaggcccaaagaucacucaacuacuucauaacaguguaacuucuggcacacaggucuuuuaaucccuuguguuauuuucuugccacuuaucaacuaucucaagggaauuccugucauucccaguuggagaaaauuuucuggagaauaauuuuuuuuucucaccaaaaucauucacaccacagguguuaggccacccaauugucuucacucauuagcaaaucagaaauuaacacaaguccaguuauuguccaaaaagaacauguuuuuaaaagucuucgugguuuaaacaagugguaacugguuaccaguaagcugcaagcuucagauugagguuucuguagguaauaauuccaaaaacugugugcuuuuuuuuuuuuuuugaacugugguuuuaaaaacaacacauaacauuuaccaucuaaaccauuucuaaguguacaguucagucguguuaaguauguuuacauuguugugcauaauuccagcuuuaguuacuucucuuuaugacucauuuuugcuuguaagcuuauguuuuccuaucuuccuaaaguucuacaaaaucuccuuggaacauauauuuaaucauuccaggagccugaguggacaaauccuucccaaaggggguuuauuagaaaccuuguuuaaauucaaaaccgacaucaugauugccuguguguauuaaucuguuuucaugcugcuaguaaagacauaccugagacugggcaauuuacgaaagaaagagguuuagugaacuuacaguuccacguggcuggagaggccucacaaucauagcagacggugaaaggcacgucuuauauggcagcagacaagagaagagagcuuguacagggaaacuccccuuuuuaaaaccaucagaucuuaugagacuaauucacaaucacgagaaaagcacaagaaagaccugcccccaugauucaauuaccucccaccgggucccucccacgacacaugggaauucaagaugagauuuggguggggacaaagccaaaccauaucacuguggguaggcuggccuucugcuuaugguguccugauagaagcucuaccauuauuuuuggaaaggagggaggaggcagaaggaggaggggcaagaggggagcuuucuguuuauuuuccagcccuucuucauagcugugauacuucugcuuuguaaguguucuugacgcagagcguaaaguucauuuuccuuuauaauuauacguuauuugcuguauuuuguguuuucauugguguugccuuuaaaauaauaaaaguaaugagcacuuauguguuauucaucucaaguguacaaaccaugcauuuaucuugggcuccuuuuuuuuuccuagagcuugcacccgacagcgcaugcugagcggaucauuugaggggcagcccgcaaaggagaggucaauccucagcgugcagcaucauauccgccaagagcgcagguaaauacuugggaagacagggcuucagagacucuaaaaaagggggguuuuacaggaaauggucgcuguacacagucacggcugucagcccuggcugccagacaggcauggcugaggaaucgcguucuauuugcuguuuguuacaauaaugaaacaccuaaucagauccaaagauucaaaaaaaucucuacuucacaauccuuuuccuuagagauggccaaauucucaccuuuaagaucagaaggaaaaauucugaauuuuguuagaugggaucaaagacauuuggagagaguauaagcuucugcuaugaaaagaaaucauaggcauuuguggcguuguagcagaaaaaguguuuuauuuugauuuuaucauggucacugcuugaaaggccaguuugaucuugagauguauuaaccagugccugugguuguuuuaggucacuaagacauggaucaaacagccagaggaucagcaggggaaaaucucuugaaacuuugacucaagauguaaguuuuaagcaaugcuuuggauuucagaaacgugauuaugaaaauguauuuaaaugacugcuuagacaaugcccagugucuuucugcugcauucccaugucuccuuaagacuucauaccagagggaaucaggaaacucaggauaugaauuauguagccaaguaucagaaguaacuguuaacagcagaaaacuccagucaucccacacaaagcacaugucuuaguuaaaauaguaacacaaaagugucauuaucaguuggauuugacuugaaauuaaagacauuuuaagcauuguauauaggauugauuugcaucauugacuuugaauauucacugagaaucgaauauucuagaaucuagaucaagggucuauaauuucagggcuuuauauauuaggaagugaaauuuuauuucuagaagaauuuuccugucaaggacuaccuaguauuucccaggaaagcuuuuugcuuuuagacucuaagucauggauuuauuuacuggcucuauaaauaguuaucaaguguuugcucugugcuggguucuguuuuaaggaacgaggagcagugggguaauaagauagacucagugcccuccuggagcuuaaauuuuagaauaggagacagauaauaaguucauaaaaauauaauggaauuucuggagugauuucuuuuuauuuuccaucaucucuucauuacugugacagauuugcuuuauaauguaaaguaaaaugaagucauguaaauaaaucaaagguggggauuugggggcagggaauuuuagauacgaugguuaucguagacccaucugcauuaucccggagacccaaaugaaaugaaggagacaugaaaaaaaugcagagaagccaagcguuauauggcccagcagcuauaccaugcaaagauuacaaugaaagguuugggaaaugcauauuaaauaaccguaauuaugaagcccugguaaaaagacaggcguuagguugaaucuggaugaacuggcuuaaaaaguaaucuugaauguucagagccaaggauggcacuugagaaaggagggcuagcaagagaaaguuagcaaagccuugggguuauuucguuuuucucuuuuucaccacuuaucucuuauuucuugagcuuuuggagugcuugccuacuacaucugcuuucauucuguagaaacugcuguuuuaguccaaguacaugguuuuuauuaaguguuccgggcaaaaucaagagcgagaaguuggcaaugagaacaccugauaucaccaauacccuauagacaugguucuaguuggcacagagcucuguuuaccaccaugauuuuuaauauccauagcucuaucugauuggcuaccauauuguugacauagaauugccaucaaauccaacauauggccugcgcaacuuagaacugcagagucagccauauugcacggagaacauuuucaggugaaaagucaaagaggcaacccucauucaaagcgccuucaauauguuucaaccgaaauguacaaccuacuuaagaaucaaaucagaacaugucuuugaaaauaauguguuuaaacauagacagcaaaggcccuauuugaauagucucagugccggagcuuacuucuucagagacuuccuacccuauuuuucauguagaaguauaguaaaauccaucucccaccuucuccauagcaaaaugccaugggguucugaucauuuccaauaaauucuuauaaugucuuuucucccacaaaggggagauuuaaauuagagaauuuuaacuuuuucacuuauucugaaugauagcagacacagauaauuaagucuaaggagugcuuucuguaaaaucuacugaguuacuggaacucuggccuugcaccuuccaugggguccaucuaaagggcugugaagggccugcauggccugcucaccucucuuagcuuuacccacacuggcauccuggcuauuccacauguagacacgccaggccugcuccuagcucuggaagaacacauuucuguaguccuaccacagccugcacccucaccuccuucuagucuuuccucaaauagcaccuucauauugaggucuacccugaccuguucauuuaaaaucauaaucuucuagccugucuaugucucucuaugccuuucacccauugugauuuuuuaaaaaaucggaucacuaagcauccucuuacauacuuauuuugaauuauuuuuuaucugucucccacugacuagaacauccuaugagaauaaggauguuuuguuuccacuugccauauccugcacacuagaauagugccuggcacauaauaggauuucaaucaauaugugcugaaugaauuacuuuuuagaggaacaaauacucuugcuaugaagacuguggccauuaaauauguacauuuaaucguauacauauuuuauauacuguaaauuuauauauuuaauguaaguauauacauuuacuuuaaauuacauauuuaauguaaauauauaccuuuaguauaaauauacauaauuauaaauauauacauuucauauagauauauauuuauuguaaauauauacuuaguauaaauauacauauuuaauguaaauauauacauuuaguguaaauauacauauuuguuguaaauauauacauuuaguauaaauauacauuguaaaauauacauuuaauauaaauauauaaauauauguuuaacaguaaauauauguaauuaauauuuauacuuuauauugagggagauauuaguuuuaaguuuuuuaacugauaauauauuuugcauucaaaacccuccuguuuuaacacacccccuguuaauuuauuucuagcauuccaauacagugagauauagaaaugcacaaagagaagacagugaaauaaagaugauucaggaaaaaaaggagcaagcagagaugaaaagguacagguugcugcagugucccauggcucucauucgggaauggcaaaauuucccuuagccucauucucccaugaauuucuccuucaaggaaagugcaagaagaggaacucagagagaaccacccauacuucgauaagccacuguucauugucgggcgagaacacagguucagaaacuuuugccggguggugguccgagcacgcuucaacgcguaaguacacuucauuucagccagguguuuggccugagccaugcaaacagcagggguguugucauaugaagaagaaggaacguguaauccuaauggggucacaaaauaaacugcggacuaauuaaucaugcugcuccucuuugcugaacacccgaccagguggaaaacaaaggucgcaaguaguuaacauuuauagaaaacucgcauugauaaaacacaaaacagccauuuucguuugugcauuuuaacaguuuccugauacacuuauaucggcauuauuaacuccauauuuuauuuuggaaguacugagacaaaaggagacuaaaggacauggugaaaggaaggucauuguccaugucuuccaugaggcuuguaguuccuuugugguaaaaauaccucaauuuguuuuuuggagaauaacguaaaguugauuagugcuuucauuaccaacuguuauaagaaggaaacccacuguucacugucucuacccuaccaacauggaagaaauguguaagaagccguaaguagaguggacauugaagacacuaguuguggacaccuaagccaaguuugacaggcaacaaauggaugaaauggauuuuugucaagcauaccuguaugaguccauuuucaugccacugauaaagacauaccugagacuggguaauuuauaaagaaaaagagauuuauuggauucacaguuccaaguggcuggggaagccuuucaaucaugguggaaggcaaaaggcacaucuuacauggcagcagacaagagagggaagugaaagcagaaaccccucauaaaaucaucagaucucaugagacuuauucaccaccacaagaacaguaugggggaaccgcccccaugauucaauuaucucugacugggucccuccuacaacaugugggaauuaugggagcuaccauucaagaugagauuuggguagggacgcagagccaaacccuaucaguaccuuuaaguaaauauucugaagacauuaagagucauggaggaaaugagaaaacuuuccauguucccauuauguaguuggagugucccugaugccaucguuuaaguaaauugauuucuuuguuauuaauuaguagcauaugauaaucacuaucuguuauggacugaauuguucccccuccacaaaauccauacgguagaguccaaacccucagaaccucagaaugugacuguauuuggaaauaggaauuuuaaacagguuaauuaaaaugagaucauuagggugggcccuaaucuaauaugauugguuuccuuaagagaacauuuggacacagacauauacagagagaagaccuugcgaagacacguagggagaagacggcucuccacaagucaaggagacagcccuggaacaggguuuucccucacagcccucagaaagaaccaacucagcuggcaucuugaucuuggauuuccagccuccaaaacuaugagaaaauaaacuuauguugcuugagccauccagucuuaagcaccagugguacuuuguuacagcagcucgaggaaacuaauacacacuauuauaacauuucagggauggaagagaccucagggaccacucggugucauuugugugcccccuccuucaacagaggaggacauuuaagcgugcagaaguugagggcuuugcucagggacccagcuacuaccuggcucucucuugauugccagacuauuguucuuucugcuguucuauaaagacuuucacaauuuaaagcaacugagucacaauuauuaaaaucuuccaugaguuuucaaaguaaaggaagaaaaugccauuuuggagauugauuugaucaguucuugaaguacguuuuuuuuaucuugaauuauccuguuggcugccuguaccuuaacaucucaugguuaauucuccacuucacuuagugugauguaauuucccuuuuaucagcaaggcagcugauguugaauacaauugaugaagacucuguuguaauuggggacacauacacaaagacuguaagcaaucucauugacagugcucacaggcuuccugaaaguagaaacaacgacucucccuuccaagaaauucuaaauaaaucauucuaccacaucacaguuaaaugcagggggaagaagucuauuuaaauuauggaguauuuaauuaaauaaucuugaauaacuaacauucuugaacuauuaaggcaaagauuucaaaugaguguuuuuaaaugaaagucaaaacuuaauuuuguacuacccaugucagaaaauucugaacaaagucacaaagucuaaaaucaaguauuuugagaaauauaaaacuuuauuuucauaagcaucaacugcaaauucuuuggauuuuuucuuucaucaauguucucugaccuccagaguuaccuacaguuaacauauuuuauaauggacauuguagagaggcuguaaaagagauuuuagguagaugagauguuugcaaauaugauuuuuagcaaguuaaaacaugcuugcuuuguugcagaauuuuauauauguguucucuuacagaucuaaaacagacccugucacaggagcugugaaaaauacaaaguaccaucaacuuuaguaagcaucaccaacuucauuuuccaugcacauuuaaaguuuucauguacuauuuuaugcugcauacaacgauuaaaauucucuuuuauuuucuugcuauauagugcuaugaaauagaugauuggggaaugauguuuuuaaaauaccagucauguugauagagccacagaagccaucaucucuaacucuuagaagccuuuccuggaaccuuuauguuucucaauuuuguuuggucuuuggcagugauuugcugggauuggucacuuaccuggacugggucaugaucaucguaaccaucugcucuugcauuuccaugauguuugaguccccguuucgaagagucaugcaugcaccuacuuugcagguaccgcuuaccgcugcaaaaucucagcuuacaacuaggagguaaaauacugaccugcuguuuuuccguucauuguaaccaaacugccuuuugcccguuucagauugcugaguauguguuugugauauucaugagcauugagcuuaaucugaagauuauggcagauggcuuauuuuucacuccaacugcugucaucagggacuucgguggaguaauggacauauuuauauaucuuguaagucuuugcuuauugccuaaaugaaaaauguaaugguuuuguaaaaucuccugcauuucuugguauaagcgcaagagguaugaguuacagaggcuuagauucccuaaccgaauucuuaaauggacucuagaguaguucauuauaugcaaauaagggccaugcauguaaaaucuaaauuaagagcaucauaaauaucuauggauaguuauauuguucaaauacacuaaucacaauuuuauguaugaaugagacauacauuaauaaggucuaacauggcaaaucuaguuugcaucccacaaaccuuauggcuucuauacuaaaaaaaaaaaguuugccucauauaaaccauguuauugauuaugagccccuuauugcugaaagcaaacuaaagugauugugauuguaucucucuccugauuccauugcauaaaauaccuggcuauagcaguugcccauucaacugucuaguaaaacucgcuggaaaaccauagaaaugggcucagagaauuuuuuauuuuuccuguauguccaaggaggcaugaaaucaaugucuuugcagagacaacaaggagaauugugaucauuaacaaguagcauguugcaggucauuaauaaaauagcaguaaccuugauaaaaggaauuccagccagaucgacaucaguggagccuccagaguaguaaguuaaaagaagaggcagaacgcacugguguacacacacacacacacacgguguggacacccccauuucuuuccugcauacacaugaugacuuuccuuugagguaccuagcaagucuagaugagguuuguuguuuaaaguuaacagauggcacguacaaccagugaguggaaucucugcuaaaugaaaaguuguggccagucggcugucagaaaauguaaauaguaggggaugaauuguauaaauuccagagaucauuuguuccccuuuaggugagcuugauauuucuuuguuggaugccucaaaauguaccugcugaaucgggagcucagcuucuaaugguccuucggugccugagaccucugcgcauauucaaacuggugccccagaugaggaaaguuguucgagaacuuuucagcggcuucaaggaaauuuuuuugguaugugagaauuauccuuugauuccaguucacaguaguccaccucuaaugcagcuaaugagggaaaagugagucuugcuuauugaggucaauucaauaguuuugguuauugccagaggguaauggaggcacuaacaaaacacaaugcaccuucaaacacuuuacucaugggcacuucuggcguaugaguuuauuuaauucaccuaaagagaagcacucugagauuugaaagaguuccuaucugcugacucuuucgguacuaaccucuugacucuaauuccuacucuggguuuuaguuuccucccaucugaaaaugaaggauaagaagauucaacacuguguacuccacaaaugggauuaggaauucaugcuuuugggcuccuaaucucauucuguguguuccugaaauaauauagcacagaauuugucuuuagaucucaggaguguuaacauaaaacaacuuuaaaaaugcaacauauagguauaacccacuucaauuaacuucagcauuacaguaaugagugauuacaaagaugauugagggggcaaaacguacuuucuagcugggcaaacauugauuuagggucuucugaaaacaaggucagagauaaaacaacaagaaagaggcucauuguucacaaucuguuacagaaagaucuuugccuuacaaaacagugaucaaaaguuuuuuuuauuauugaugaggucugcuugugcaugagaagcaugaauuaauuuacauaggcuuguuuuguaucuugcuuucuagagacuuaccugugaugagaaaacagcuguaguuguaguugacacaaauguauuuuaaagauagauugugauguuacuagagguauauauaucauuacugacuuuuuuuuucuuuuuuuuugagacagaaucuugcucugucgcccaggcuggagugcaauggcgcaaucucagcucacugcaacuuccaccuacuggguucaagagauucucaugccucagccucccaaguagcugagacuacacgcaugugccaccacucccaguuaauuuuuuguauuuuaguagacacggggcugcaccauguuacccaugcugcccuugaacuccugaccucaggagauccacccaccucagccucccaguugcugaauuucuuuuuuaagauggguuuaaaaauucuuguuuucuuuaugcaaagccauaaaacagugacucuucacacagcuggaauuaaaagaaaauaucaccugacugcuaauguauaugaaucuuuugaucaauaauaaauuuuagaggagaauuugugccuuucccuaaugguggucagugugauuuuaguacacuuagguauauguuuagguuauucaaccagugcaguucacuuguuccauauuuugcccucugccacucgucucugcugagaccaaagaagucagccagcagagggagcaugaguuaauuaacagauuugcucuucaggacugaauucucuccucuccucuaugcauagaacauucuccuaacgcacaccuucacaguuacaagacagcuaagccacugucccgcucauuugugcucugcuaauaaaaauaugaauccaggccaggcauaguggcucacgccuguaaucccagcacuuugagaggcccaggcggguggauugccugaggucaggaguucaagaccagccugaccaauaugaugaaacccugucucuacuaaaaauacaaaaauuagcugggcuugguggcgugugccuguagucccagcuacucgggaggcugaggcaguagaauugcuugaacccaggagguggagguugcagugagcugagauugcaccauugcacuccacccugggggacagaguggcacuccaucucaaaaaaaaaaaaaaaaagaaaaaaaaauaaauauauauauguccauuugggaaaaaauagacaaaauauaauuacuuaaacauuuuuuuccuuuguuccauuaaauaaaaaagaucaagguguugauuuuaaagucagaaaaguucaagccauaucaaaaauaccuuauuccauuuucuuacaugaaauucauguuuccauuuaaaaaauucaaagcuuguuaauuuucuccuuuugaccuuccaguaaggcuaauugugugaccuaugguggagaaguuaaaauauaucaucaaaaacccaugauuuuuauacaauguuaucuuagaaguccuauuuaugucacuguuuaaaccaaaccuaauauuuagucuuuaacaagagauuuaacauuucaucaauuucuuucaggucuccauucuuuugcugacauuaaugcucguuuuugcaagcuuuggaguucagcuuuuugcuggaaaacuggccaagugcaaugaucccaacauuauuagaaggguaagauguaucuuucugucuuuugaaauaaaaauuaagggccaagugugguggcaugugccuacaauccuagcacuuuggaaugccaaggagggaagauuacuugaaacuggaggucaagguugcagugagcuaugaucucaccacuguacuccaaccugggcaacagagcgagagcccugucccuaaaaagaaaacaaaauaauaauaagguguuuacacucccuuggcaagcaugugguaccaguggcugacaagccuaguuuaagaacucccuauaaaacccuaagaauucucuucccacaaaccccuuuuugcuuaagcaugugauaugucucuucuggcuagaaagguuaauaagaugaaaagcacaccucagagaaugucacucuucccuccuauuccagugucaacccacuguugacaacuugaguguggucacccaagauuccagcuguuuacagcuguaagcuuuggauacuuucccuugaggucuuagcuaacuugauccuuccuuuguugucacauaagacucauaucagcaaacagccccaugcaaaaauguccaagaagcagcguuugguucucaccacuuuuuauugcuuccccacucucagcuuucuccccauuagaaagccagugccuuuacauuagcucuagcugcccagaaucucccucuuuaugacaaccaacaaggaccuccacaaagacccaaacuugaauacuugcacuacggcguuucuuucucuuucuucagucauugguuauaagggaaggcuagcugcuguaacaagcccaauauuucgguagcuucacauaaugaaauguauauauugcaucuuggaucaguugcaauauauacauuugcaauauauacacuauauacagcucuccuccaaaugaccacucagggacucacaugccuucuauccuaugccgccacccuuugccaugucuucagagccuucuucaaugagcuggagauaacaguggagagccaucuccaacugagugggcugugggagaaucugcuccacccacauuccucuguaaagagcagagauacugcaaggggggcuggaauuuaguugugugcuccagaaaaauaaaagggggacacaguuugguuaauaauuagacaauuuuuguaauaucauaaagugucccauucucuuaggauucuuauguuacaaguaaauucauaaaguaaaccaaccacugcugauguauaaacuagaaaagcauuuucucuuugaucccaauaaaaugaugccucaguuccuaaauguauaucuucaaaaggccuacuagaccugaacuacauuauuuauuucuagcaaauauggcuaucuaguauagauuuuaaaugauacaaauuguucucuaauugugacaaaauacagguaacaucuuuguucagccaaaauacauuauaaauuauauuaauaaugagaauuugaaacaaaggccagacugggagagacauuccaagagcuuugauacaccugagaagacagaacaaggaauguggccugacggucaugccguaucaaauuagcugauaaagaaagugacagagaccugacgcauucauccacaagcuuguguguggaaagaagagugauuuuugauccacacugaacagaggccagaaagauaauaacacuucaggaugaagccugcuaggaaucuuggaugacucaguauauuaacaguggccuaagagcauggugauuuuacauuauccacucauacccagccaaagcugaagauugauggugacagcagccagcagaugagcauagacacagauuucaugaugcauuuauccuguuuccuagagcagugaggucugugcgaggcucagauggaaagccuaaggagacucagccaucauagagagcaccagcaccaagcagaacgauugaaaagaaauuggcacggugagacggggcuugagucuuuuugucuucucaaauccaaacauaagaggccgaggccgaggccaaaaacgccaugagugaaggugacgucggcugaaguucuguuggagaacuucagcccaucuuacuaaaagaagagauaaauccaaagaaagggggaaaguagauacaccaacauuuagaucacacacaguuccuguuaaagacaacgaagcuucaguugcugcgcccauaguuuccaguugggaagauguguuuucuuguaugaggcugagcacuuccucccucugcuccuuuguuuguugucuuaaaacucaacagaugucaugagaucaauauagauauagauauggagccuaggacuuugucaccaaaacccuguaaacaaacgcugaggauaccuuuugacaaauagucauuaaaugucaguuguguccaaggcacugugauaggugaaaugaaauguggaagggaaacauuaggagguccuugcuucuguuuuguggcauuuucuguccaaucagaacguguuucauguucaagcaacaguaauauaaagucagcaguuuucaaaagccuaugagaagcagaaauaacauguaaucuaugaugucagcaugggaaauugugcuuccaacugggaguacuguacugggagggcuucagggaggaggugggauuugagaugagcaggaaaggaccuuccaaggagagcaagcagugaagaaggacacggagcauacaaagaagggucacaguguagaggcagggaccgaacaaggaggaaggagcaugggcuucgaaaucacagcuucugagauuggaauccuacuucaggagaggugauggccuggucuggucacuuaauccuucuggaaccuauuucugccuugaaugcuucucacacaaugauauuaugaagauuagauuaccuuguuuaugcgaaguaccuaaccugaucucaacagugaguguuaauuucauucccgcccauguaggaaaaaacugaagaacaaggccagaaauguaaguuagggagagauccucaagugccugaaaugccuggcuaagggguuuggaauuucguugaugagaagugagaaaccacaaaagguugguaagaagaggaaucagacacauccuagugcccacaaaguacaaagcaccauuccuagugcuguuuuuguuacccauauccuaaugaggauauccauuccuaaugaggaaaacagguguagaaagauuaaauaauuuguccaaggucacccaccuaauaaguggagaagcagggaacuaguguccaggcacccuggcuuuucaccaagauaccagacugcuucaugcaaucaaaggugggcucagguggguucaggaagacaaauuggaaaaggcagugaggccaaauaugucaagggaccuuuauacaauacacuacaacacagccuuuccaaauaauguucuacauaaaaagguaugguuauggaaagauaaucgcaauguaguuuuagcugaaaaaagugggcgauggaagaauauaaacuuuaugagcucagauacauauaggaaaaaagacuggaaggauauacuccaaaacguucauuguguuugucuguggcaauuguggguaaguuuucuuccuuuuauuuguccaggcuuuauaaauuaaagauguguuauuugcauuaaaauauucuuauuuuaaagaaucaugcugguaauccagaaagaaguaacguuggcauuacuaaacucaucguaguaagaauggagacuugggccaagaaggacagggaaagcccagggaacccuaagcuugaugcugggcuucugcugggaugcugguccagggacagaaaggaggaggccaagaggagacauggcuuagggucaaagaggacgugaagcagauuaaaauggaauuuuuguugaaauauucaaacagugaucaagaauuuuaccaucuacaccuugaacccagaaaagagauuuagguucaaaauaugaccaucauagccaaagaaacaaaaauaaccaaagggagaauaggaaaugagucaaaaacuuccuauagauguuuaauuuuuaaaaccuuuuuaacagcuuuauugagauguaauccacauaccacacaauacacccacuucaaguguucaauucaaugguuuuuuagcguauucauagaguuguauacacgacagccacuuuuagaacauuuguaucuccuugaaaagaaacccuaugucucuuaacuauuacccccaucccuuuagccuccaccucaagaccuaaacaacaacuaauauucuuuuugucucuauagaguucacuguucuggacuucuauaugaauaaaaucauaacauauggucuuuugugacuuuuuucucaauuagcauaauauuuucaaggauccuccauguuguagcacguaucaggacuucaucccuuccuauggcugaauaauauucacuuguaugguuggaccacauuuuguuuaucuguuuguucaaaaauggacaucuggauuguuuccaccuuuuggcuauugugaauaaugcuuauauaaacauuuuauacaaguuucuauagggacauauauuuucaucucucuuggguagauaccuaggaguggaguugcuggcucauaugguaacucuguguuagugguuugaggaccugcuagaauguuuuccaaagugguugcaccauucuacauccccaccaguauguaaggguuccaguaugaggauugcgauuccuccacauccucgccaaugcuuguuguuaucugacuuuuugguuauggcuuucucagugggugugaggugauauaucauuaugguuuugauuugcauuuuccggauggcagauggcacaugauacugagcaucuugucgugugcuuuuuggccauuugcauaucuuccuuggagaagugucuacucagguccuuugcucauuuaaguaauauucucagcaucgauuuuuaacugccugucuccaaagucuuuguuacuauuugcuggguagcuguccacaucacuguuguuagauaaagggcuuuugggauuccgugaaagaagaaagaguuuccuauccuuuaucuuuucugaguucauuuucugaccagguuuccccucuccucuuguuuuucuacuuuaggaagauugcaauggcauauucagaauuaaugucagugugucaaagaacuuaaauuuaaaauugaggccuggagagaaaaaaccuggauuuugggugccccguguuugguaaguauaucauaaaaaaauauucugaagaaugguguguuugucaguauaaggcuuuaaauaaguaucauauggcauguaacuaaaaguaguuuugcuagagauguuaaaaugaucuuaagucauacagggcgaagcgcuagauuauauuggaagauagaaauaagguaaaaaauaagagagcaaguagugcaaugaguucuauauagcuucaugaaacuagagaaauauuaucucaguauuuuucuaauacuucagaaauauguaucuggauucaaaugccuuaaaaaauuaggcuuaacaggauuuucugucaaauuaaaacuaaacuuauccugaguuuauaucuuuaaaggaggaucugauguccucauaauagaacccuaaaucauaaagcuauuuccauuuuaaaacccauuuacacugaaggacuuccauuauugaaacacuagagaggaauaaucagugacacaguugauugcuucuaacuuucccuuuaauauuccuuuuucuuuaaauugaguuuucaaagcacuuagaucaaagcuagaaauaccuaguaccuucuuucuuauuuuauuaaugaccaugagugaaucucucagucugugucauuggugaacugaguguucugucaccuucauuuguccuuuaaaauuauuaucuguuuuuuaaguuuucuuuuagaaaauguguaagaauaacaacugagucacagcaccucugcuuuugucacaauugauguucuuuucuaaaugucaaaacucuuuaaaaggaacagcauuucacccagcuguacccuagcacucacuguuaccucucuuuggcauuuuucucauaugaaauucgcuuuuauacguaauccaauagaaugcauauuggguuuuuauuuuuuaaaauauccaagaacugagaaaaaggauucauuugggguauguggcuucagcuuggagagagaggaaugugagacaugagaauauccuggccccacugcugacuagaaaagccguccaauuuccauugaaauaaaaauuaaaggagcauaaaaauuuucuuccaugagauaaaaauuaauuauagcauaaaguuauuuauguuauaauuuauuaauuuuuauuaauucaaagauaauaucauggaaguaaauguagucaggaauagagaacacuggggcauuucauuuccuucacuauagagaaagguagagggugccucccaccucugccaagugagguaccccagggggaucacuuaacgucagagaugggcagggcaagaagagagacucuuguggccaggcugcucaucaccaucuggagagcaggguuaucugguguuccuggagagcccaguagucacugccuagggccacaucaucugaguccucuugagccuugcggcaaagggcuuugugcugggaaaggguaccccccuccaaaggguccguagguguguuuccaggagccagacuugagaaucacccaaagacugcacacuuacaggagaaaaggugcaaugaggcacuccugggcuggagaggggguucaaacucuugaacaccuauggccagaauccaauuguaucagaugcacaagacuuaaacuccauuccuccauuccuuucaacgacaucccaccucagucaugugagaaucucgugguggccugaagaggaugaguggaagugaagaaaguggccaacuuuucuuccuuuccucaaaccgggguccuugagcugcuaaggaugggauuguuauaugaguuauaggaucaguuggauguaaaacugaauuacugaaaauaaccaaaaagcucugggaccuccccaagaauucagacagggagcuggaacacacuugaagguaguguuuggagaaaaguaaaccugccaguugugcccuauagcacucaaccuaguccauaaaaccagcuacaugggauuuuuaaaaucaaaguuaauuuaaaugcaauauuuuauggaagguauuauuagggguuucaaaggcaaugccauucuagaagcauaagcaaauagccaggcauuccuugaacaucaucacaagugcucuuguccauuucuccaggauaaugugacuuggauuguagugaaauagacaccuucgaucuaauaaaugucaucuguaaccaugauaacuuuuuacacuuuccuucuuaaguaagcuaaucaagaguuggaagcugaaauuuuguaauuuuauauuggcuaaauuaugauuaagaaaauaacauaucuaggaauacacuagaggaaugcuuugguaauuauaauuaggacauaaauaugcacuaauucaggagacagucuaguuucaauauucucucuucagauuaauaaauguacuuucuucugaaucacucagacuugaugagucaccucaguaaaaaggauuaaacauaucauggauuauaaauacagugugauuuauuuuaagaggaggucuggaauauaggaaaauggcaugcaugggagaaaaacuaacaaaguauucaggcuuauaauaaauguauuuauugagugcuugcucuucaccagcuaguaugcuugucacugugguaaggcccugaauaagcgauggccccuaccccuuaggagcuuaaagucuagugggaaacagaaaauaaaauuacaaauaauuuuauauaauaugcuaagggcuuuaaugcugcacagagaagccccuaagcuuaccucuggcucacccgaaacucaucuccauguaauguuaagcuacacugugauauguucuaggaagaaggugaucagguuuuauagggucuaaggcccaaacaauuugggguaccaacaucucagaagggccuguacaaaagagggguccuaccccuuagguuucuuuggcuucaucauauaccugccucugauuccuacagaaaggcuaaggguacaauggacacacaggagaagcaccuaaccccaacuaugcagggccaaagagaaggaccagaugagaagacacacugguuaccuuuugaaggacaaccaauaggaacuagccaggugaagggggcagggucagaggcaggugaggaggaaagucuaggcauagguuugguauuacaaguuaaggcaacucuaugcccaaagcucaaggcaaaaagcguuggggugcuguaggaaguacgacguuucugauuucuuuuaggagagaugguuguguaagauacagcaugccguuuuuggacaaagucuuuuucugcauuuccacauccaagggcagacgcucagucacgucuucagggugcccccauguuccccaagggaagagcagcucucccuaccuugaucuuggggggccuuggagcaccuccucugggagguaaaaaacugacaaaauuauguggucagaucuaaugucuuaguuuucugaauuggacaggcaagauuacaauauuucacaaauuaaccagaaaaaaugacaaccuuuucaauucaaggaaggguagcagguaaaaaugacaauaauagauggcauuugggauuuauugaaggacuccguaguuacagguaaaguuucaaacuuugcaacuuugcuagcaugaagaaagcauaagaaaacacuuuacaugauuaaaacugaaaaagacuuauuuuuuuaaugugauaaauucuuccaacuauugaagucuuugaugcuacauuuuguuuuacuugguuuaguuagaauauuuuucacauauucuaacuucuagaagaucuagaacauaacaguaguuucaguggcugcaaauucagcuaagaaagcacuucuacaaaagaaaaugagcagguaaggaaguccaacaccggcucugagaaccgguucacuugcuuguaaaaaauccuuauucaagcaaacuguggcaucuguagaauccuuauaacuucugucuacuguaaaauauaugaaauuuaguggaaacaucccaaaggaaagauuguuggaagcauccaaaagaauauauuuguacuuucauacauaaaaaaauauaaagcagaauuccaaaauaugcauuucugaguggggcuuuugcacuauauuaaagaccgucuccacuaaucagcccuaagcccuuaagaacaaaucaguuucaguuuaauguuuucuucuuauauccucaucuauuuaauauucaaaaaacuuaugaaggcacaucuugugauugucucuauaguuuaaaaaacauaaaagaugguagaaaaguacagaaccagauuuucccuagagcguugccuguccugaggguuaaauuuugagaaaugagcuagcagggggaaaaaaugaucaaaauauaauuuaaauaggcuccaaggggccuacucuagucagugguccggagcucaguucuucauuaaauucaagaaauauaguccaugauuuuccaguguuugguuaucaaaaucuuaauuauuuaaaauuagccucuaauaagaaggaaagagggggaaaagccacugaaagcuucuucuauuaacaacaaaaauguuagcuaagaaccauaacaauuaaagaagaugcaaucuaguaaaaaggaucacuuuuauaauugggaagagaaaaguauaaccauguuaaaagaacaagaaaugagacaucccuggcccccacagaagugggagcuaaacaguggguacaccucgacauaaaguuggaaacucuggacagcggggacuucaaaugggaggaggaaggaaggaggucauagguuggaaaaauuaccuguuggauucugcgugcacuaucugaguaauggguucauuagaagcucaaaccccagcauuaugcaauacacccauguaacaagccugcacguguaccccccaaaucuauaagaaaacagaaaaugaauaagccaaugaguuucaggaaucaggaaucagcgguggagguagaaagcauaccacccauaaaggggaccagacuaagaguccacugagaagacucagaguuaauaagaaaaaauccaacuggaagagaguaauuuggaaaaauacauacuacaagcaaacaccucuugccgucucagugaccucuaaaugcaucacuacuuuccagcccuguguucaccaugaugacacaaagugaaauaaagugacuaaauucuacucuacacuuucuauacuaacacaggcaauuguaauuuaugccuuucgaaagauuuucaguuacaaaacuauuucaaaauccacauccaaaauccaaugcuucuuugugcaaaucgauaaaaucaucuguccaguccucaggguaaucaggacaagguagaaauguugcagaaccucucaagcuagaacuagagcuguuuuacauugagaucaccccaucauuaccuaaugaacacaaucaauuauaacacauugaugcauuguuaugauuuagcaaacgaaugccauauagcguaaaaauguguguguauacauauacacacauauguaugugugugugcacgcacacguguguguguauauauguguguguauauacacacacacacacauaucccacacucaugacuggaaagggcuacagauauuugccuucgggugcugcuuauuggaauuucacagaacauuccuguauuggaaucgcagggcgaauccucggaacuuuaauuucgacaaugugggaaacgcuaugcuggcguuguuugaaguucucuccuugaaaggcuggguggaagugagagauguuauuauucaucguguggggccgguaagcgagcacaucgaauccuuugaacacuucaagagcagcuuucauuuguuuugaugaauaaccauauuuuccuuuaugcagauccauggaaucuauauucauguuuuuguauuccuggguugcaugauuggacugacccuuuuuguuggaguaguuauugcuaauuucaaugaaaacaagguaaggauuuuugguuuggauaccacaggguuuagccuuuucuagccacucacuuugagcuauuuguuucuuuucacacgcggcgugaagccgcuuuaaacuguaaugugacugguguaaauaaucucuauaacuguuuuacaagcucccucauugcugcuuuucagacacauuauuuaagaguacaguucucuugcuaaauuuacccuuuugguaacagugucauuaauucaccgacaacugagaggcgcgucuccuauuguucaaauugaaaagaaagaugggcagcaaguuauuaaaauacaauagaugaaagugauucgcuaauuacagguaauauuacuuucacuaaauguaaauuguaugcuucuguguaacucaguaggugaacucaggauuuugaugggggugaggggagucugguagaaauuucaaaauccuaauucacagaaaaaaagauuuuguggcagggcaugguggcucacgccuguaaucccagcacuuugggaggccaaggcggguggaucacuugaggucaggaguucaagaccagccuggccaacauagugaaacccugucucuacuaaaaauacaaaaauuagccgggcgugguggcgcaugccuguaaucccagcuacuggguuggcugaggcaugagaaucguuugaaccuagaaggcagagguugcagugagccgagaucacaccacugcauccagccugagcaacagagcgagacucaaaaaaaaaaaagaaaaaaaagaaaaaaagauuuucuaauuucauaugaacuugacauacuuugugaacucgggaagccuguugaguuuguaacagcucuaaugauuagaacaaaggcucacaaaugggaaaauaacaauguaguuuccuaucaaagugugaguuuggggaagaacauucuauuagcacuccuuggagaggggcuugcucaucuaggcacuugagcuaugcccucuauuguuugagacgcagucuuuggaaucauaguaagggaagugcaugcaguuuuugagcacacacuguguacuaagauuuuacauauucaaucaauucucacaacucucaaaugcacgguugcagaaaaagcaaugacuagucuggggcuuauaaggugugauaaacagggccagaauucagaauuggugccuauuaccgcaggcucugugauucuucgaaggcaugaguagaauaaagucaaccuucacucugcauuaaguugaagcuagaucugccuguaaagcaccgugcugcucgauguuauucauggcuaggacugauucccaugcguucacaucagagcucuucaguuuguguugcuacacaugggacuguaucugucauucacuguccucaggcucaacgugagugguaccaguuagccagucaauugacaccuuugauguguggcuaaugagcaugucauuucauucaggcuuucaaagggugagauuuaaaaauuccucuuuugggccccgacucuacuuggacccucagaaacaugggauguuagagacagaaagaacaguagugaucaugucacccagccccuuauuuuacuccuaucacauucauuaacgagaugcuuugagcccuacaguguugaguuuaauaccaagcagaaagaggaagaaggaucuuuuuagaugccuuugagccauguaaugcagcagacacugagaauucuagaauauaagcagaagcuaaucagucaauuaacaggagaguuuaggcacugcuugcccagaacaccguuaagaagccgucugagcagacaccugauuucaggaagauuagaauguaucacagcucacaauucagcaacauacauagaacaacauaaaauguucaguaacuggaaauaaauguauaauuaauugcaacacuugagcuuagagaaguggcugagguuagcagaauaaccagggaggucuccauccagcacuguauuuauguucugcagguaggaaagaguaacguggccuguuugggggaucuggggcguauguucuaucagcucaaaugggcacuuaaagaaaggagaaauugacaagaaauuauauuaccaagcuuuacaaacuugauuuguuaauuggagauaucaauugcuaaauuaugugagccuuuuagaaaaguuucuuucucugcaaguuuuuuuuuuuuuuuagaaagcagcucaugagcugccaucuaacagcauuuauacauuauucaaucauucaacagauguauuugagcaucuacuaggugccagaggcugcucuugacacugaggaccuagugaacuaaccuaaacacuaaacacagaaaaguuauuugcccucauggagcacacaucuuaauagucauacccaaaggcacauagguaaauuuccaaauguagagacaacagagauagaaaaugagggaaucuuuaggguacaauucagaaucaugcaaaaauaugucuucuuuugaaaauggaaaccucuuuaaagaguuccaagucuauauuaguaauauagauuuuuuucugauuucucuacuauguaagacaauguguuugauuuauuaaccuaacuugauaauaauaaacuuucagagguuuuuauauauuaaugaucagaugauaucuccaugccuauuauucuuuuagauccuuucagaguucaacuuuccaaaauuuuuuuuauguauaacaaaguaauuacauuagugucuaugguggccagagaacaaguguuugcuuauaauuagugagaaaagugguuuagcaaugugauuaucagaaaagaacaauuuuaaacaaacacuauuauugggaauaaaugauguacuaaagaaugacaaaauaaucaccagaaagauauagaacuuccaaaucccaaaauguacaaagcaaaaauuaaacaaguuguaaaaagaagcuagaaaauccaaaaucauagugaaagauauuaacauauaucucaaaaaaucucauaauucagaguagaauaaaaggaaauaugagauuugauacaauaaacacaaucaagugaauguauaaggaaaacucuaauuacaacaauuugagaaugugcauuauuuucaagcacaaaaugugucucccagaaggccauaauuacccaagaauugauaauguaagaauguuuucugaccauaaugaaaacaaaaacaaaaaaaacucuacaauuuggaaauauuaagacaauacuauaaauaauuuaugaguugaagaaauuauaauagaaaaucacaaaauauuuacagacaaaacauuuuauagcgucauauacaaaaacuaaugagguauagguaaaucaguaauuacaaauaaauguaucguuuuaaguguauauauuaaagaagaaucacaaguuaaauauuaauaugucaaauauccaaaucaauaaauuauaauaaaguaaaaucaaauaaaguaggggggaagaaaguaacaaagauuaggacacaaauuaaugauacagaaaguaaggaaacuuguauagcuucuauaauauucaagaauaacaaaagcuggguuuugguuuuuuuuaaaucaagucaauaaaccucuaggaagguugaacaaaaauaaaaacaugaaacaagaaaguaagcuacaaucauuaaaagagugucaguauuguuauagguauagaaaauuagacuuacagaaaaaacuagaaagacccagcagggacccauguauguagaaaacagaagcagcucaacaaauuagugcagaggguggugagaccaacaaggagugguguugggaguauugauuguauugauguaaagagcuaugcugagaucucuaccucacugcauacucaaaaaugaauuccagaugaauuaaagacuucaauaugaaaagcaaaauuuaaaccauuuuuaaagcaugucagcauuuauuuuuuauuugaauuucagauaagcagcaaauaauguuuuugccuuuauuauuuuuaaucagcgcauaauuguacauauuuaucggguacagugugauauuucaauucauguauuauaauguguaaugaucaaaucaggauaauuagcauaucuaucaccucaaacauuuaucacuguuuuguguugggaacauucauaauccucucuucuagguauuuaaaaauaaacaauuaauuguugucaauuagauucaccauauauuaccauggaacacuaaaauuuauuccuccaaucuagcuguauuuucauauccauuaaucaacauuugacuaucccuauucuaguuccccuccccaccccuaguaagcauuuguuuuuugcccuggaguaguuauggauuucaucccauuagccaccaagugaaaucuguaaaggaaaaaaauuauaaacucgauuauauuuaaauuaaaauguucugaaugacaaaagacacucuaagcaaaauaaaaauacaagccaagacuaagagaaaauauguacaacuuacauaauugauaaaagauuaguauccagcauguauaaagaaucucuacaaaccauuaaaaaguaaauaucaaaauacaaaaaugagcaaaggauaugaaugggcaauucacauaggaagauacaagcaucaccauuuacacacaugcaaauguuucaucucguuaauauuaaaacaacauuagauacauuuucacaccuaucaaaauggucagauuacaaugucuggcaauaucaaguauugcaagaauauuaggauaugguaacaccuguguauugcugguaggaaauuuguuuugguuuuugcucuuuggaaagcaaguuggcaacaucugguaaauguaaagaugcuuaaauuccuagaccccaucaauucuucuccuagagaucaacaauggagaaacccucauagauauuuacugugagacaguacauggaugcuuauugcagcauugguuauaguccauaaaucaaaaaugaauaacuucggauauucguacaguggaugguguuugugagcaguuaaacaaauuagauuuaguaaucuaguuguauggaaaguauacuguucaaugcagauauaaagaaacagcauaaauaaucacauguuggaguccauuucuauaaauauuaaaaaauucagaacaaauucuuacguauugauucaugcguaagcacaaaagucugaaaacauaguaaggaggaugcacgccugaaggguagugguuagcucuggguaaggaaagggagagugggguuuuugucuaguuuuuaaaauuacacuucagcuuuuaugauaaaauauaaugcagugcagugcaauacaauauaauauaauuuuaaucauaugcauuuuaaucaaguacucuauuauacagaauauggaauuccauuuaggcaguuaucacagcacuacuuucuuaaaaugcaaacucuaugacuuuguaucucucaaaaacaguuuugcaauugcacauauuagacauuuuuuaaagaaagacaacauacccuuaacuggaagccacagcauugacaagcuauaauuuugcugcuaugaaaugaaaggaaacuaacuacuauuagugaguauccuuuuuugaaaauguaauuauguagaaacuccucuuuacauuuucccaaaccugaauauuacacaucuccaaagauacaagucgaaggcugcugaauucucucugaaacaccuggucaucauuuugggaacuccucccgagaccaacuuugagcauucugaccauguuucucucaccaccacgguuggaagaacauggucagugcaagcccucacaucaguccuguuugucucggcaccccaucugccauguucuuggugcaagcacaugacaaaaggccuuuuccugcuuucuuuugucuguuaaggggacggcuuugcugaccgucgaucagagaagaugggaagaccugaagagccgacugaagaucgcacagccucuucaucuuccgccucgcccggguacccaaaaugcucugauuuuauucauguugggcacuagugugcacgauuccccaggagucucagauuuaaauuaaaauaauaaucgugaggccgcugggagguugugcauaagguaauacagaaacaggcuccaaaccacagaucucuccauaaggcuauuaaaaucaaccacccaaaggcugugcuucagugcucucagacuaagccuuaaugaaaaaaugaauuuuuaaauaaaauauauuugcucuugccuuuuaaaaauauaagugaaauguauuaaacugacagaaauugaaugaugcacuucuccuuccaauauagacggcaucaugcacugucguuuugaauauucagagccagccauugcugcaaaaacaccucacaauagacggaacuguuuggggagaaaaauguaauggguuuuaagauaagcauuuaagaaaauaaacgacaagaaaguaaaugugaccugugucuaaaaugcccuugcccaaaccuuucuuuucuagauaaugaugguuuuagagcuaaaauguaugacauaacccagcauccauuuuuuaagaggacaaucgcauuacucguccuggcccagucgguguugcucucugucaagguacuucguuucacccuaagacuccgggaaugaauuuuguauucacugcuacauccgagaguaucacaagcugcuauaugcauucacgguuauguucuuggguguaaaaauuaagauucacugucaauggcaaagugggcagaagaggggcaagccuguauguguccgauggacgugggcaacgacucgugugcuguuucuguugcagugggacgucgaggacccggugaccguaccuuuggcaacaaugucaguuguuuucaccuucaucuuuguucuggagguacuguaaugagucagcuagcucugggggaaucugugcacaguuuuaaaguaaaucagccucccucuuugaugccacuuacucuccucucuguguuccauugccuuugaaguuugcccuuaggauauuuccuacuuaagcgguucugcuuaacucgaacaaagacaucacuuuauccaucagauuuuucuaacuacagaaaugcugcugucgauuguugugucugaacauuggccugucuaguuaugcgaguucugauauuuagagggaauggugcaagccacuauaauucauugacucaaauugcaauagagacgcaaaacaaguuggcccagacaagguuauuuuaacaugugauucucauaauauugcuuuccagggcagucuuccugaaauacaagcagauucuuauuuugcccuacacugguugauguuucccaaaaucuauggccuuuugcuuaaggaagaaaaaugucccaugaucagaacuagucauaaaacgaagaggaaagaguguagagaacacagauuuguaagcuacuuagcuucaaaaauaaaaucauauaucuugguaauaaacucuuauuuuuaguuacuacauguuuacaauuauucuuuaaauagauaguauaaccgagcaugcuggcucacuccuguaaccccagaacuuugggaagccgauguggguggaucaccugaggccaggaguuugagaccagccuggccaacguggugaaaccccaucucuacuaaaaauacaaaaauuagccaggagugguugcacgugccuauaaucucagcuacucgggaggcugaggcaggagaauugcuugaacccgggaggcagaggcuacagugagccaagaucaugccacugcacuccagccugggugacagagcgagacucagucucaaaaaauaauaauaaauaaauagacagacagacagauagauaguguaggcacguggccuaaaaggaaaccucaaagggcauuaaaguguuugucucauuuucaauggaaaagauacuguguccacaucaaauaauuuaaaauuuucuucauuugaaaaaaauacauacacauaaugcaucucaaguuaauacauuuaaauauguacuaaacacucucucuguuuauuuucuucuuugcuuuuucuccagguuaccaugaagaucauagcaaugucgccugcuggcuucuggcaaagcagaagaaaccgauacgaucuccuggugacgucgcuuggcguuguauggguggugcuucacuuugcccuccugguaagcauagaagucaaguugauuucagcugauuauuucaguuugguucaguucugcucaguccuguuuccagucucauuuuacuccacaucaaccugcucugagguguuagauggaccucccuaaagcccagcuuugacugugaugggcucucagacaugcuugugucuacauguacacacccccacacucuucacacaggcaaaaccuggccccucaaagaccuagacgaugcaagcuagaaagagaaggaccuucaagaucuucugguuuagccccucauuuuaccaaaggggaaaacaagaaagagagaggaagacugcaacagagacugagaacuguccaaauucacacaagcuaguaucagaagacuauaguccuguuuuccuguuuucucagcugaaauauagcauuuguuccacuuuguuauaaucaguauuucacaaugugauucucaagugcuuccacuguuucauuuucuauaagacauuuagccuccacuucucuaaagcauaugauucuccaucucuauaucuguguucucacuauuuuaccuaaagugccuucacccuccauucagucugagaucccacucaaaaucugcagcuauggguguacugaacuguaaucuagggccauauuguccaaugaaaauaaaauguggccacagauaucacuuaacauuuucuagaagccacaauaaaaaaguagugguuuagaaaauauaacuauuaaauuguuaauaauuauuaaauaaauaauaauuaauuauuuaauuauguaauauauuuuauuauuuaaaauauguauuaauuaaaagaugcauuauguguauguguauguauauauuuuuauuauuuauauaguuauauauuauauauuaauauauuuaauuaaauaauuaauuuaauugauuauauaauuaauuuaauaauuauuuaauuauauaauuauuugguuauaauuauuuauguauaauuauuauuuauauacuuauaacuauuauguauguaauuauacuuauguaauuauaauuauuuauauaauuuaauuauuaacaauuuaauaauuauauuuucuaaacuauauccaaaguauuauuauuuucauguguaagcaauauaaaauuauugagauaaguaguauccuuguaucugugugugaagucuuuggcugaguauguaucuuacauuuacagcauaucuucauuuaaauugccacauuuuaagugcucaguaaccacaugugguuccauguggcugcugguuaccauguuggauagcacagcucuggaagauauggguccuagucuagguuccaccauuuuccagccuugacuaauuuauuugccuucaaugauccuuuguuuccugcucugaauggccaauauaacuucauaauccaccuauucccucuggcauuaugaagaucaagugagauaauauauuugaggcuuucuugaacuagaaagauuauacaagccuguaggcauuauuauaauuaccuucuuuuuguuagucauacuugaucucaucccaaggaauauuaucgguuuuucccuguuuccuucuauccauucucccauccccuuaguguuagagacaugcugggaaagacucauuuacacauccuaaagggcuugccuuaauacgagacgcugugcucaugaacauagugagcguccuucuuaaaccagugguuaccuucagcaucaggggcuguaugaagccuaggugagcucucagucauccugaaguauuuucucagcaauaaaugguucucaauuccuaguacaagacacaguacuaguaacugagaagaauguaauaagcaaaacaaauauaguugcugcucuugugaaccuuauauccuagaaaaguagauagauagucaucaauugcucacaaaucuaugaguauaaugacuaugaugagggagaugaaggagagccuguguuccugugacaacauagauaauagugggagauggcuucaucagagaggucuuggaagacauccccaagggagugauggcuccaucuguaggauaaggggagggcauuucagguaguugucccugugauggaaagaugacagagcuggaagaaggauagauacauaguacuagcauaguacaagauuuggauggguaagaagguaucagaccucuuaggaccuugcaguccaggugaagaauucagauucucauccuaaaaacuauugguugucauuacuuccaaaacauaaagagggaagguaucugcaauagaucuuuagcuaacaugggaagaaaaggcagcaaggcccauguuuuuccuuucuccagauaaaauuuguauuagucccuucucacacuguuaugaagaaauacccaaaacuggguaauuuauaaaggaaagauauuuaauugacucaaaguuccacauggcugggaaggccccaggcaacuuacaaucaugguggaaagggaagcaaacacauccuucuucacaagggaacaggagagagaagaaugagugcccagcaaagggggaagucccuuauaaaaccaucagaucuugugagaacuaacucaauaucaugagaacaggaugggggaaacugccucccuuaauucaauuaucuccaccuggucccucccacaacauguggagauaaugggaacuacaauucaagaugagauuuggguggggacacaguuaaaccauaucauucugccuggaccccucccaaaucucaugucuucacaauucaaaauacaaucauacccucccaacaguccccgaaagucuuaauucauuccagcauuaacuuaaaaguccaagcccaaagucuuaucugagaacaggaaaguuucugcugccuaugagccuguaaaaucaaaagcaaguuaguuacuuccuagauacaauggggguacaggcauuggguaaauauacccauuccaaaugggagaaauuggccaaaacaaaggggcuauaggcaccaugcaaguccaaaauccaauagggcagucauuaaacauuaaaguuccaaaauaaucuccuuugacucugucuuauauauauccagggcacacugaugcaagaggugggcucccauggccuugggcagcuccaccauuguggcuuugcaggguacagacccccuccuggacugguauugagugucuguggcuuuuccaggcacacagugcaagcugucaguggaucuaccauucuggagucuggaggaugguggcccucuucucacagcuccacuaggcagugcuccaguggggacucuguguguggacucuguguguggacuccaaccacacauuuuccuuccgcacugccccagcagagguucuccaugagggcucuacccccacagcaaacuucugccuggacauccaguuguuucuauacauccugugaaaucuaggcagagguucccaaaccucaguucuugacuucuguucacccacaggcccaaaaccauguguaagccaccaagucguggggcuugcacucuuugaagcaucagccugagcuguauauuggcaccuuuuagccauggcuggagcagaagcugcuggaaggcagggcaccaugucccaaagcugcauagagcagagggagccuggggcccacccacaaaaccauuguucccuucuaggcuuccaggccugugauggaaggggcugcugugaaggucucuggcaugcccuuggggacauuuuccccauuguccuggugauuagcauucagucccucguuacuuauguaaauuucugcaacuggcuucaauuucucccuaguaaauaagguuuucuuuucuauaaaaaucaucagacugcacauuuuccaaauauuuauacucugcuuccucuugaacacugugucacuuagaaauuuauucuaccagauacccuaaaucaucucucuuaaauucaaaguuccacagaucucuagggcaggggcaaaaugcugccagucucuuugcuaaagcauaacaagagucaccuuugcccuaguucccaauaaguuccucaucuccaccugagaccaccucagccuggacuucacuguccauaucacuaucaguauuuuggucaaagcuauccaacaaguaggaaguuccaaacuuucccauaucuuccugucuucuucugaguccuccaaauuguuccaaccucugccuguuacccaguuccaaagucgcuuccacauuuucagguauccuuauaguagccccccacucuaaguacgaauuuacuguguuaguccuuuuucaugcugcuaugaagaaauacccaaaacuggguaauuuauaaaggaacgagguuuaauugacucacaguucugcauggcugggaaggccucagaaaacuuaugaucaugguggaaggggaagcaaacacaucuuucuccacaugguggcaggaagaaguaugagugaccagugaaaggggaagccccuuauaaaacuaucagaccuggugagacuuaaucaucacaagaacaggaugagggaaaccaccccagugauucaauuaucuccaccuggucccucccaggauacauggggauuaugggaacuacaauccaaaauaagguuugggugggaacauagccaaaccauaucgaaaugcaaccuaaagcuacugaguccaagcaaaagucaaguagacucucuaaucccagauaaccucagagaggaaaucuuaaacccaaagaccaacuucccuuuucugccuaauugccuuuguucuucuccaagaaccucuuuggucuuggaaggaugcucauucuccaccguauuuugcaguggacuauugggaaggaaaguuccccauccaaggaugcuaugugcacacauucaugugcuuggaccucaccaaggaucucacuggacccccuucgcggggcccaucugugacugucaucauuuggcuaggcaagccuccuugagaguaaucacacucuggcaucggcugaaugucaagguuguuauugcaguuauagcuggugggaucuuuguuucucaaaugaagcuuucuuauucauaaagugcagucaucucuuccugcuaaucacacccuugaaaaaagagcuggauguguuccugagcagggaggaccucucugaaaucagcuuagaggaaugaguguauguuuguucuucaguggugucuagaaucugacuucuggcaaucuuuuccaccaucagcccuuucucuuugccaggauuccuuuaccuccuaugucaguugaccuuccuauguugcacuguuauccuguguuuuucacacccuguaugcaaaagagcuggucaccauuuuauguaaaauaaauuucaaaauacagaauuuagcugagcaaaacagaacccgaaguuucauuugagacugaauuuuaaaucuaauauuuauucaugaguuuuugcagugaccuuuucagcaccuuuuuuagaucacuuucuuauaauaauuuacacauauuaagcuaauuauucaguauacuucacagaaggcuuaaaaaauggaacuguaacaagaucuuuugugcaaauuaugagaagcugucuucuguuuaaauuucagaaugcauauacuuacaugaugggcgcuugugugauuguauuuagguuuuucuccaucuguggaaaacauguaaguacauuguuaagaaucuuaucuuaaaggucauauauguguuaaugaaagaauggugauuaauugauuacagccuuaccucgguuauuuagggauguaaucacaaauuacuagacaucauaagucaagauuaacaaauauuaaacauuguuaaaugaaucaguagcuuaguuaucauucgauguguuuccugccauuuauguugcuuauucuuuauauucaauaauuaaguaaauuauuuaaauuuauuaauuuaauuaauuaaagauaaccagucaugaaaacaaaaaccaauauucuuucuuaaugcauuuuuauuuuuauuuucaauaaaguuaaguaacuucaaagaaaaauaaucuuuaaugaauuuuuauguuuccaugauuccagauuuuuuuuuuuuuuuuuuuuuugagauggagucuugcucugucaccaggcuggagugcaguggcaggaucucggcucacuguuuucuccaccucccagguucaagugauucuccugccucagccucccgaguagcugagauuacaggcaugugccaccacacccagcuaauuuuuguauuuuuaguagagacaggguuucaccacguuagccaggaugagauuccagauuuuuuaauauuauuuguuaauguccauggguauauuccacauauauuuuucauuuuuuacaaugcuguuuccuuuuuuauuacaaacguuauuucauauauacauuccauauauacacauaaccaauauacuuaauauuugauaguuauuuaguauuauaccauugcuuagguuuguuuuugugaaagucuguuuguggaagaaaccugaguuuacuugcugucagucaaaaauguguagcccuuaucauagagaauugaggagcagaagagaaaauggaaggugaaaaugcuuaguguuacucuuauuaauuugugugaagaggcugaaauguuugaaguaaaaauaaaauucgcccaacgccugguggguuuugaagaauauuuugauguaauaccuuauagaaagcaacuuucaaaugauacaccuaagagugauuuugagccaaucugcuuaaagauuaguugcuacccaggucuuccauagcuuaauagauugaauauucucucucucucucucucucucugucucugucucucucucucucucucucugucuccccgcuucccaccccugguccccagguaacgcuaaagaugcuccucuugacaguggucgucagcauguacaagagcuucuuuaucauaguaggcauguuucucuugcugcuguguuacgcuuuugcuggaguuguuuuauuugguacugugaaauauggggagaauauuaacagguugguauauacuuaucuuucuauucauuuaucaagcaaacccuuugguaauaaaauuuuaaauaaacaaauguuuuuugucuauuaaagucuaggagaggggaaagggaaguaaucaguuggaaauuaaaauaaaauagccaaguuuuaaaugauauuuuuccaguugaaaagguuauucaacugaaaaggucuacuuucaaaaccuuagaaaaauuagaaauaaaagaaaacaaaaagaaucuauaauuccaccaacauucaguaaucaucacuccuaauuccagcacuuuuucuaucuacauauugccaaaaaaugauauauuauuuuuagauggaacaauuuuaagauaacucuggguuucuuucucagcaaaauaugggaauuuagagccccccaaaugguuguaauauaugaaaagcaguuuucaacgauuugccuaaguuuuauagaugcaucauuuuuuuucaaguccugauacaacaaaguauauaccgauaugucaaguuguaggaauuagauacauggcugccccaccuuuuauagcaucguccaagugaaagaaggaaucacuuaguugccaaagccugccuacuuagucauucaagaugaaugguaauaaauuaguggccaugcuagaguuggguguucagacggcuauacuuggaggcaaguauaaaugacaaauuaauaaaaagguauaaccuuuggaaaaggugacuuagcaaccaaauuugcuacaaccuccacuuguuuugguguuggcaaaccaugcuauuucaugacaaacccuucuauaauucacauucuguuaauuuuuuuuucuuaaauuaggcaugcaaauuuuucuucggcuggaaaagcuauuaccguacuguuccgaauugucacaggugaagacuggaacaagauuaugcaugacuguaugguaaauaucucucaucaugaacaaggcuuagacuuagaaucagcaugaaacucuugcaacacaauguuggcaggaucauccuuguuagcguuaagacuuuauguaugaaauauaaauccugacacuucaguccauaaaauugcauuauuauacauuccaaugugugaauauuuagggcaaaauacucaauuaacccaacuugagcuauuguaguuccauucaacaaauaugcauuuugugaguguuguucuuucccucccaucuuuaauauuuugguaaugaaagucaaacaggaagcccuuuaauuuaauguguucaguggauaguucacugccccucagcuauaugcuaggcccuaggucuucaacaacuccaaggcacacucaaggagcuuaccucaagggcucugaguuacucuuccuuuauacuauaaaguauacuuuauacuuccuucuuacuauauccugucuuccccaagcaucauccuucuggucucaguuuaaacaggucuuuugccuuaagcuaagacagccagcuacauguucuuaugcugcucuauaguucuccuuuguaauaaggagcuguagugaauuacuggcuuacauucauuuauuuuaucucuuucucaccguaggacagaccaaugcuguguuaaaaaaugucugcagugauggaaaucugcacuguccaauucgggagccacuagccauaugugguuauggagcauuuaaaauguggcuaacacaacugaggaacugaauuuuaguuuuaauuuuauauuauuacauuuuaauuaacauaaauuuaaauuuacaucgcugcauggagcuaguggucaccauauuggacugcacagcacucaacugucaguaggaagaagagauagggccgccuaugucuuucuuaccagucucuccccaaacuuggcacaaaccuagcacacaguaggagugcugggacuucaugcaugaauuaacaaggagaauuugccaaaucaaauagaauacaaggcaaaauuuaaugaaucuuaaauaaaaauacaagcagaaugcugggauuauagaagagagagcuaguuuaucuggcugagaaaaaccagaaaguucucucagaggugucggcauuuuauagagccuguaaacaaugagagaguuuuugaugacuuaagucuugugcuauuccauagcaucccauaacaguguuccaagaauggggcuuacuccucacacaauuugaaugugaauuuucuaugugcaggcacaucuuguuuuacugugcuucccuuauugccuuuugcagacauugcauuuuuacaaguugaagguuuauggcaaucuuguguggagcaggucuaucagggccauuuuuccaauagcauguuugcucacuuucugguucuguaucacauuuugguaauucucacuauuucggacuuuuucauuauuaucuguuuuggugaucugugaucagugaucuuuugauguuucuuuuguaguuuuuuuugaggggugccaugaaccaugcucaauaagauggagaauuuaauugauaaaugucauaugucuucugauugcugcaccgaacaucuguuucuccaacucuucucucuuuucuugggccucccuauguccugagacacaacaauauugacauuaggccgauucacaacccuacaauggccuauaaguguucaagugaauagaagauucacacaucagucacuucaaaucaaaagcuagaaaugauuaagcuuauggaggaaggcaugucaaaagcugaguuagcccaaaagcuaggucccuugcaccaaauaguuacucaaguuguaaauucaaaggaaaaguucuugaagggaauuaaaaugcuacuccagugaacacaugacugauaagaaauagccuuauggcugauauggagaaaaaauuuuaccggucucaguagaagaucagacuagccacaacaugcccuuaagcuaaagccaaaugcagaagaaggcccuuacucucuucaaauuuaugaagggugagagaggugaggacgcuguagaaaaaaauguuugacgcuagcaaagguugguucauuauguuuaaggaaagaaagaagccaucuccauaauaugaaaguguaagugcugcugauauaaaagcuguggcaaguuaucuagaagaucuagcucaaauaauuaagguggcuacacuaaacaauggauuuucaauguagacaaaacagccuucuauuggaagaagaugcccucuagaacuuucauagcuagaaaggagaagucaaugccuggauucaaagcuucaaauaacagacuuacucuguuguuagggacuaaugcagcuggugacuuucaguggaagccaaugcucauuuaccauuccaaaaauccuaggacccugcaaugguuugacuguguccccacccaaaucucaucuugaauuguaguucccuuaaucuccaugugucgugggagggaccaggcagagauaauugaaucaugggggugguuucuuccauccuguucuugugauacugagugaguucucacuauagccgucaugagaucugaugguuuuauaagagguuuuuccccccauuuucuuggcacuucuugcugccaccaugugaagaagaacauauuugcuuccccuuccgccgugauuguaaaucuccugaggccucccaaucccugcugaacugugagucaauuaaaucucuuuccuuuauaaauuacccagucucagguaugucuuuauuagcagugugagaauggacuaauacagucucuuaagaauuaugcuaaaucuacccugccugugcucuauaaauggaacaacaaagccuggaugacagaauagcuguuugcagcaugguuugcuggauauuuaagcccacucuugagaccuacugcucagaaaaaaaagauugcuuucaaaguaguacugcucauuaacaaugcaucuaccuggucacccaagagcuguaucaggagauguauaaggagauuaacauuguuuucaugccugcuaacacaacauccauucuguccauggaucaagaagucauuucaacuuucaagucuuauuauuucagaaauagauuucauaaggcuaauagcugccauagauagugauugcucugauggaucugggcaaaguauauugaaaaccuucuggaaaggauucacuauucuacaugccauuaagaacauucauggccaggcgcaguggcucacgccuguaauccuagcacuuugggaggucaaggcggguggaucacgaggucaggagaucgagaccauccuggcuaacauggugaaaccuugucuguacuaaagauacaaaaaauuagccgggcaugguggugggcgccuguagacucagcuacucgggaggcugaggcaggagaauggcguaagcccaggaggcggagcuugcagugagcggagauugcaccacugcacuccagccugggcgacagagugagacuccgucucaaaaaaaaaaaaaaaaaaaaacauucaugauucauggaaggaggucaaaauaucaucaacauuaacaggaauuuggaagaaguugauuccagccauuauggaugacuuugagggguucaagacuucagugaaggaggucgcugcacaugugguugguagaaauagcaagagaacuagaauuagaaauggaaccugaagacgcgacugaauugcugcagucuccugaucaaacuugaaggaaugaagauugcuccuuauggaugaucagagugguuucuugaaauggaaucuacucuugcagaagaugcuaugaacauagucauaaugacaacaaaggauuuauaauguuacauaaaauuacucgauaaaccagcagcaggguuugagaggguugacuccaaauucgaaagaaguucuauuguggguaaaaugcuagcaaacagcaucacaugcugcagaaaaaucuuucaugaaaggaagagucaauugauaugauaaacuuccauguugacuuguuuuaagaaaucgccacagccaccccaaccuucagcagccaccacccugcucagucagcagcugucaacauugaggcaagacccuccaccaccagcagaagauuacaacucacugaaggcucacaugauuguuagcuuuucuuagcaauaaaaguacuuuuuauuaaggucuguaccuuuuuggacauaaugccauugugcacuuaauaagccacaguaugguauaaacaugaguugcaugugcacugggaaaccaaaacaugcauaggacuuuauugcaauauucacuuuaucacagcagucuggaacugaaacugcaaugucuccgagguauaccuguagagucuauauucccaaaucuuaacccauuacuucagucagagaaaaacuugcaaaugucuuuuuauuugauuuucugcaguuugaucacaguggcuacuuaucacuuggggcugguggugguggcagaaagaauaucuaguggagaucaguucauuuucauugugcuuuuaaaaauggcaauaaccuugggauucuacaagauaacagcauagcauaagugaaauauucuucuuuauuucugcuacagaugauguacccaauguauguggcuuuugaaagcuuacuuugaaguuaauuauaugcuauauguuuaggaaucuauucauuaacuauagucagcuaaaagaaauuuguauucucuacucuuauccucuccuucuuccaccccaaugccccaaagguucagccuccguuuuguacuccagaugaauuuacauacugggcaacagacuguggaaauuaugcuggggcacuuauguauuucuguucauuuuaugucaucauugccuacaucaugcuaaaucugcuuguagguaagugauguuaguugaauacuuuuuacucuuuaaacucagguacuuagauaauuauguauuauuuucaagcaauuacccuggauuucuugggguggguguuucauggcauuaauuauaaauuguugucucucaauccagaagcugaaaagaccuuugaaaggcacguaaaugacaguugacugcaauuuuaagaguuguagcauuuauuaugaucauuaauuucaaaagggcucuucucauggauugaguugaacaaauaucagagaggacuaucuuucuagccuugaaauaucacauuuauguuuuugaaagguacaccuuauuuacccagaugugggcccacccagaacucaauuugaccuuuaaaaauggcccuggaacucucaacuaagaguuaaagccagcuggcaugacuaucucuauacacagaauguguguuugugcuuacgacccucauguuuuggaaaggcaggagcuggagaaauagcuuaguccaaguguaaacaugccaauuuggaaaccauacuaaaagcacuuuaaaaauuuggcuuaugauauaggugauagaauccauuauuaauaauagauguuuuacucuuucuaaaauaugacagauuagcauaauggucuaacuucugaauuuuucuuuuuuuaaaagccauaauuguggagaauuucuccuuguuuuauuccacugaggaggaccagcuuuuaaguuacaaugaucuucgccacuuucaaauaauauggaacaugguggaugauaaaagagagguaugggaguggguuguuguuucaugccucaccucaaagagacuuaucaacaugucucaaacacuuaaaugguuuucagguuggcaaaugacacagauugaauuuuuaaauggugaauugcagaaagccaucauuuacaguucagcagaauccucuaggaagggagacagcaucguuccuccuuacaugaucuucaaccaugaacauccucuucuucagacuuuccgaaggccagcagggaaaggaagccaaagggacucuguaggaaucagccuugggcucaggccagaaaaagaggugacacugaaacuaccaaagggacaguauauuacaaauucaugaucaccucaaacucaagcagcaaucccaauuaaaaguacaaaggaguuauuuaaguggcaucugaagguguguauuggauuauuuuugaguuacuacuugaauguuuuaaccauaaaguuuacccaagguuucuuaaaauuagccaaaguagcugcagucugcucuuccucuucuugucauugucgucaucaaccuccaccuccuucccuuccuccuacuccuccuccucuacccccucuucuucccccuccucuucccccuccucuucccccuccucuucccccuccucuucccccuccuccucguccaccuccucuuccaccucaucuuccccccuaccuccuccuccucuaccccuuccucuaccuucuccucccccaccuccuccuucuccacuuccuccuguucuuccucccucuccucuucucucuuccucauccaagcaaacacucaggcacaguucuaggcacugaggauauagcagugaacaagauggaacagcuccuguacucacagagcuuacagucuaauagguggagacaaauaauaaaaagugaaauaauaauaaauagugcaguauuuccagaaguuaaaacuauagacaguaguugggguuggggcugcgccggcaggaaugaccaugaaggaggccugaggggugcugugggaccucaugucugaacaacaaggaaaguucugccaggguauuuggggcgagaucuggaaauaguucaagaagaguugaugaagggcacaaagaccaagaagccagccugggcaucauaaaugaggggcuccggcagugcacucaccccaauuugcucccucuucuugguaccccugcccgcccaggcuucagucuugagggcuuuccuuucaagguagugagagcccugcgugcagggcaucugagcucacucucagcuccucaggauccaccugucucucuguaacugucacccacgggaaccugcuuucaugcaauacacacaugaagacccacugcccugcacaccgagaugucaguaacuggcaggcagucauggucgccaguguuccgcccagcacuuucauucaaagauacagccagggggcauggugguuuguguugcauggaagguagcaacacaucuuagauucucagugucuggaucaguucugaccccagaagagggcagagcugaaggccuaauucucuuguauauaguuuuucuaauccugaagaagacaugaaaaggaguuaguuagcucuuuuuuuuuuuuuuuugagauggagucccacucugucuccaggcuggaaugcaguggugcaaccucugcuuccuggguucaagugauuccccagccucagccucccaaauagcugggacuacaggcauguaccacuauguccggguaauuuuuuuauuuuuaguagagacugggcuucaucaugcuggccaggcuggucucgaacuccugaccucaggugauccacccgccucggccucccaaagugcugagauuacaggcaugauccaacacgaguuaucuuuuaaugguagaaaaacauguaauaaacauugagacguuccuagcaucccgauugagugaagaggaggauuacacgugugugucuuguccauuaccuugugugaguacauuauggcccacucagugcauguguuggagguggcgucugugggacaggcuaugcaagcaucagccuggugagagcaagaguaggguccuggggggcugaaggggagcuucccaugccucacuccaaaugcugcaauguggugacaucccagaaagagaagcaccagcagaaauuuaucacucaguuuucuauccucugcucuucuuagugcacuuaauucuaccaggcuccaaggaggugaccagcuuucuucacaucuggugcuaauuaugcuagcuuuugagaaauagcaccuuuuuuuuuuucuuuugagaaacccaagugaaucaucgaggccugaugauuugcuacuucuugugcucugccccgcagggggugauccccacguuccgcgucaaguuccugcugcggcuacugcgugggaggcuggagguggaccuggacaaggacaagcuccuguuuaagcacaugugcuacgaaauggagaggcuccacaauggcggcgacgucaccuuccaugauguccugagguacaaggcaggcuuucgcagggcugaaugggggccagaaaccacagcugucagccuucaaggccucugcaguacaauuaacaaguguguuuccaacccaaaaugccacaucugcuguggucgugaaguggggucacaugucccaggcgcuaagugcccuuuccugccguccuccagugaacauuuccaaguaggugccucgcaggggagggcugggcggcugugcccugaugucccguagggaccccugcccacugaggugcaccccgaggggagagguggaagggaucugggagagcacagucccaccccuucccugugaugcgggaacugcccagaagagcugagugacuugcuugcgguuacagggcucuggcaaagcugggacuaacaugcagagcaccucacuugcaugggucugaugagaauuugccuggccugcucugugaugguugccccguuggcuaaaacaccagauuuuccagacauuucaugagcgcccagacaggacagagggucaaauggagucucugccuuuucuucuuccugggagacuucuguauuuguuuccuugggcuacuguaacuuagcaccuuaagcugagggauuuaaacaacagaaagguauggucucgaaguccuggaugcuggaagcccgagauggagguauugcggggcugauuccuucugaggccugugagggagaaucuagccuagccucuccccuggcugcuggaggugcgcugccaauguuggucauuccuuggcuuguagaagcaucagcuuggucucccuucaucuucacauggcauucuguuuguguguguguguguguguguguguguaucuauguucaaauuccuccuuuuauaagaacaucugucguauuacauuaggaguccauucuacuccacugugaucucauuuuaacuuaauuacuaauuacaucugcaauguucuauuuccaaauaaccuuacguucugagguacuagagguuaggacuccaacauaucuuuuuuugggaggaaacauuuaacccauaacagcuucuuaagcaggaguccauggauaaaacagaggcccauggacuugcaagggggaaacaauuacaucuuuauuuucacuaaucacucuuugaaaugugucauucucuuccaugaugaacguaggcaacaaaccacagucgcauuagcaauauccaugucuuuguuaccaggagaaaucauagauauuuucagaugacauaacugacugccuugacugacaucuuaaaauaucauuuaugcucaccagugcuucugaguuaugguagucauuugagcucugcuagaugguauuauuuaauggaauaauaaaggaagcacuuacuuauguuacuuuaucacugccguuuuaaaguaaauuugagaauuguauuuuaauauaauugguuuccuuuguaauacgguguauuucauuccgugcauuuaaagcauuauuucaagaaaugucccauaagcuccacugccacagggguccaugccacagaaaaaaauaagagcgacugacuagcaguagcuauuuuaaucacauagcaguaccuacaaggagugugugggauauuguguugugucucaaauuucaggagaacucagguguacagaaauaugcuuguggccagaagcugaaaaaaaaaaaggaucagaucagcacaggaagaaucugggaaaaguucucucaaguuaucaauuucaccucccacuauccaguucuuccaccaacaagcuaaaaagcagaaaaacaugggacggagaaaugcaugugaaucacaaaggaggucaucucugucagaauguuucugagucuuuccuccuaguggcaaauuuuuuugguugacaugaggcagauaggcauacuguugucauuaauaauuaauauucagccucuuuggaacacaccgauguaucuaauaaaaauagacccaggcaaaaucugugauggggcugucucuccccuuccuauuuauuccccuagcccaguauaugauaaaaacaaacagugaagauaaaagcaaugaagcuuugaugggauucuugaugagucagggaagagaggaagagaaaauucauuuuuuuucccucuguggugggaagagauuuagcaaagagaagcccaauguaccagugcucucaagagccuccaggcugugauuugggcucuaggauggaacugagcucacagaaguggguagcucacaggugcaccagggugcaugggucugagccauaaccuggaauccuguggcuacaccugggugcaucacacugccaagaggggcugucuucuccucuggugguggacugcucaguccaggcauccugggagcugccuuauugccccaugaacuguaaugcuguguuggcuuuaccuacaacugcaugggccugcugugugucaaggguuaaaugggaguggauauucaacccuggguuuguuugguagccucugaaauuaauaaggaagaccaggcaugguggcucacaccuguaaucccagcucuuugggaggcugaggcagguggaucauuugagguuaggaguuuaagaccaguuugaccaacauggugaaaacucgucucuacuaaaaauacaaaacuagcugggcgugguggcacacaccuguaaucccagcuacuugggaggcugaggcagaagaaaugcuugaacccaggaggcggagguugcagugagcugacagcacgccauuacacuccagccuggucaacaagagugaagcuccaucucaaaaaaagaaaaaauuaauuaauaaggaagauacagaaggaugaaugagagaaacagagagggaagugggaugcagggaguagggaugugugacgcacagccgagcauauuaaccaucaccucggggggcuaagugugaagaaaguaugggaggugcggucuuccuucugcagagaaagucgcgagccuuuuccuagccuggaucuuuugcuuuacaggcacuuagauggcacuuacuacuauaagagccucacagauauuaacucacuuagucauuaaauaaaggaguuaccaggacuaucuaucaucuuuguuuuacagacgagggaagggagacacagagaggugacaggaccagcccaagacaugcggguggcgagggguggcgucaaaacacuagacuuauuagacugagugauguccucucuggauuuugacguaucuaaggguguaaaucucaggugaaucagagcugcgauugcagguguguuucucccaccagcaugcuuucauaccgguccguggacauccggaagagcuugcagcuggaggaacuccuggcgagggagcagcuggaguacaccauagaggaggagguggccaagcagaccauccgcauguggcucaagaagugccugaagcgcaucagagcugugagugaacugcacacaugcagguuggguccccgccccgccccgcccugccccgcaggaggaugaaagaaaagagcuucgugaacaugggauuagcuccuucugugaucagccuucuaucccuuuaaacuauguccacuaccuccacuuacaguggucagaucaugaugcagacuuucacucuaguccacagucagcccugcccucuuuagcagaguccauuaggaguuuccauggaaucccauuuuuauaauaugacaugaagacuuaaaaagcaguuuauuggccaggugugguggcucaugccuguaaucccagcacuaugagaggucaaggggggagcucaacucacuugaggccaggaguuggagaccagccugccaacauggcaaaaccccaucucuacuaaaaauacaaaaauuaaccaggcguggcacacaugccuguagucccagcuacucaggaggcugaggcaugagaaucacuugaaccugggagguagaaguugcagugagcugagaucaugccacugcacuccagccugggugacacagugagaaucugucucaaaaaaaaaaaaaguuuauugauauuaaaauaugauguccauuuauuaaacucaacuguucaaaauucuagaauuuuccacauauugaauuugcaaaacuacuuuaaauugcugcuaaaaauuucaacaaacugugauaaugucauuuauucugaaaagaccaccucucaagauuaaugauguuuccugcuuccugacuuauaagccuauaagauucucuaacucauaaauuaaugaauguauacugcauugacauauacuguauuuacagugaauguuucuaugagauaauuacuuuuaugaaugcuuuuggcauguuucacagacagggaaaaaacccaaagcaaucacuaaacauuuauauauaacagagauuguuucaauccucuuccucagagcaacaacgucaauugcagacacauguauuucuauuggaggagaaaagguucccagagaaaagauacaacucaaccuccuauagcaaggccagcugcccagugaugucccaucacugcuggccacuguagcuauguuagcuccagggaucaaucuguccuccucuggcucugagagggcacaaggaguccuggcuuuaguauaugccgagacagauuggucuccuggauugaccugaaaacuucagaaccaagacaagcacaaagguuuucucauccacccaaggcucuuugccucuuacaacuugcaggaaagugggaaagggguugggauuguauuggcuuaaugagccuagaauaaaauaagaggagaaaaaauagaauagccacauuaguaauuuuaaauaagacauaagcugggcacagugucucaugccuguaaucccagcacauugggaaacugaggcgggaggaucgcuuaagaccagaaguuugaaacuagcuugggcaacagagugagaccuccucucugaaaaaaaaaaaaaaaaaaaaaaauuaauuagccagccacagucaugcacacuuuuagucucagcuucucaggaggcugaggcaggagcauagcuugagccuaggaguuuaagguuacagugagcuauaauaaucgcaccacugaacucuagucuacgggacauagugagauccuaucuaaaaaaaaaaaaaaaaaaacagaaaacaccaacaacaaaaagaaaaacaaauaaauaaaauacaagcaucaaugaccgucacuauucugauuguuacacaaaugaaaauggacugggaagucaaugcauaccucucuaagcccaccuuugcaucagccuaccuuaauugaacauugaaauuaguucaggauccuuacuuggaaauuccuaagaggucacccgucaugcaggucuuaggagaggggagaagaaaauaagauuuguguggcgguggggcaggcaggaugcugggcuuauuuuacugaacaaacaaucgcauuuccauagaaacagcagcagucgugcaguaucauccacagccugagagagagucagcagcaagagcugagccgguuucugaacccgcccagcaucgagaccacccagcccagugaggacacgaaugccaacagucaggacaacagcaugcaaccugagguaugggcacgaggcguccucugucccaggacacucugugggcuucuuucuuuuaauaaaaauaaauaaaaugggugcuggucagaucauucaaacaaggugacaauauuucuaauaggaauauuuucauuaaaaaaaaaaaaggcaacggaaauccauugauccagauuaugucuaugucuuugccaucuuggaugcaguugagguuauuuaaaaagagucugacucauaugaaugccaaaaaaagugaaugcccugaacuucauaauucuguaguuuuauuuuugucuaaagaguuaacaucagcucuaagggcugcauuugaaucuggguauauuacauggaguaugguuuacaggaagcucugcccuaaauauuuuccucccuucucuaaagucauagaaauuugcaguaaaaucagugaaaauguuuguaauuagcuuucaaccuccuuaaauaaucagacucauugaagauauauccuuuccugguuggguaucagaagaacauauggaauucaggacaauuggcuugaggaguuucuauuuauuaagucacagcauauuuucauuuucaaacucuauguaugugucuauauaaaaaaguacaaggaguuaucagcguccuggagaguccugugcugugagaagcagcuggcugggaggaccugccccuuuaugaggcagcaauuacgauuugagguuaacaacguggagcugaucccgugcucugugcagagcccccagcagcaccaggcuccauggugugcagcaacgcagccaggggccagaguaccuuuggaagccuaaggcuccacggcccagcagggugcuccaggaggcccacuggugccauagcucaguuuucaguagaucucauguuuugggcuccccagccuuuagaaaucaucugccaccgacugcagggacuucugcggaguuagucaaccaaggggcaaggggaggcaucugcaguggccuugccacuggucacccugaagaugguuggcaaugucucgcaugggagagggaggcaggcugaagucaggacagacagugagacagggcuaaugagguuggggaaagugaugauuucagagcccucuguuuuuagaugaaaaagccuaagaaagaaagaggugacaaaaaaaaaaaaaaaaggauacuaaagagaugugaagaccaaggcuuuuguuaggaaagggagaggugacaggugaaccugagaacaggugaaaugugugggaagucuuggcaucucucuuucuuucacuguagcuuagauuguuaucagcuccauccuccaccagggcccaucauacagcuuugccugcagagaacucuuucccugaagcucuaaguguggaucuccaggcuggugacaguagacugcccccgcccagcccguccccacugccccaccuuccuuccugcaguuccccuuccuuacccccugguuugccagcgaagauaugaagggaaacaaugacauucucaggcauggaggggaacgaagcaguggggguuacccaggacaagaugucccaggaagaguggugucuccuucagcagggcgugcagugguggcucuuuuucuucugugacccuuuauacccauuuucacuuuuccccauuguggacacucugaguccauguuguucuucccacuuguccuccugccauguguuuuccuuucuuauaguaaaaggaggagagcgcaggguuaaaaagacgguaacugugugcuucuccucccaugcagacaagcagccagcagcagcuccugagccccacgcugucggaucgaggaggaagucggcaagaugcagccgacgcagggaaaccccagaggaaauuugggcaguggcgucugcccucagguagguccauccaggcauuucuccagcgaucgaggcauuuuaaagguauuuacucuguuuguguguuuugggucuugccuuucaaaaugcaagucugcaucuacaguuguuuacagacagcaacauaaugaaaaauguagucuugucaaaaacauugucccccaaaauaacuucucuaaauaugacuuacauuagcccccauuuuccggguacauuucaggcuaucaugguugagaagccagcaccuaugaaaaagacaagauucagcaagagggagaaauuuccaagggcuuucugugugccucaaggcaugcucaaacaugggcaaaaguauucaacugaagagggagugggcagaugcaaucauucagaaaaugccacgaaguucucaaaaaagggacaggcccccgauuucucucagcacacuuugcagcugagccggucacuggcuuuaggcaagcugcuuuaccuccauacaauaacaaacaacaacaacaaacacuuacguaguacucacuguaugccagucacucuucuaagugcauuacuuguguucucucauucaauccuuuaauaaacagucccauuauuuuccauauuuuacugauucaguaagagaauuuucuucuaugagcuucuucucuauaggguuuuggaaagccaggauaaucccauuaagagcacucaggaauggagggagagcaaugcuccccacagcccaguguccuuguacauguuuuuuucuauagauaacuaaguucaugcuaaagcaggagcuuuauaaugcucuuuaacugugccccaacuucagcccaauugaaaggagaagauguguagcauauguguuccacaaagcagaugacagcacagcuuacauuuugaggcugacgauguucagugggucuucacugggacuaccaccaaggaaaguauccccuuucauauccaggaacuuauuuuucagagaucagagaagaucuagguuccuccugauucaaacacagcagagaaugacagcaucaagacaacguagaugguggugccaggucauaaauuacaagcugagucgguucaauuuuauccuguaggcaauuaggagcuagcaaagauuucugagcaguaugugacuuuuggaaucugugcuuuaggaaguugacuuggcagcaaaggagggaauugucuaugacagagccuggaggcagguuacaagcuggaggaaguuaccguggugugagcacaaggcaacaaaggcauggacagagcugggggccagauacugcagggacagauaggagaggugaccuggggagaaugcacaguccuugguauucauuuaaauggacaaaagaaaugaugcugucaaaaguacuuccauugggccaggcgcaguggcucaccccuguaaucccagcacuuugggaggccgaggcagguggaucauuugaggccuggaguucaagaccagccuggucaacauggugaaacccugucucuacuaaaaauacaaaaauuagcugaccgguaguggugugcaccuguaaucccagcugcuugggaggcugaggcaggagaaucacuugagccugggaagcagagguuguggugaaccaagauugugccgcugcacuccugucugggugagagagugagaaccugucucccaaaaaaaaaaaaaaaaaaaaaaaaaaaaaaguacuuccacugguccaugccuaggugguccccaccaaaaacggugaucgugaaauagacaugcucuuggggucaggcugaguuugaggaggcagaggagaagaaaaauaguauuuugagggggcagcaacaaugucacaggugucaugcuaugcacuuuccuaagucaucucauguaaccuguuuuaauccugacaauagucuaauuaggacauuuucauugucuucaucuuacaauggaggaaacuuggguucagagacgugaaguugcccauagcuacauauccacagguugcagaggugggucccaacaccaugacugugaggccccagaaccacaccuuuccucccauacccucacugcauccccccucgccuuuacugugggucacacucuccuuccuuuuuguuuuuuuuauugcauaugcuaaugaaugcacagguuucugugacacuuaauaguucccgaauuggaauuuuuuuagugauuuucuaguuuuuuuaauuauuucaaaaugaaaggggugagcagcacguuuuuuucccaaaugacaucauuaguuguccaugagcacaauuaaaaaaaaaaucuaucgugaacauaaagaaucaaguccugaaaaggauguuuacuuagcaucuguggcuaggacacguuagccaaaaguaucacugaugggaauaucauggguuuuuaggagugauuacaauagggugaagcaauaccaaguggcucauaggacucauuaauuccacagccccaaaaccaauaagccauucaguguccucagucaacuuacgguuuggaggaaggacaaccaugaaaucugucgugugcaaaaugaaccccaugacugacgcggcuuccugcgguucugaaguuaagaagugguggacccggcagcugacuguggagagcgacgaaaguggggaugaccuucuggauauuuagguggaugucaauguagaugaauuucuagugguggaaaccguuuucuaauaauguccuugauuguccagugagcaaucuguaauugaucuauaacugaauuccagcuugucacaagauguuuauaaauugauuuucauccugccacagaaaggcauaagcugcauguaugauggguuacuaucaaucauugcucaaaaaaauuuuuguauaaugacaguacugauaauauuagaaaugauaccgcaagcaaauguauaucacuuaaaaaugucauauauucugucugcguaaacuaagguauauauucauaugugcucuaaugcaguauuaucaccgccccgcaaaagagugcuaagcccaaaguggcugauauuuaggguacagggguuauagcuuuaguucacaucuuucccauuuccacuagaaauauuucucuugagagaauuuauuauuuaugauugaucugaaaaggucagcacugaacuuaugcuaaaaugauaguaguuuuacaaacuacagauucugaauuuuaaaaaguaucuucuuuuucucguguuauauuuuuaaauauacacaagacauuuggugaccagaacaaguugauuucuguccucaguuauguuaaugaaacuguugccuccuucuaagaaaauugugugugcaagcaccaggcaaagaaauggacucaggaugcuuagcgguuuaaaacaaaccuguagauaaaucacuugagugacauaguugcgcaaagauguuaaguuucuuaagaaaccuuuuaauaacugaguuuagcaaaaagaauaaaacuauauagcucaauuuauuuaaaaaaaucuuugcaugugugauguuaucauuggcuucauuucuuacccaagguaugucuguuuugccauaaaucagcagagucauuucauucugggugauccuaacacaccauugcuacguuagauuugaaaugacaucucuguuaaaagaaucuucuauggaaauaauggugcccugcaaaaucuuccuuugaacucacagguuagggaucacacaacuuacuuaaucguuuuuuguuuuuguuuuuuuuccuuauaugucaauggcccauguccuccgggaaaauuagaaaagcaaaaugauuacaaagugcuguuagauuucuugugcugggccagccaaguagaaguggacuugacuuggaccuuuaacuauuuuauuacagauuggacauuugcuguucagauguuuuuuaacagagggauuaucucagaauccugugaccuccagguuguuuuauaaucuauuuuucucuauuuaacauuccucagauagauaggcaaauaggacauuccuucugugucacagaaguaucgugguaguggcagucuacaguuuauaugauucauuguaacuaugagauaaagaacaaccagucauguggccaaaaggauuagauuugauuugauguucacuuggaguuuacuuuuuguacauacaagauaaaauaaauauuggauuuguaaaau

SEQ ID NO: 192527 - RNA, 3958 nt, Homo sapiens
gggaggaagcccaagagagauuuaaucagcaggguuucuuuauaagugaauguucugaagcugagaccugaaggguaaauuaggaguuaaaauacaagaugagaguagcaauuagcuagcacauuauaaagccauuccagguuacaaguaaaagugauacccuuccaaggccagguuaagaaccucagauguuauucuaaacacaguggagaauuauaauuuaaauagcaugacuuggcuacaucacuauuuuauguagcuguuccagcaauucauguucccuucaacugccccugcccucucacucagcaguccaguugacuuugucccuucauuuuaaaaaaacaaaaaaaacccccaacccugucaauaaaccacgaaaacuaggaaggcacgacagcaaguuucagugcuuuaacacagaaacacccaauuaccaaguugagggcuaaaaaaauucgaccaaguagucccacaucauugccuuuagucuacaaaucucagggauuauacuugauuuuccuuuauuuccugcucaaucuuuacuugcacccaagcccuacuuuuucucaaaccuauuuacauauucuuaaguugacucacaccuagcaggcuuuuuucacuuagcuagccaccuuacacacagcccacaagucaggugugccaagugagcauuacagauacuaggauaagaucaucuuuugaaaaacagaagccaccuaaacuccuacccauacguuuccagugguacucccaagcucuaugugacuaauaaucaucccccuagucaugacagcauagcagaugaacauguugcuaaagguaauuuaaacaucauacucuuucaaauuuacucaaacaucuaaaauacccaccuaugccacaugagcugugcuauuuuaaucugcuauauugucuuccagugcccucugcuucaaggacuccuggaauucugcuuguuucucauugccuuuaaccguguuacaaacccaguccaaaaguaaacauuccaaaacagucacuuaacaaguaaaucugauaugaagcuagcccagucccuaaaccuacaguauuucacugauacuacaagccuaauugauuaaaaauaccuuaccaaaaccagauauguauuuuuuaaaaccagaacauuuauugcaugacuaaucguugacauucuuaagaugaacuggaugcugcaacagcugcccucuuggguuuagguguuguuccuucacggaauccaugccugcaggaugucaaaaacaagaacaaguuacuucagcaacaucgaugcauacauuuuaauuuuuguuaaacagauuucaaugcgcuuaucucaguuaaaugcugaaaucaauacugcauucauauguucagacauuuauuuuuacaacaucacugauaagcugaaauucuucacuuugcuuaaagauacccauuuucggauauaguuaacugcaacugcaauaaaggcucaaaaacuuauuuggcuauacuagucauugggccaguauguuuguucauauuuggcaagagaucacagauuauuugugaaaaugguucccuauacugagaauagaucccaacuacuuucacuaagcaaggaaaaaacaauuagcauguuuaauggcagacauuuucuaaaccaagagcuuugcauuuuaacuuauuuaacaucuguaucuacucuaagaaguaucuacucuaagaaaggucaacuauccuacuuuuaaaagccuggcuucaguucaagcucuuaacuccuauauuguacuaacagaccacucaacauuaagcccacaaaaacguuaugacccuaaaugcaaagaaaguugcuucagcacaugaacacaccuaugggugucuacaaagcccugaacugucuugcuaucuuuaaaacuggacacuccggagacugaguggguagaggcuagggauucugcaaaauauucaauuuugcacuggacaaucccaccacaaagaauuauccagcccaaaguaucaauagcugagaauugcugaaauagaacauaguaacggaaggagcaccagcuuuauaguuaagucugcaucauucugaaucuuagcugagaucuuagauggguuaaucucuuagaaacuacucuuuaauaugcagguucucucagcuaagucuacggcggagcugagauucugcauuuauaacucuaaggccaagacuugaguaacaagagcccaaggcaacagcagcaaccagggcaauuuucuacagcacucuugcccacagccacuauacuaaagguugaaccaagccugacuccagaccuuauucacuacugucuugacaaauuuugacaccaauuaaaccuaauaaauaucaacacuuugggacccuaguucaaacaaugcuccuguuauuuaauuuauacuacuguuuagugaaaaaacuacuaauaaaauccaaacuaacugaugucaagguuacagcggcagaagauaaaagcuuucaacaucuggccugagcccaggaguuccgagauuauccuggguaacaugacaauaucccauucucuacaauaaauacaaaaauuagcugggcauguggcagcgcacaccuguagucccggguacucgggcggcugagaugagauuaccugaggcuggggagacugaggcugcacugagccgugaucgugccacuacacucaagccugggcaacauagugaaacccugccucaaaaacaacaauaaauaaaaagcuuccaacaucucauccccaguaaccaucaggguacuguuaucuuuuuacaaguaaacacgaggguuucauucaagcccacuggaccaauuaugaucgaacauacaaacuguaccugaaucugcgguauacaauuuuuaggugccucauucgaccaguuccggugguauuucgucuuuuagccuuggcacuccaguuaucuaaaacauaaguucagaaaagauuucaaacgguguucucccacacaccuuguagguguuguuaacacacgaguuuuaugccaccucaucggcauacagauguacgaguuuuaagauaggcaccaaauaaaguucaaaccuaugcccccacuuaagugcaauacaaacaaaagcuaacacaguuggccugaaaaauguuacuuacacuuucucuugcgcuuggcaggguagccacauuugccacaggucgacuucugaaggugguaggccuuagagccacagcggcggcacaacgugugcgucuuauugcgacgcuuuccaaacgaugacguucccuucgucugcacauuaaaggaauaaauaguucugaaaccuggcaacuucuagauuuacucgaguucuccgggaaaccaauuacugauaaaauuuaaaggcaaucguaaagaucgaaacugcgggagaagccucuuuccacgaaugccaagucagagaccacuacccgcauuucacguuaccuaaaacccuccgcaagaguugcaauguucugaaaugcaccuuaucuuuacagacuccggccagagagcaucaccaaugaauuauuucauuguuacacagagccaaacauucccaaacuccuucccucggcucccaaccaaggcuagagccgugaaaggucuccaaagguuggaccgaggcaaaggacacaaugcggcucuagcaccacaauuacggcgggauaggucccccaggcaccaguuagcagucauucuucuggcucuugagggccaccgcaugccucuuuccagcccaccaguuccccuuauccggaaucuugccagccccccaagcacagcaaacagagaggcacaaaggacgaggauggaacgcgauucacaaacaccacagucacaacucaccaucucgcuucugcggccgagaccagaaagaccggaagagaaggcacuuccgcuauaucacgcucagaagcuuccgcccagggaagcacuuccugcggggcgc

SEQ ID NO: 192528 - RNA, 38817 nt, Homo sapiens
agcgccaugcgcagacucaguuccuggagaaagauggcgacagccgagaagcagaaacacgacgggcgggugaagaucggccacuacauucugggugacacgcugggggucggcaccuucggcaaagugaagggugagaaccccgcgggacuaggcuuggccccagcugaggagccgcacgacuuccgcuuuccgcaccucuucauccucccccgcccgcugcgucccuucuuuccagggcugggcagccccugucccggauccugcgggagcucuccccagccgccgcggggcugcggcgcggccagcacaggccgggugggggugggggugggguaggggccagucgccauggcgacggcgccgcggccugaggggcugguagguacgaggggcugggaugcgaaggugcaaacuuucccagguggggcaggcgggcggcgcggcgcgcucugggugcugggagggggcgccgggcgcgauccccggggaggcggcaucuugugcgcccggguugugcucccuuggcucagggccagcccaucgcuuccuuggcgguccuuggcguugucgguauuuccguccucuguaggaggcugucgauuuaccggccccugcuguuucccgagugcgaaauguguuuccgcagaaguaagguuucuuuguggguagccgacaucauuuuuuuuaaagaccaugucgucggaaaggaucacugguuuccuucggagcaguuaaugaguauaaacugguucaguauuugcgaugcaugguuuacguucugaaugagacugugccuuuaguguuuccgaauuaacaggaguuucuccgugcgaaacuucguuguuaguucagauguugccuccagauaguauuuauuacuuuauuaguacaguucauuuccacuuauuuucaaagguuauuuguauucuaauaaacucuuuaagugcacaucauucgaacuuuuguuuuaagaaagguguauugggugcauuguacagcauucgggugacggguacacuaaaagcccagacuucaccacuaugcaguucaucuauguaaccaaaagccacuuguaccccuaaagcuauugaaauuaaaagaaaaguguggacucuuucaaaacacuauucuggaaauaaacuugcucuacaguccaccaauucuggcaaaaaaacguuuaauugcaaguuuuguaaggcaugauuuuuuuuuucuuuaacauauuugacuuuguuauaagggaugcagagaaaggaaguuuggaacugauaaaaauaauucaugcauuggcuuuggauaaauaauagacugacuugcauauacuaaguucuugguaaauauuugacuugaaagaaaaaaaguuugccaaagucuguacgguaacucaacugagccuuacucuuccagagcuaaauaaacaguuucugauuuuauuuaggguuagaagagaagaacgcuuccuucucuugccauuuucugagucauagaauuggaaaauuguuguauaucccacagggaagcaacugccugaaccuucuuaugaaaaucugcaaggcggacaaugucaggaggaaguaagaagcaaaugccagaauuggguaauaacagcuauuaggacagguccauauaaggccaguaagauguuucugugccauggaaguuuuaacuuuaucuuuggcuaugauauuucuuguuagcaauuacaaacugcuuuuuaguuuacaaguguuuguaaaaaaaaaaauguucauuuuugcccccaucccuucccagaguucugccuggauuaggguguucaucauuccccuaauauagacuugaaugcuugaauaaagucaggucuauuuuuuuuucuuuuuucuuuuuucuuuucccgagauggggucuugcucuguugcccaggcuggagugccguguggugugaucuuggcucauugcaaccuccgcuuccuggguucaagcaguucuccugccucagccuccugaguagcuggaauuacaggcgcccaccaccacacccggcuaauuucauauuuuuaguagagaugggguuucaccauguuggcccggcuggucucgaacuccugaccucaggugaucuacccaccucagccucccaaagugcugggauuacaggcgugagccacugugcccggccaggucuguuuucguauuugcuaagugguuuuuggcauggcagguaguaaagcaggaagagauuuuucaucuucuggauuugaucugugauauggcugugacacgaaugucuccagugacuuugcuguuucuuaaccuucacuuccccacccacacuaacuucucuuggaguaccauauucuguuaaagucaacaaacucuccaaauguacaaaggccaauauuaguccaaggaucauagguuucauagauaugguuaaauuuguucaugaucacauuuguugauguugaucagaaucuuuaaccuguucauuuuuuaaguuaacaguugggaugcuuuuugccacaaguaauagaaaaucuagcuuugccuaguaaagaacuuaucugugguucucuuuccacagauaaguccuuccagcagggaaggccagcauaucucuuaugagucucauuggcucauccagucccucuggcuaggaaugccaugugccaguuggcuuaugcuuguauuccuaagcaggcauuagcaagggggauggcauugcccuuggaggaguaugacccacccuuugaugugugugugcaacagaggugggugggugggagacaucuuuuuuuuaaaauuuguuuuauuuuuuaaauuuuucuuuaaguuauugggguacagaugguauuugguugcaugaguaaauucuuuaguggugauuugugagauuuuggugcacccaucaccugagcaguauacauugcaucauauuuguagucuuuuaucccucaccccucucccacucuucccccucaaguccccauaguccacuguaucauucuuaugccuuugcguccucauagcuuagcucccacauaucagugauuagaacauacuguguugguuuuccauuccugaguuacuucacuuagaauaauagucuccacucuuauccaagucacugcaaaugcuguuaauucauuccuuuuuauggcuguguaguauuccauuuuguguguguguguguguguguguguguauauauauguauacaccacaguuucuuuauccauacauugagugaugggcauuuggauugguuccacgauuuugcaauugugaauugugcugcuauaaacaugcaugugcaaguaucuuuuucgaauaaugacuucuuuucagaagagauugcuggaucaaaugguaguucuacuuuuaguucuuuaaggaauaucuacacuguuuuccauagcagcugugcuaguuuacauucccaccagcaguguagaaguguucccuguucacccuuuucaacaaauugugcugggauaauuggccagccacauguaggagaaugaaacuggauucucaucucucaaccuuauauaaaaaucaacucaagauggauuaaggacuuaaaccuaagaccugaaacuauaaaaauucuagaagauaacauuggaaaaacccuucuagacauuggcuuaggcaaggauuuaaugacuaagaacccaaaagcaaaugcaauaaaaacaaagauaaauagaugggaccuaauuaaauugaagagcuuuugcacaggaaaaggaacagcagaguaaacagacaacccacacagugggagaaaaucuuccuaaucaauacaucugaaaaaguacuaauauccagaauccacaaugaacucaaacaaauaaguaagaaaaaacaaauagucccaucaaaaagugggcuaaggauaugaauagacaguucucaaaagaagauauacaaauggccagcaaacaugaaaaaaugcucagcaucccuaaugaucagggaaaugcaaaucagaaccacaaugugauaccaccucacuccugcaagaauggccaucaucaaaaaaucaaaaagcaguagauagauuuuagugugcauguggugaacagggaacacuuuuuuuuuuuuuuggagacaguuuugcucuugucacccaggcuggagugcauuggcgcaaucucagcucauugcaaccucugccucccagguucaagugauucuucugccucaacuucccuaguagcugggauuacagacgugugccaccacguccugcuaauuuuuguauuuuuaguagagaugggguuucaucauguuggccaggcuggucuugaacuccugaccucaggugaucccacccgccucggccucccaaagugcugggauuacaggccugaaccaccgugcugggcugggagacaucuucuaaguacuuggauaguguggggggacaggguagacaccuacacauaaauggauguuguuaggagagagaaagggggacauggauacucagugaacacacagaaauggccacuauuguggugauguugguaauuaaacaccaacagccuuaauuaugcaagaauucuugcaaauaauaggguuaaccauauguuuagacaauuuggaguaaagaaagcuuuaaaaauuacuuauacauauugguaaauuuaacaugaagagggaucuaauaaaauauaugauauugauaugcagaaaaagucuaaguaugauauuccaugcuuauaggaaauuuaauuuugcggggagaguaggcuggaaguucggagugauuguuuccuguuacaggccaaaaaauuuguuugguuacuuagugguagcauuuugagaggaaaguuuacagaaaacuaggguuauuuugugauuaugcuugaauugucuuuauuguuuccaaggcaucuuuuuuuuuuccuucuaguuaucaagauguuagguucugugcccuugugggccuucccucugcccaaaaaaagcauggaugagcagaguaauaucauuaaaauggcagucuuuguuaguuuuucuagagaagauggucucuuugguaggcuggguguaucuucggcaaaugaguuauuuauacauauaaacuauuaaguuggcaaguauuucuuuuuuuucuuuuucuuuuuuuuuuuuugagauggaguuccacucuugucgcccaggcuggagugcaauggugcgaucucagcucacugcaacuuccaccucccggguucaagcgauucuccagccucagccucccaaguggcugggauuauaggcgcccaccacuacgcccagcuauuuuuuuuuuguauuuuuaguagagaugggguuucaccacgucggccagguuagucucgaacuccugaccucaggugauccacccaccucagccucccacagugcugggauuacaggcaugagccaccaugcuuggccuaaguucguaaguauuucuguguaaaacugcaauuucagcuacauagguacuuugugaaugaaucauaguagaaguuauuuaaaaauuccuuuaaguaaaaauuauaaacaugaacuagagcuauauauaucagugugaaugaaucuuaaaaauauaagguuagaccucgaaagcaaguuguauaagaauauguauaguuugcuguuauuuauauaaauuuuagaaaccuacagaaccacucauacaaugcugguagaguauaaauugguauccuaccucuacaugagagagugacagcauuuauuaaaauuaaccuaacaauucaacuucuaggaauuauuuuauagauguacucguguaugaaauaauggguuauucgcugccauauuguuguaaauauuaauacaaaacuuucgaaguaaccuuucuaauaguaauaguuaugguuuauccauauagugaaauaccuugcaaacauuaaggaagaaaaagggaggaacuuuguauauuuuagagaacaauuuccaagguguauuuuuaagaggaaaaaguagaacaguguguucaauaugccuaccacuuauguauaaaaggcaggggcaaaucuguaucuuaaaugugacugcuuuuauauauagaguaugucucuuuaaagauacacacaagacugguuacguuaguugcucaguauaggggacuagguaaaggaggacauuguguugcaccauagaugcuuuuguacuuuugaacuguguguauagugcagguauuguguuaucaaaauauaugcaaugacauuuguaaaaauaaauaugaaaaauaauguuacuauauuuuuuauggauuccuacccauguaaaaauauuuaaacgugggaaacacaaacaccaaauucaggauagugguuacuucugaggacagaugaaggauaagggaaucugggaggagucaugcagggcuugaguuguauuuguaauguuuuauugcuuaagcugaugguggcucauggguauuuggaaugcccuuggugugcuugaaauguuuguuugcuuucuuaaauuacgaucuauagcuuuuaaagcccacccuuccccaggauuaagcuauuuccuuaacacguuuuuauucuuucaauuuuaaagugggaaugaaaugguuaggugucuagaauaucuuuaguagauauuucuaucuuugcugcuucucuguccuauuaaaauccucuguuucaaaguaugaucuuguuucccuucaggauuauauaucuaauuagaagagcauuuguuacaauguuaugcaguuagacaaaguucccuuuagauagcaauagcaugguuguuagcuaauauuuaguugacuaaucugcuauucuugugagggggacauugugaaugcugguaauauuugcucugaguaaugugcaagucuuccguggccaaaauaucugucuuccguuucauuuaaaagcaaaaccuuagcacuauucuaaaaacugacagucugaagaauaaaguuugaauuuugaaaaaggggggaaucccuuaguagugcauaugccugacagaguccauuuacuacauucauugauugacuauggaacagcauuuaguuuggcuacaacugaguuuacucacuggggagaauauuuagccugguuuugagaaaacaguuuaguuucugauaccaugccaagcccuuugucccucucacugcacagugaugguggggagaguggauaggucaaaagacuugggagucggaagaccugucccaacuugaucacaauagcuuuacuuccacaacuuacagaaucucuuagagccucaguuucuuuaucuguaaaagacaauaccuccaucauagguuuaugcucaaaugugauaaugugagugucuccuaagcuauuagaugccauauuuuaaaaaguauuaugcuacugaaggccgggugugguggcucacgccuguaaucccagcacuuuugggaggcuaaggcgggcagaucacgagcucaagauauugagaccauccuggccaacauggugaaaccccaucucuacuaaaaauacaaaaaucagcugggugugguggcaugcgccuguugucccagcuacucgggaggcugaggcaggagaauugcuugaaccccggaggcagagguugcagugagccgagauugugccacugcacuccagccuggcgacagagcgaggcuccaucucaacaacaacaacaacaacaaaaaaaaaaaaaaagaaagaguugacuccugauagacuaugaaggcugggauacaaauucaaaaagcggaaaaccacacgagcuggaacacuauaggcugggagcaaaaagcccuauccugcuaaauaacucccacugcugucacugugugaggguauaaggagcaguugauacucauaaguuaacauuuguuugguucccagucuucauguacauguguuccauuuaagaagucaugaucauguguaguacaauuagaaaaccuguuuucaaaaaauauuacuucuguuaacuuguuaauuuuaauggugaauaucauaguuuagaaaauccacccuccuuuucuugucagggacugagugugugguccugcuccuguuauguauggaggcaaagggaaagggcuccggcccccucaaaaucaugucuuuggugccagccgguucuguucucagucaccuggauacugaacuuuccugagcagggcagaacugagauccagugggcuucuccccaggaugcuuacgcuuuuucauuugauuucaggucuccucuuucgcuuccuauugcaaccaaugaaggccauuccuaccauaaguaaauaaaaaagaaaaucuaucuuuaauaaauaacaauuguauauauuuauggggcacaaugugauguuuugauacauguauacauucugcacugaucaaaucaggccaaguaguauauccaucuccucaaauauuuaucauuucuuuguggugagaacauuuaaaguucccuuuuuuaacucuuuugaaaaauuaauauauuuacuguaaucaugaugcuaugcaauacaacaccaggauccuguuccuccugacuguaauuuuauguagccauugaccaauaucuuccuuuuccccuccagccccacuuaccccagcuacugguaaucaccauucuacucucuacuucugugaguuugacuuuuuuagauuccaaauauaagugagucucagacaccucugacauacugauuucaauuccuuuggauauauacucaguaaugggauugcuggaucauauaguaauucuauuuuuaguuuugugaggaaccucuacacuguuuuacaaaauggcuguauuuauaguuucaccagcaguguauaaguguuccauuucucugugaccuugcuaacacuuaucuuucaccuuuuugauaauagccagucuaacaggugugaggugauaccuuauuguggcuuuaauuugcauuucucuuaugauuagagauguucagcauucuuucaucuaucuguuggccauuuguuugucuuuuuuuuuauuuuuauuuuugagacagugucucacucuguugcccaggcuggagugcaguggcaugaucauggcucacugcagccuugaccuccugggcucaagcgauccucccaccucugccucccaaguagcugggacuacaggcauacaccaccacgccuggcuaauuuauguauguuuuauagagacaaggucucacuguguugcuuagacuggucuuguauucuugggcucaagugauccacccgcgucggccucccaaagugcugagauuacaggcaugagccaccaugccuggccggauauuagcuauauaucugaugcaugauuuguaaauacguuuucucagucuuuggguugucucuucacucuauuuguuuuugcuuguuuguuuguuuuuuugagaugcagucucccucugucacccaggcuggagugcaauggcgugaucuuggcucacugcagcguccgccucccggguucaagcgauucuuuugccucagccucaugaguagcugggacuacaggugugcaccacuacgcucagcuaauuuuguauuuuuaguagagauagggcuucaccauguuggucaggcuggucucgaacuccugaccuugugauccgccugccucggccugccaaaguguugggauuacgcgucuggccuguuuguuuguuuuuugcuguucagaagcuuuuuaguuugaugucaucccauuuguuuauuauugcuuuuguugccugugcauuaggggaucauauacaagaaaugauugcccaaaccugugucauggagcuucucgccuaaguuuucuucuaguagauuuguaauuucagguccuaaauuuaauccauuuuaaguugauacuuguuaaggggugagauaaggguccauuuccauucuucuguauguggcuauccaguuuuccaaaugacauuauugaagagacuguccuuuccacauuguguagucuuggcaccuuugucaaaaauccauugauuauagauauaugcauuuauucugggcuauccauccuauuccauugguggacaugucuguuuuuaugucagugccgugcuguuuuaauuacuauagguuuguaauauauuuucaaacaugguagugugaugccuccagcuuuguucucuuuggaccuaaagucuauuuugucugaaauaaauauagcuaucucuguucucuuuuuguuugcauuuguauggaauaucuuuuucagucccuucauuuucagucuaugaguguccuuuauggugaagugagucucuuuauaggcagcgcagaguuggaucuuguuuuuuauccauuuagccacucuaugccuguuguuuggagaauuuaaucuguuuacauuggaaguaauuauugauagguaaggacuuaguagugccauuuuguuaauuguuuucuaguguuucuguagaaccuuugucccuuucucuauuacuuucccccuuuguggcucgauugcuuucuguagugguccacuuuggauuuuuucuuuuuaucuuuugcaaaagcaaaggcuuuugcuuuguaguuacccuguggcuuacacaaaacaucuuauaacugguauauaagcugauaacaaguuaacuuugaucacauacacacauucuacauuuuuacucccccucuuccauguuuuauguucaugaugucacgauauacauuuaaaaaauaauuuguaucuuuaacaaauuauuguagcuuuauuauuauuauuauuauuauuauuauuuugagauggaguuucacucuuguugccgggacuggagugcaguggcgugaucuuggcucaccccaaccuccaccuccuggguucaagcuauucuccugccucagccucgugaguagcugggauuacaggcaugcgccaccacgcccggcuaauuuuguauuuuuaguagagacgggguuucuccauguuggucaggcuggucucaaacucccaaccucaggugauaugcccgcuucggccucccaaagugcuaggauuacaggugugagccaccgcgccuggcuagcuuuaacuauuuuuaauaguuuuaucuuuuaaccuuuauacuagauauauaauucauuuacuuaccaccauuacaguauuaguguguuuugggguugacaguauacuuacuuuuuccagugaguuuuauacuuuucauguuuuccugucacucauuagugucuucuuuauucagcuugaagaaguuucuuuaccauuucuuuuucuguuucuuuuuguuuguuugagacaaagucucacuuuguugccuaggccagagugcaguggugagaucuuggcucacugcaaccucugccugcucuguucaagugauccuuccacucagccucccaaguagcuaggauuacaggcgugcaccaccacuggcagcuuuuuuuuuuuuuuuuuuuuuuuuuuguauuuuuaguagagacaggguuucaccauguuggccaggccaguuuugaacuccuaaccucaagugcucugccugccucggccucccaaggugcugggauuacaggcgugagccaccaugccugaccacuguuuuucauucuuuauccuuuuuucuucuucagauuguaugauuuccaguggccugucuucuaauuacuaaucuuuucuucugcuugauguagccugugguugaaccccuuuauugaauuuuucaguucaguuauacuauuccucagcucuaugauuacuguuugguacuucuuuagaaaauccacuuuucaacugauaaacuaacuauauccauuucuagggcugccguaacaaugccacagacucaaugacuuacagcaacagaaaauuauucuuugccaguacuggaggugagaaauuugaaaucaaagggccaucagggccauguuucuucugaaggcucuaguggagaaucuguuccuugccucuuccagcugcugcugcuuuuuuuuuuuuuuuugagacggagucucacucugucacccagaauagagugcaguggcaugaucucagcucacugcaaccuccgccuccuggguucaagugauucuccugccucagucucucaaguagcugggacuauagguguguuccaccacuccuggcuaauuuuucuauuuuuaguagagauggaguuucgccauguuggccaggcuggucucgaacuccugaccucaggugaucuccccgccucggccucccaaagugcugggauuacaggcgugagccaccgugcccagcccucuuucaccuucuuguggcuccugauguuccuugguuugugauagcauaacuccagucucugccucugucuucaaauggcugcgcucgcuugcucucucucucucucucucucucucucucucucucucucugugugugugugugugugcucuccucuucuuguaaggauaccaggcauuagauauagggcucacccuaaauccaguaagauuucaucuucaaauccuucacuagucacgucugaaaagauccuauuuccaaauaagauaacaaucagagauucuggguugacauagauuuuguggggacguuauucacuucacuacacuuguuuuuauauuuuguauacuuuuaguuuuaugcuuucuuucuuaguuuuugaguaacuuuuaaauugguuugauagaauguauuaguaaaaugucugugggcugggcgugguugguuaaugccuguaaucccagcacuuugggaggccgagggggggcggaucaccugcggucaggaguucaagaccagccugaccaacauggugaaaccccaucucuacuaaacauacaaaaauuagccgggcgaggugguaggugccuguaaucccagcuacuugggaggcugagguaggagaaucgcuugaacccaggaggcggagguugcagugagcugagaucaugccauugcacuccagccugggcaacaagagcaaaacuccgucucaaaaauaaaaaauaaauaaaauaaaauaaaaugucuguggaauccuaagacauugaaauugauaugaggcagguuuucaguacacuggauucauguucugauacaggaaggaggucauaguagcagugccuggcacauaguaggugcugguacucaaauauuucuugaaugaaugaauuuguaugauugaaugcauuucuggauaauucuuauuacuacaaggaauucagucuauucuuuucaaaacuguauauacauuaagaauuucucugauauguuuaacuuccauuuauguuuuauuaaaaggauguguauuuuuacaugucuucugaggauuaucuuuuuaaaaaaaucaaauuucacuuaaccauguucggaaaaagcauaacuuuaagagucugaccuggguugaaguuuuggcuuuuccacucauuagcuguguaacuuugggcaaguuauuucaucuuucugugccucaguuuccuguaaaauguugcuaauaaugccaagucuuccagguuggugagagugugucaguauguuuggguacaaagugaguaugcugcaaauauuaacuaguaaguuguauacuuuaauuauguauuguaaaggaacuagauuuauguuguaaaaaauuguuuuuguuaaaaaaagagcccuuguuuauuaaaacucacaucaaauuaagcugcuuuuuuccucuguguucuucugugaccaaacaaguguuccuguaguaggugaaaucacugucaaggauugguguuauguguauauaugucugauaguaaucuguugaacauuaaccaaagucaggaaaugaguugaacuuuggaagguagaaaucugaggauuggugguagugguggugggguaggagugguggagcggguuggagggauugaaguauaugggaaugggagcuagauacauuaaaaugacagcuauuauuuauuuagcacuuauguaccuggauaaaggaaugcuauugcaucuacauggauagguaucaccaaucagagcugagauaaaacuggcuauucagagauuaaaacaaauaauucagggcugauuagauacagaugggggaacaggucugggagcaguggaaaauaaauaacccuaaauaauaaaggcuaccauuuauuuaucaaucacuugcuauaugccaggcauuguggaaagugcuuuacaaacacuauuccauguaucuguuauagucacccuuauggaguaugugguauucuuauuuuaaagaugaguaaauagaagguuguaguuucuuuaacuugcccaagucaaacaucuaguaaguaccuucaaacaggaauaaaaccgaggucugugcgacuauaaaaucuaugcuuuguauacauacugcuuucacaugugcaauuggaauuagggguucaacccuauucaacucuacuuccaaaaaaggugaaucugcuaauacuacuuccaauuguuuuuuuccccuuuggaaauuuuuuuuuuugagauggagucucgcucuguugcccaggcuggagugcaguggcaugaucuccgcucacuguaaccuccgccucucggguucaagcgauucuccugccucagccuccuaaguagcugggauuacaggugcgugccaacacgccugguuaauuuuuuuuguauuuuuaguagagaugggguuucagcauguuggccaaacuggucucgaacuccugaccuugugauccacccaccucguccuccaaagugcugggauuacaggcuugagccaccgcacucggccuuggaaauuuuuuuucuaacugauaagaauacaaagcagcaaguaaaauucaaaaaggaucacaguggaauaacuuuucauuuuagcauauuaacauuuuuauaugauuuuuuuguguagcuaaaaaauguaaaaugcauauauaauuuuuuuuuauguuuguaagaacauuuucuauaguuuuccuaugagagucuguuagguuggaauaacaauguauuaaacuguucucugaaauuggucagccuuuuguucuuacauaauacacuguaaugaacauauuuaugcacauuuuuuucaucaacuuuuaaaucaaauucuuagaaggaaaacuacagauuaaaaaagaaaagauccugaucauguaauuuguguguguguuuaugaauuugaaugaucucuuggcauggcugucagggcacugccucuauuccugccacugugauacgaucauacuuuugugauuucuucuauuacuucaaaagggaagaaguuauaccaccauacuuuaaaacaauuaauuuauaauuugaugaaaugcucaaguauuagaaaaaaguuuuaugguauaucuugauugguuauggauuuuguucugcuuauuaugccuucuuuugggugguuggggggcuucuguuauuuacagguggauuaauauucugcuccguauuacucaugaguuaaauuauacucaauucccuauuccguaguuaccaccuucccuccuauuuuugcuaauuuccuccucauuuuuuguuguguguucuauaaaauuucccaucacauuauuauugcuacuaccuacuguuuucuaaaugauuuuaauuguauuguaaaauucuucuugcucugcucuaauuucauaccuccuauauuuucuuaucacucugaaaauaguuaauaaauuuugcuaauacaaucaugcauuucauggaugaguuuaaugucuauucauuuuuuuguuuuauucuuuuguauuauaagacuuuuugcuuuuucucacuuuacuguuauuuuugucaucauuacaggccgggaaggucccauagcccagguugcuuuuggucaauacuguuuuccccagcagcauuaacuggcauguaggagaugcucaguacauaaugccaaaauaaugaauuugagagaaugcuuugaauuccuauuccaguuccuuauuaaaugacaggauauauguccagaguuuuggauaagcuccagucauuucuuaaaguuaauugggguugaaguucaguugagcaggguaucauaggaguuugguugguuugugaugguuugggaguucaggcccaaauuggauucugucuuaguauucuuuccaggucuugaguccaccaguauuauccaguauuguggcuauuucccaguccuguuucagcugagcagcugucaagagaaagucugugccaagccagagcuuggagauucuuggaggauguguuuagcaccaugcuuagguuucaacauacuuguucuaagaaaaaagauacuuccugaagcaagcuuuaacagucaaguuggcugcucuuaaucacaucuaauuaguacuggagauuggagaaagccuuauuagaaauuagaaugugcuucauuuccacaguugauuucagcugugauuauaggguugccuuccuucuuucucuuauacauuucauacuacacccccauccuccuaauauaguuauaucguacuuuuaauaaaaccuauauuugguuuuuucauaauuguggcuguguaaauacuauuugcuaagucaguaucuaugacuauguuuuauuucuuacagaacuuuaauuuuacuggcauucaugaauuaucucauuuuuuucauuuguuuaauuuuuuuaccuaaagcuuaauuucuuacaucuuccagugccuuuguaaaaucccucagaaauaacuaucuuggauucucugucacauuccugucuggauuuguugccuucuaggccuucuccauauguuacugugacuuugcuucaccauuuugagauucucuuaguuuuucuccuauauuggaucccuucuuugcuggauuccaugccaucuuucuuggguuucuuccugauuuugauggaauauauauucuccaguagguuccugagaaagggugcacaaagguuaaauuuuuggagacuuagccucaugacugucuaaauucuacuggugaucauauccccaaaagaccaaaucccuaaugccauaaucccaaauguugaaauacugaaagaucaaaaucucuaaaaaucagaaucccuaaauucuaaaaaucucacacaucugaaauccugaaaaucagaaucaugaaagauuaaaaucccaaauguugaaaugcugaaagccaacaccugggguagaaauuagugcacauucgguuguaugaaagauaguugcaucauuuuacuugcaucauauuagguggaaccgauugccuuuuuauuguauuuauuuggaaauuaaguaugguuuaaggagaugguuuaugggugccaaauugacgagggguggauucauggauuuaauuuuaggugucaacuugacuggauuaagaaauaccuagaaacuuguuaaagcauuauuuuggguuugucugugaggagauuaguaugugagucugaguggacuagguggggaagaucugcccucaauagcgguggccaccauuaaaucugcugggggcccagagaaaacaaauuguugccuuucugagagcuggaacggacuuuucuucugcugaauugaacaucagaacuccaggcuuguuggcauuuggacucuaggacauacaccagcagcccccuggguccugggcuuucagccucagacugagaccugguuuggcuugguucugaggucuuuggacugagccaagcuaccagcaugccagggucuccagcuugaaaaugaccuguccuggaacuuaucagccacuauaaucgcaugagccaauuccccuaauaaaucgucucucauauaucuauguauauauauaucuuauugguuaugucucucaagaaugcugucugucgagaauuaugucugucgagaaugcugacuaauacggauuugguauugagaaagccaaauaucauuccuucuuacuguauuccuuacagcacaguggaagagaccugugaaauuguucccuugcaaaaaggcugugauaaauuaaguauaccaggcuacuuaaugcugaaagagaaaaguuuaaaagcuaauuauuauugguguugugaagacagaaaaucacuuaauugcaauggccaagcaauaaccagauuucuaaauggucagcauauacuuacaaaauauuuagaccacaaccgcucuagucuaaacacaagugaauguuuugaagaucauagaagugaauaugcaggugaaaaauauaagaaagcuccccugccaaauuauucaaucagguaugacuucugcccuuucacacauagugccaauuugcuaugcuauguauuuuaucuuugcaucauuucuaauacugcagguauaaauucuguaaaggcuuuuagagaauucuaauucauuuuaugcacuuuuuuuuugcauauuugacuccaugaaagugcauuaucacaaugugacguaauguguaagcauugugcauguacauaaaaauguugaaacuugcucaguaaaugaagagauguccguuuuguucaucuguauuugugaaagauaaaauuucucaagaucuuggcucuuugggugacucuauugcaguuuuugugcaaacgguagugacccauugcaguuuuugaucgaucuugucagaagauucagguugucugguauuucagaugaccgcaguuaugaaucugggugcaccugauuaccaaccauagugauacguguuuauccauuuugcuuuuuaaucuauuucuucaugaauacauuuucucuguuccuauuauacccaugcaaugguuguuaguauaccugaguauuuaugcuugcaaaaauauguuauuagugccuauuuuauuguguaaaggggccuaugaacuguuccguuguguuuuuauguuucucaaauaaaucuuuuaaaaauggaaauaagugucuuuuagagaacuuuuuacaaauuauuuuuccagaauucaauuuuuuggauuuuguucuuuugggauugugauuuuuggaauuuuagauuuuagggauuuugaucuuuugggauuucaacauuugggauuauggcauuugggauugugucuuuugggauuauguccuaaacccaaauucugucaccaccgacugucuagugauaacauuuaaaauggaaagauaaaaugacuugauuuuuuuuuucccuuuauuuuuaacugcauuuaaaaaaauagaggcugggcaugguggcucacaccuauaauccuagcacuuugggaaguugaggcugguggauugcuugaacugaggaguuugagaccauccuggucaauaugguaaaacaucauuucuacagaaaaauacaaaaaaauuaucugggugugguggggccugccuguagucccagcuacuugggaggcugagaugggaggaucaccugaucaccugagccuggggagguuaacgcugcagugagcucugauugugacacggcacuccacccugggugauagagugacacccugucucaaaaaaaaaaaaaaaaaaaaaaaaauuaaaaaacaggaaaaaaaauuuaaaacacagagaaaccaaaaaaacuagaaaccacaugcacaugaaccagaauuucaaagguauaagagguuauggauggggaaauguaucuaugacaugagagagucuuuugggaugauggaacuguucuguaucugacuauauaaugcugguuacaccaauuucuauauguuuuaauauccauauaaaugauacuaaaagaaaaauuuuagucuguguguaugauagguuaaaaggugaaaaauuaaaagaauuuaaaaauacgaaaagguauacagcaaaaaagucuccuuccccucuuccuuuagucuucuagcuuucucuucuggaagaaaccacuguuaccaauuucuuauguauucuccuauguaaucacucuuaaacaucugaacauuugggaugaaucuggcaaaagagaaaauaacuuauauuugcuuagcuauuuucugaggaugcuagaugacuacucuuauaauaugucuaaauauauuauuauuuuuauuuuguugaggcagagucucaaucaucaccccagacuggagugcaguggugcaaucugggcucacugcaaccucugccucccagguucaagugauucuccugcuucaccucccaaguagcugggauuacaggcaugugccaccacugcacccagcuaauuuuuguauuuguuuguuuguuugagacagaguuuugcucuuguugcccaagcuggagugcaguggugugaucucggcucacugcaaccuccgccuccuggguucaagcgauucuccugccucagccucccgaguagcugggauuacagcuguguaccagcacgccucgccaauuuuuuguauuuuuaguagaaacgggguuucaccauguuagccgggcuggucucgaacuccugaucucaggugaucugcccgccucggccucccaaagugcugggauuacaggcaugagccaccgcucccggccauuaauuuuuguauuuuuuaguagagaugggguuuugccauguuggccagauugguuucgaacuccugaccucaagugaucuacucgccucggccucccaaagugcugggauuacaggcaugagccacugcaccgggccagaauauguguaaauauauuauuaaucauacuuaguacuaauuuauuaaauuacuucuuuuacaguuggcaaacaugaauugacugggcauaaaguagcugugaagauacucaaucgacagaagauucggagccuugaugugguaggaaaaauccgcagagaaauucagaaccucaagcuuuucaggcauccucauauaauuaaacuguaagcucuguuuauauuaaauauaguccagucaucuuuucaucuuuuuuguuaaccuacuuaaugugacaagugagaaaaaugacugacacuucuuuuuguuuccuaaggguuuugaaaaguuucuuccuaggcugugugcgguggcucacaccuguaauuccaguacuuugggaggcugaggcaggcggaucaccugaggucaggaguucgagaccagccuggccaacauggugaaacccugucuccaguaaaaauacaaaaauuagcugggcaugguggugggcgccuguaauaccagcuacucgggaggcuaaggcaggagaauggcuugaaccugggaggcggagguugcagugagcugagaucgugccauugcacuccagcuugggcaacaaaagcgaaacucugucccaaaaaaaaauaaaaguuucuucccauucauguauuuuucuaaccccauugauggucauuuaagccuguguucauguuuugcccuugugcuuaucagcuguuaucuucucauucuuuccugucuccuggaaagaugcucuucugguaauguuuggugccccauugcuguaaaaccaacagugaucugcuaguaaaaacucuugaccuccaaaugcccacaugaugucaguuagccucacuagugagaaugcgguaguagaaaggguuuuuccccauccugcuuauaccugaacauauagauaacaaaauuucaggaauccaagguuucaaaagggcaguaaucuuacuguuguuuuacaguugccaguuauagagucuacaaauaacuauuuccugcucagcuucugcuuuguuaugcaggcaauaacuuaaagaugcuuagguuuuucuccugaacuggcugacucaaacuuguuucacucuuaccucuucucauuuguugagugcuagguuuuaaauaccauccauaugcugaccaccccuaaauguacaucucuugcuuuaagaucucuucuuacaccagacuuauuugcucacugcugacuuuacauuuccauuuggauguucgcaagacauuuaaaacucaacccggcccaaaaugaacucuuuauuacucucccaaaccugcucuucccacaguuuucaccaucuuggcuaacagccaaugacccagggcuaaaacuuaggaaccauuuuuaacuucccuguuucuuucacuuucuaccaugcauuucauuucuuccuucacaaucaagcuaggauuugauugcuucucaguuccuuuauugcugucaaccuggucucagccaccaucugucucaugaaauccugaaguaaccuccuguggcuaccuuuacuguugacaguuaauucuucacauugcugccauaguuuuacuuuuaauaugccagaucacaugacugcuuaaaacguacgauagcuuuucaucuuccuuggaguaaaagccaaagccuuaucauggcuuguaaaauucugugucuucuggccugcaguuaacaccuuugacucuacauccuauuucucucuaauauuccucgaacaugccaagcaggcuucuacuuggggaccuuugcaguugcuauucccucucccaguuucgcuuuccuccuagauaauuacauaauuuguucccauucuucuuuuaggcucagcucaaauguuacuuuauuagaggcuuuccuuuagcacucuguauacaaagauuccccuucauuugcuuuauuuuucuucauagcauguuccaccaccugagauauugcuuauuuauuuagugucuguuuccugguuccuggaacaugaacuccaugagagcagagaauuuuuguuuccugcaguuuuucuagcuccuagccuaguaccugguauacuauaggugcuuaguaaauauuuauugaaugaaugaauauauguguuuuaauauuuguagacaauguuuucucucaccagguaccaggucaucaguacaccaucugauauuuucauggugauggaauaugucucaggaggagagcuauuugauuauaucuguaagaauggaaggguaagcuguucugcuuuaauucuguauguauuuuguaacuccccuuuauccuuuacuagcaucaaaaugucagcaaccaauuuuaagaggucuauuuaauaaccaguucccuuagucauauauuuguuuagaaucauaaacuauguagaacuagaaaggaucuuaaagauuaucuccuuagccuguuuauacagauguggauacugagccucgcggcuuauaugauugcucacaguaacgugauuuauuaaugacggaauuggcuugagcccccagaacucauaauccucagacuuaugcuuccaggguauacaaauacuuugaauauguaucuuaauguaauuaaucguuacaaaauauauuauuauuacuuaaagaucuaggccuugcuagucaauucuagccacauuuaaauugcauucauuuuuugguuucagaaaucugauguaccuggaguaguaaaaacaggcuccacgaaggagguaggaauuagauauaaagaauuuacagcuggaaggaacuuuguaggacauuuugaacacuaccuuaaguuacagauacaaaaacucaacacugcccucugcccauacuuuuucucauacccagguuaugugguaugcaaaagccccuuugugggagagcuguagcuagcccugaaaagagagcuuuucucucaauuuuaaguuauuuacauuacucauucauuuguucuauauagcaugucuauuuacuuuuaucaaaaucaaacuuauuaaccaaguuaauuuugauuuuacuauuucuuaacaugauucauuucuauuucagguacuccccuuuacuccugcuucuccuuaccaaaaaaaaaaaaaaaaaaaaaauucugccuggagaaaugggaaacaggcacaauugauauauauuuuucuuaucuuuucuguuguuguuuauuucuugguuuuaccuuguggguauuucuucaguuuuaccaguugaauauuaaaauuucagcacccguauuuucuauuucaaaaguuucuuauuuucugaaauuuucauuuuuuuagucugcuguuauuugccucacagauauaauaaccuagucugaggauggcauuuuaaaaaaagucuuccucuguuccgucuuguucuguaccuucugugcucucugcauucauuuuauucauuuuugucuuugaugcauggcccuucuucagauauuuggugauucuuggcuguccacuaaauauuuaagaauaggguauuaaaugccaggcucauguggguaggacuuacugauugcuggguuuucucauagcuugaauagguagggacuugucuguuuuauuacuguauaccaaaugcuaauaauaacaaauauguuuucuuggaucagauauuugcuccagaagaaaccuucccauuuccuuaaaggccuuagcuuagcugccagugcuccaggagcugaguggagaaaagagaugcaagucucacuaguuaguauguugacuuugucuuagcccccauguuuuccuuaggaugccuuaucccugccuugguguccuugagagcagagcugguucagccuuacuagaguaaauuauaggucuuauuccccaauaugggugaguuuaaaagcuucuuacuucaagcacuuguccuguuuucagcucaucucucacuucuaccuugagcaguucccuguguuuccaauuucuaaggcuucccaggcuuuguaugcagauguuuauuuuuuacugguuucuaccccuauaggcuuagguuuuagcuuucucuuguaggcuuagucuuuauuacuguuuaucuauugucauccuuggugacuccucuugauuacugcugucucuuuuguucuuuuugucuuuauaugccuguuuuauugcugaugucauuuuagugauguuucaagaguuggagacaaaagauuuaaucuguuacauuuaauuggaaauguauuuugacuuuucuaaccuuccuuuauagacaucccuuucuccauccuuuguaauuguacuuguuacuaauacaguauaauuuucauuuuuguagccugucuauuuuacuuuuuauauuuuguuuaaucaaguuuucuccuauuuuuucauauuugaacagauacucuuuuuuuuccccaugaaccuacaaaucuagaaauaaaaguauuagaaugcuaaaggauuaguauuuuucuagaggaaugguaucuuauaauaguuucuuguuucaaaauaaauuacugauuuguauuuucucccauauuauccaugcccuuuaagguguaagucugguuuuagaaugcuaauuugugaccuguguuagagaauugcauauuggaguccuucgccuagaggauuaauagcuuauuuauuaaauaugacuucuugggagcaggcauguccaaguaauggcugucacuuauguugaaaaaagugguaauaauauauggauacauagagaaguuuaaaaaaaauacuucaggcugcaugcaguggcacaugucuguaaucucagcacuuugggaugcugaagcgguagauugccugagcucaggaguucgagaccagccugggcaacauggcaaaguccugucucuaucagaaauacaaaaauuagugggcgugguggcaugugccuguggucccaacuacuuaggaggcuggggugggaggauugcgggaccccagggaagccgaggcugcagugagccgugauggcaucacugcacuccagccuggaugacagaacgagacuggaucucaaaauauagauaaauuuaaaaccccgcccccccaaaaaaacacaaaaaacaaaaaugaaaagguaguugcuauguaagauuuuuuuuuuagcaagcauauuaaagauaaaaugcuaugauauuuuauuaaaugaauuaagguguuuguuguuaaaaugucuucuauuuuaggacauauagcaacauaguugcuugcugguuuaugaauagugcuuaaauauuacuuccucauggucuaaaauagugucccucaccccacuaucacucacugcaccuauauuuugcuuuauuuuucuucaaaacaguaucacuccuucugacuauauuuauuagucuauuuucaucaacuagauuagccuuuguuuuauucauugcuguguaaugagugucuaaagcaauguguagcacguugaagguauucaguaauuuguuaaaagaaugaaagaguaaacauuugccgcuuauaaaaggaaauaugccaaauuucaaguagauauugaaauuauuugaaauaacucaugagauauagaggaaggcaagcuguuacaauguagucauaugcaaaugauaauauuagaaacuugaguuacugauuuggguuccaagaccaucuuagcauuucuguuuugugcugcagguaucuccuccucaugucaaaaguaucucauaagugaaguucauugggaagauuuucauguauuuugacaauuuuauagguuggagaauuauagauaggacaauuuacuuugaaagacacaccuuuaaaaagccucucuaacuuuucuuagcuggaugaaaaagaaagucggcgucuguuccaacagauccuuucugguguggauuauugucacaggcauauggugguccauagagauuugaaaccugaaaauguccugcuugaugcacacaugaaugcaaagauagcugauuuugguaaggauaauuuuauaguuucuuaacguucauuucuaauguucuuauaguuucaaugaaccuaccuagaauucuucagauaacuguaaaagauuacauaaaguaauagacugaguauaucaaaguauucuguuuugucuaugaagauacaaaaagaagaaaagcuaagaaaucaucuuuucuuagcuuuaaaugucuuuauuacuauuauuuuauagaggcaggguuucgcuuugucgcccaggcuggagggcagcgacgugaucauagcucacugcauccccaaacuacugggccaggugacccuccugccucagccuccugaguagcugggacugcaggcgugcacuaccaugccaggcuguuuugucuuuuuguagagacaaguucucacuauguuguccaggcugcucuugaacuccuggccucaagugaucuuccuaccacagcuucccaaaguauugggauuacaggugugcaccacugcaccuggcucuuuaaauaucuuuaaaauuaaauuuuaaacaacuuaaguugguaguauuagagagacuauuugaaaagaguauuauuugugaaagagaagguagcagcuuuauuuccaguauguucaaaagaaucaaguauggagaagaaggaaagugagugggauggaauuauuuaaaaccuuaaaaaccagaagugaacuaugugaauuuaauuauuuaaaauuauuuaaaacaauuuuuuaauuaaaaaaauuuauuuaaaaauuuaaaaauguuuuaaaugauaguaaauuauaauuuguuuaaagaacauuuugauuguuaaaaaugaauuuauuuuggcugggcgugguggcuuauaccuguaaucccagcauuuugggaggccgaggcgggcggaucaccugaggucaggaguucgagcccagccuggccaacauggugaaaacccaucucuacuaaaaauacaaaauuagcugggcaugguggugcgugccuauaguccccacuacccuggaggcugaggcaggagaauugcuggaacccaggagguggagguuguagugaguugagaucgccuguccggccugggcgacggagugagacacggucucaaaaaaaaaaaaaaaaaaaaagaauuuauuuuuucuguauuuccuauauaaauugccauugaccuuacuaaaccuaagagaaaaaggaaucucuucuuuucuuuagguugguuuuaguucaaaucagauaacuuuuuuuuguuuguuuuuuguuuugagacagaguuucacucugucacccaggcuggagugguacgaucucggcucacugcaaccucugccuuccaggcucaaguaauucucccaccuuggccucccaaguagcugggaccacagaugugggccaccacaugcagcuauguuuuuuuuaauuuuugguggagauggggaaucacuauguuggccaggccggacucgaacuccugagcugaagugauccgccugucuuggccucccaaagugcugggauuacaggcgugagccaccaugucuggcccagagaacauucuuauaaaaauuuuccucaguuuugacuacaucuauguaucuauaucuauaacuauaucuauuuaaauguucagagauuaacuggaaaaugccaaccaaaccugagcugguuguuuugguguuuuguuuuuuuuuaaaauaguaauuggcuaaauuauuugaauuucuuauuccucaguugauuauuuuuauagggugcauuuuugagggagcaacaguuucuuuuuggaguaaaacugugagggaacuuugaaauucaaaauuacuguuuuuuuuuuuuuuuuuuuuuuuaaagaaucagaacaggcuuaauaggaacuuugaauuuuaauccuucuauucaucuguuauagauuauuuucccuagugauuucuguauuaauaaaacuuaaacauggcaaguuuuuucuaauaagcaaaauaaccaacagcuuaauauauuuguauuaaacucuaacagugcacuaacuuuaaauguugaaauagauuacacauuuuagggcauaauggcagaauauuuggcuacaauagaccauaggauuuuguugaagcaaauaacaaaaugaugauuuaucauuuuaaugcaaacucaauuuuauuguuuaaugggauuuuaauuuuugucuuugggaaaucuuuugaguagcugauuuugugcacuuucaggucuuucaaacaugaugucagauggugaauuuuuaagaacaaguuguggcucacccaacuaugcugcaccagaaguaauuucaggaagguaguauuugauacccugccucccucaauacauuugaaauugucuuuuucuccuagauuuuguuagucuauagugucauauuuaauucuaaugaaaggaaagaaagauaaggcuuauucuuaaccacauuuauaugugaaugaggguuaaggacuacaagucaacauuauauuaaaguuguuagaagagaguacauuaauuuuuuucccagguggaagaaauggaaaguuuaaaacuaggguguuuaaaaaguagguaagacacuggaaacuugaauaauacagaaauaucuaguaguuagaaaaggauuacuauuuacuuagaggaaaaauuaaacauguaauguguagcuuuaauuuuuuacauagauggcauuuuguaguaccuuuauguuucaugauaaaaugucuuggggaacugggcugaaguaaucuuuagacuucauuuauguugaaucuuuguucuuuaaaccuuuuagagacugcaauauuauaagaauuuuaaccucucaauuuacuaacuaccagcauugagaacaugaagauauuuguacagugucgcuuuuugaauaguuuggaaaacaggagaauuuaauauuuuuaagaauaacucuuuguccuucacuauacuacugaaauugaaaacagaagcugaaguuugcuagauuuauaaugaacuuuuaauaacuuuucacccaaaccaugcuuauuugugugaauguuuugcaucuugauuaacucaaugcagaaauacuguaguauuuucuauuuuuauaagcuuguuggccuagacugcucaaagaaaugagauuuguguaaaaauauggcugugaguaaggcaggaguaccuaauuuuagauuugucaaguuucaucuuuuuuuuaaauauuaacuuaaugucaaaaauuauuuaaaaaauuuuuaaaaaaaugguguugucuaucuuaauucuuuuaggaauaaaacaauucaggacauggagacuguggaaaguuguuauuuaaauaaauaaaaagaaauguuauaacugugcauauaugcaaugggcuauuacugaaauuuaauuuuucuaguuuggauaaagucuuucuucaagcucuugguguaugagaacuuuuacuuucaaaauaauauuuaucgaucaguucagcaguacauaaauuuaaagaaauccuuuuccugaauccaggcuuugaaugggugaucuaacuagucugcagcuaguuaaggcacuugacuacaaugcacugcaaacgggauuuaaaaacucugugaaccaauuugccuggcuuucuuucacagccucaggauccuuucaccuugguguaaggggucuuguguuauugggauugugggcucagaguccauuacuaaagaacauucucaguugaugaaauaucacuuaaucucuccucuguaacaaaaaccaaugguuuuaaauugaauagugauauguuuguucaagauuuggcccuauugucagaucccaucagggccauaguaaauaguagaacagaauuuuagccaugguguguaauuuacaaacuucuugacuuuuguuuucaaagauaauacugauggaauuaacguuguaacauguaguaguggcuauaaaaaccauauucugcuuaagaauucuuuaugaaauauccauauuugaaguuuuugaugaacugaaucuuagguuaaaaugauucuuuaauccaauuguuauuuccuguuacagauuguaugcaggcccagagguagauauauggagcagugggguuauucucuaugcuuuauuauguggaacccuuccauuugaugaugaccaugugccaacucuuuuuaagaagauaugugaugggaucuucuauaccccucaauauuuaaauccuucugugauuagccuuuugaaacauaugcugcagguggaucccaugaagagggccacaaucaaagauaucagguaauaaagcaguuuggaaguuaucagaucugauaguauccaugauaaaaguuaugugaaaaaaaaaaaguugcagaacagaauauacaguguaauccuguuuuuaugugaaaaaaauagaguguauagacacauuuauuuuauuuuguuauuagaaauacauaguaaacugguuaccuuagggaaguaagauucguaagagggagggcuuucacuuuuuacuuacacaucuuuguuuugaaauuuuuacagugaacaucauauuacuuuuuaaauuaacaaaaaagcuaaugaaagauuggugcuguggcucacaccuguaauuccagcacuuugggaagcugaggaaagaggaucaugugagcucaggaguuugagaccagccuggguaacauagcgaggccccauauauauguauaucuuuuauuuuuauuuauuuauuuuuuuugagacaagguuuugcucugucacccagccuggagugcaguggugugaucauagcucacuguagccaguaacuccugggucaagugauccucccacuuuagccucccuaguaguugagacuacaggcauccaccaucaugccuggcuguuuuuuguuguuauuguuuugcuuuuuguuuuuguuuguagugacaggucuugcuauuuuugcccaggcuggucuugaacuccuggccucaagugauccuugugccuuucccucccaguguugggauuacaggugugagccaguaugccuggcguuaggauuaauacuuuucaguaguaaauuuguggguggcuauuuuauuucuuaucucaugaauuauuguauuuuuuuucuuuuuuuaaucccaaggaaugagauuuaauugacauguuuuuccugguaguauacauugaauuacaugcaaaauuccuguuuuguagguaaaagucaguauaaccaguuucaucugguucaaccuaauaguuuaaauuagacaaaaaugacgaugacaaauuuucuucucaaauuagagugagccauuucugaugaagacuuaaacaauuuuauugcaagccuuguuucuuuuuuuuccccccuguggaaauuuugguccuuuuggucuucuaauggcuagacugcacauuuaucugagaaggaagaaagaaaucagauauggaucuaggaauaguaaauaugaaagcauuaguauaaugaagaagaaggaaagauuauauguggaacuugaagcuugauuacuuuccacuuacuacacguuuuagacuagcuaaaaaagagaccaugaauggcacggcaugauuuuaucaccaaagggaaaggacaaaucauucucuaaaauuuauauuuuaagauaucuagguaagaaauguuuuuguuuguauuuuaccuauuuucuuccaauuaaaauauaauacaugacaauugaaaaaacuuagaaaaacaccaacaauagagaagagaauaaaaaauuaucuuuaaucccaugacccagaagauaaccauuguucuuuucuuguuuuuuuuuucgucucuggauuuuauuuaguuuuagcaaagugacauaguucaggucaaacauauucuuaaauauacgaaguuagggaauuagaauaggaaaucauucagggcauggccuuuccagucacacagaacugggucauaauccugguucugucacuuacugucuuugugaccuugagcauguuccuugauuuuuuuuuuaaccucaauuccuucauuuaaaacaaagagauauuaucuucauauaauuguuucgaugaugaggggagauaguguauaugaaguguuuagcauaaaacuuagcauauaguaaguacucaguaguugucuacuauuuuucuuguuguuacauuaucuucacuuaacauuauaucaaaagaguauuauaaugaagcuaccuaauauguucucuuucuaagcuggaaauaagcuguucuuuucauuguuugucgcugucauuugucccauaacuuuuuuccccccauugcugugucaauacauucucccucuuaaaacuggagggaaauuggagcauuucccucaacauacacaaugaagugcgagcuagaagaggaaaauuucagugcaaaaagugacaauaauacaguaugaauauaaauauaaauuaagucauauucuaaauucccuaaacuguuacuuucagucucagcucuauucaaaguccuucuccugauccugccauuuuucucucagggaacaugaaugguuuaaacaggaccuuccaaaauaucucuuuccugaggauccaucauauaguucaaccaugauugaugaugaagccuuaaaagaaguaugugaaaaguuugagugcucagaagaggaaguucucagcugucuuuacaacagaaaucaccaggauccuuuggcaguugccuaccaucucauaauagauaacaggagaauaaugaaugaagccaaagauuucuauuuggcgacaagcccaccugauucuuuucuugaugaucaucaccugacucggccccauccugaaagaguaccauucuugguugcugaaacaccaagggcacgccauacccuugaugaauuaaauccacagaaauccaaacaccaagguguaaggaaagcaaaauggcauuuaggaauuagaagucaaagucgaccaaaugauauuauggcagaaguauguagagcaaucaaacaauuggauuaugaauggaagguaagaaagaaauaacauuuugauuauuagcauauuuggcaaacccauagucuauaaaauguuuuauagaagaauuacuuuugacuugguuuuuguuauaccaugugcuagguuguaaacccauauuauuugcguguacgaaggaagaauccugugacaagcacuuacuccaaaaugagucuacaguuauaccaaguggauaguagaacuuaucuacuggauuuccguaguauugaugguauguacaucacacaaaacaacauagauuagaccuuguuacuaacuugguauuuuacgccuugauucuuuugaggcuucuugacuuguuccuaguaauucaacugcaaaggaauaaaaaaugugauuucuugugccuuugcaauauuaacauuuaugaaucuuauuuuucuuguaaucuuauagcauauuguccuuuuaagauuaucaucuuguaaaauccuuaaagccagguguagucugauccuaaggugauaguuuucugcugcauuuguuuuuuugguguaguucauuuugauaagagacaauguuuuauuuagaaauaaauauugacucuucuguaagcuuuuauuuauuauuaaauaaguuuucaguuaagaaugaaguuauggcaauucuucauuggccaauucaauugcauuaagcuacgcuguugagugcaggugugguggcuuaugccuguaaacagcccagcacuuugggaggcugaggugggaggauggcuugagcccaggaauuugagaccagccuuagcaacauacugagacucugucuuuacaaaauauuaaaauauauauauauaguaucaccuuugcuuauggaagguugcauagaauuauuagaugagguucacguuugaauuuuuuucuucuuuauaaacucaaagauaguacacacauaguagcagaaagacacagguuugagccaugauauguuggccaaaccaguuugucugguuaucuuuagguccauauaguacguaucugcuaacauauacuaaugcagucugaaauacggaaugaguuuuauuuuucuuguauuuggaucaaauuugcaaccuuagauuuacuaguacugggguauaccaauugaaugcccauuuuguuuuuguacuguguucccaaccuuaguuuuucuucgauuuuuauucauuggaauuguugcucuuuuaugaaauacuaaaugaaauaugaagggaaaguggaaaguaaaaagcacugagcugagacuuaggagaguuggguucuagacuuaccuuucuguucauuuguuaccuugggcaagucauuucucuggguuuguuuucuuaucaauaaagugaggggcuggaugagaugguuuccaguauacccuccaaauuuuaagugcaucgauucuaugauuuuaauauagagggauuacuuuuuauugcuauagaauaauauuuauuaaucccuagauuguugguuuacugggcucuuaaccuuggauugcaacugaugaguagcuauacuguacccaacuuugguuagcuaucuugagaauacauacuauauguaaaaaagaugaauaguuuaauacaggcucauugacuguuuuagaagguauuuagaauaagcgugcucuugauagcuggccagcagccccacuuaaagaagcaaauucaauacuguuacaaaaauuuuugggagaaggucauagacuauaauaaauugaaauucuuuuuacccagaugaaauuacagaagccaaaucagggacugcuacuccacagagaucgggaucaguuagcaacuaucgaucuugccaaaggagugauucagaugcugaggcucaaggaaaauccucagaaguuucucuuaccucaucugugaccucacuugacucuucuccuguugaccuaacuccaagaccuggaagucacacaauagaauuuuuugagaugugugcaaaucuaauuaaaauucuugcacaauaaacagaaaacuuugcuuauuucuuuugcagcaauaagcaugcauaauaagucacagccaaaugcuuccauuuguaaucaaguuauacauaauuauaaccgagggcuggcguuuuggaaugcaauuugcacagggauuggaacaugauuuauaguuaaaagccuaauaugcagaaaugaauuaagaucauuuuguuguucauugugcaguauguauauagcauaauauacacagugaauuauaggucucaggcuuacuugauuuuuggcuauuuuauauuuaguguacacagggcuuugaaauauuaauuuacauaaaggccuucauauauuauuacguguuauauauuacguguuauaaauuuauucaauaaauauuugccuagaauucccaagaccuuuauaggugauuuuguuuucugggcuccuuaacuucauaaauagcuaguaucuuccagcaguaguaacagucuggauaacuucuuccauaucccucccucuuuguuuuuuugagacagugucacuuugucacccaggcuggagugcaaugguguggucucggcucacugcaaccuccaccucccggguucaagugauucucccgccucagcuuccugaguagcuggaacuacaggcgugugccaccacacccggcuaauuuuucguauuuuuaguguagacgggguuucacuauguugcccaggcuggucucgaacuccugaccgcgugauccaccaccucagcuucccaaaguggugggauuacaggcgugagccaccgcacccggccuccauaucccccuuuuaaaauucuguaguguaugguaagucauaucagauaucagaccuaauuuaaauuucauuuuagcuuuacaaguccaaaaacacagaauuuauauauucagauacucuagcacuaauuuuagucuuaaaauauucccacgauauucuguacacaaaauguucuuuuuguuacaagagcugaguugcauauacuguagauaaaucauauuauuuuugccaauuucacaaauuccucuggcccaucaugucagucauuauugaguauaugcacacauugcuacuuauuugauuauguaucuuuuaaauugauucagugcauagaaaacuaucucuuacaaacuuuaagugcucugauaugacuucccccccaaauuuuauuaugaacauuuuuaaaaacagaaaaauugaaaaacuguuugguaagcacauguauaucuaccauuuagauucagcaguuguuaauguuuugucauuuguuuucucuauaccuauauauguauagauacagcuaguuaugcauauauaugcauauauguguuuguuuguguauguauauaugcuuuuuucccccugaaccauuuggauguuacagacauacuuaucaccgugaaaauacuucaaguaucuccuacagauaaugacauucuccuaaaaauccguaauaccauuguaaaaguaauaauuccccaauaucaucuaaucaagccauauuuaaauuucugaaguuaacuccaaauuucuuuauagcugauuauuucaaacuaggauccaauuaaaguuuacauaugacacuugguuauaacucuuuaguuggauauaacauuauuauuauuuugauaaaauauggaacaaaucaauucuauuaauaaguggucacauuuguuuugggcuuaaauuacuuuuuaaagauacuggauuuuccuaagauuucugauuuacacugauauuuuuuuuugucauucuuaauugcaucacacaauagauguaaaugaagauguagucaccucagauaaaauugguaucguguaugauaauauuguaucauuuauauuugccuuauguuaacuuuaagaaauugauuuuuuuguauuaaucauuuucccauugcaacagagcuauauuuuuucuauuuuaagaaucauauuuuaggauuauuuuuggcaaauacagugagcacuuauguaaccagaugauaaugaacucaaaugucaugauagcuugcauaaauggugacucuaguagauuugacucaagcacuucuagaaucaugcacugaauucaaaagaaaaaucuugcugcuuuuuguccagggcuuguucuauucaacuucuaauuugaaagcuguacaaaguaauagaaguuccauuuaaauaugaguucaaaacuguauuuacuuuuuauguggcccucucuuuaggggauucuaauuuuacuuagggucucuaagugcagcauaauguuccugauguuaacagaagacuguauuuuuaaaguuacaaauuuguauauggaauuaaguaauggcgcuauauacgcuguuguggggaggggggaagaaaaggaggaaccaauuaaauaggaccuuuuaaaaauuguuaauuuuguaaacuuugcuucucuuauaaguuauugugauucauuuuaguuacuguguuuuauuuugaaaauauuuaaauauugcacuucuauaaauaguaugauaaaugcacagacaauugcaguaaauucuuuuuuaagcuaggauauuugaaaugacaaccuuugguuaagugugucaagguugcaacagaauuuucacaauuuuuuuguuguuugcaaauuguuacuaauauugaagagguaagggaggcaaugcaaaugauuuuuaaucuuuuuuuauuaucuuuucagcaguuuauauuuuuugugacuuuaugcaaccauauuuuuacuuugucuugacaacugaaagauguauaagguuuuuugccagaaauguacuguauacauaguuuuaaguauaacagauuuuacugauauguaaaaauuuugccauuaaaauaaaugauuucucacugagaggaacuuuucuaccagguuggggcauaugggagcuuaauauaucauaucuaauuuaaaauaauuucacugaaauaaacuccauugcuuuuaccuaauuuuuuucuugagaugcuuuuguaguuuuucagaguuuuagaugauuuuauacaaaauccucugccuagcacugcucuuuuugauguuguagugacaccauuuacauugaauuaaugcuugguagccuggggcuagauguggaacuccauggaucuguguucugacuggcaccuuuggaaugaaagaaaagugugugcuguccaaauuuuuuccccuuaauucuuucccucaucuucucacccauaauagaaauuuuauuuccauugugaguucugacaagaaugaaauuccacauacaacauaacuguaaauuguugguagguagaaguuaauauuugugguucauguauauuuugaccagaguauauuuaaguauauaauuucagcuuccuugauuuagaaauaugauauaauaaagaaaaacuccauuuaucaucuguua
